United States Patent
Krieg et al.

(10) Patent No.: US 10,058,623 B2
(45) Date of Patent: Aug. 28, 2018

(54) COMPOSITIONS AND METHODS FOR MODULATING UTRN EXPRESSION

(71) Applicants: Translate Bio MA, Inc., Lexington, MA (US); The General Hospital Corporation, Boston, MA (US)

(72) Inventors: Arthur M. Krieg, Cambridge, MA (US); Romesh Subramanian, Framingham, MA (US); James McSwiggen, Arlington, MA (US); Jeannie T. Lee, Boston, MA (US)

(73) Assignees: Translate Bio MA, Inc., Lexington, MA (US); The General Hospital Corporation, Boston, MA (US)

( * ) Notice: Subject to any disclaimer, the term of this patent is extended or adjusted under 35 U.S.C. 154(b) by 0 days.

(21) Appl. No.: 14/401,196

(22) PCT Filed: May 16, 2013

(86) PCT No.: PCT/US2013/041452
§ 371 (c)(1),
(2) Date: Nov. 14, 2014

(87) PCT Pub. No.: WO2013/173645
PCT Pub. Date: Nov. 21, 2013

(65) Prior Publication Data
US 2015/0099791 A1 Apr. 9, 2015

Related U.S. Application Data

(60) Provisional application No. 61/647,886, filed on May 16, 2012.

(51) Int. Cl.
*C12N 15/113* (2010.01)
*A61K 47/48* (2006.01)
*A61K 48/00* (2006.01)

(52) U.S. Cl.
CPC ........ *A61K 48/00* (2013.01); *A61K 47/48023* (2013.01); *A61K 47/48246* (2013.01); *C12N 15/113* (2013.01); *C12N 2310/11* (2013.01); *C12N 2310/315* (2013.01); *C12N 2310/321* (2013.01); *C12N 2310/3231* (2013.01); *C12N 2310/351* (2013.01)

(58) Field of Classification Search
None
See application file for complete search history.

(56) References Cited

U.S. PATENT DOCUMENTS

| | | |
|---|---|---|
| 4,725,677 A | 2/1988 | Köster et al. |
| 5,491,133 A | 2/1996 | Walder et al. |
| 5,576,208 A | 11/1996 | Monia et al. |
| 5,623,065 A | 4/1997 | Cook et al. |
| 5,652,355 A | 7/1997 | Metelev et al. |
| 5,661,134 A | 8/1997 | Cook et al. |
| 5,912,332 A | 6/1999 | Agrawal et al. |
| 5,914,396 A | 6/1999 | Cook et al. |
| 5,919,619 A | 7/1999 | Tullis |
| 5,965,722 A | 10/1999 | Ecker et al. |
| 6,015,710 A | 1/2000 | Shay et al. |
| 6,046,307 A | 4/2000 | Shay et al. |
| 6,107,094 A | 8/2000 | Crooke |
| 6,143,881 A | 11/2000 | Metelev et al. |
| 6,146,829 A | 11/2000 | Cook et al. |
| 6,197,944 B1 | 3/2001 | Walder et al. |
| 6,210,892 B1 | 4/2001 | Bennett et al. |
| 6,294,650 B1 | 9/2001 | Shay et al. |
| 6,326,199 B1 | 12/2001 | Cook et al. |
| 6,346,614 B1 | 2/2002 | Metelev et al. |
| 6,359,124 B1 | 3/2002 | Ecker et al. |
| 6,395,492 B1 | 5/2002 | Manoharan et al. |
| 6,451,991 B1 | 9/2002 | Martin et al. |
| 6,503,754 B1 * | 1/2003 | Zhang ............... C12N 15/113 435/375 |
| 6,531,584 B1 | 3/2003 | Cook et al. |
| 6,608,035 B1 | 8/2003 | Agrawal et al. |
| 6,677,445 B1 | 1/2004 | Innis et al. |
| 6,727,355 B2 | 4/2004 | Matsuo et al. |
| 6,753,423 B1 | 6/2004 | Cook et al. |

(Continued)

FOREIGN PATENT DOCUMENTS

| | | |
|---|---|---|
| CA | 2805791 A1 | 1/2012 |
| EP | 0 999 270 A1 | 5/2000 |

(Continued)

OTHER PUBLICATIONS

Exiqon, "Locked Nucleic Acid (LNA™) Custom Oligonucleotides for RNA and DNA Research" [online] Aug. 2009 [retrieved on Jun. 6, 2016] Retrieved from the internet: <URL: http://www.exiqon.com/ls/documents/scientific/lna_folder.pdf>.*

(Continued)

*Primary Examiner* — Tracy Vivlemore
(74) *Attorney, Agent, or Firm* — Wolf, Greenfield & Sacks, P.C.

(57) ABSTRACT

Aspects of the invention provide single stranded oligonucleotides for activating or enhancing expression of UTRN. Further aspects provide compositions and kits comprising single stranded oligonucleotides for activating or enhancing expression of UTRN. Methods for modulating expression of UTRN using the single stranded oligonucleotides are also provided. Further aspects of the invention provide methods for selecting a candidate oligonucleotide for activating or enhancing expression of UTRN.

32 Claims, No Drawings
Specification includes a Sequence Listing.

(56) References Cited

U.S. PATENT DOCUMENTS

| | | | |
|---|---|---|---|
| 6,794,499 B2* | 9/2004 | Wengel | C07H 21/00 536/22.1 |
| 6,831,166 B2 | 12/2004 | Manoharan et al. | |
| 6,919,439 B2 | 7/2005 | Manoharan et al. | |
| 7,015,315 B1 | 3/2006 | Cook et al. | |
| 7,041,816 B2 | 5/2006 | Ravikumar et al. | |
| 7,045,609 B2 | 5/2006 | Metelev et al. | |
| 7,374,927 B2 | 5/2008 | Palma et al. | |
| 7,449,297 B2 | 11/2008 | Freije et al. | |
| 7,655,785 B1 | 2/2010 | Bentwich | |
| 7,683,036 B2 | 3/2010 | Esau et al. | |
| 7,687,616 B1 | 3/2010 | Bentwich et al. | |
| 7,687,617 B2 | 3/2010 | Thrue et al. | |
| 7,709,456 B2 | 5/2010 | Corey et al. | |
| 7,858,592 B2 | 12/2010 | Shames et al. | |
| 7,879,992 B2 | 2/2011 | Vickers et al. | |
| 7,888,012 B2 | 2/2011 | Iversen et al. | |
| 8,092,992 B2 | 1/2012 | Kuwabara et al. | |
| 8,129,515 B2 | 3/2012 | Esau et al. | |
| 8,153,602 B1 | 4/2012 | Bennett et al. | |
| 8,153,606 B2 | 4/2012 | Collard et al. | |
| 8,222,221 B2 | 7/2012 | Corey et al. | |
| 8,288,354 B2 | 10/2012 | Wahlestedt | |
| 8,288,356 B2 | 10/2012 | Obad et al. | |
| 8,318,690 B2 | 11/2012 | Collard et al. | |
| 8,361,980 B2 | 1/2013 | Kauppinen et al. | |
| 8,404,659 B2 | 3/2013 | Kauppinen et al. | |
| 8,415,313 B2 | 4/2013 | Mourich et al. | |
| 8,846,639 B2 | 9/2014 | Swayze et al. | |
| 9,328,346 B2 | 5/2016 | Lee et al. | |
| 9,567,581 B2 | 2/2017 | Lee et al. | |
| 9,593,330 B2 | 3/2017 | Collard et al. | |
| 2002/0160379 A1 | 10/2002 | Cook et al. | |
| 2003/0198983 A1 | 10/2003 | Zhou | |
| 2003/0208061 A1* | 11/2003 | Manoharan | C07H 21/00 536/25.3 |
| 2003/0219770 A1* | 11/2003 | Eshleman | C12Q 1/6869 435/6.14 |
| 2003/0228690 A1 | 12/2003 | Baker et al. | |
| 2003/0235822 A1 | 12/2003 | Lokhov et al. | |
| 2004/0002153 A1 | 1/2004 | Monia et al. | |
| 2004/0038274 A1 | 2/2004 | Cook et al. | |
| 2004/0096848 A1 | 5/2004 | Thrue et al. | |
| 2004/0241651 A1 | 12/2004 | Olek et al. | |
| 2004/0248840 A1 | 12/2004 | Hansen et al. | |
| 2005/0003369 A1 | 1/2005 | Christians et al. | |
| 2005/0026160 A1* | 2/2005 | Allerson | C07H 21/00 435/6.11 |
| 2005/0054836 A1 | 3/2005 | Krainer et al. | |
| 2005/0108783 A1* | 5/2005 | Koike | A01K 67/0276 800/17 |
| 2005/0130924 A1 | 6/2005 | Monia et al. | |
| 2005/0164209 A1 | 7/2005 | Bennett et al. | |
| 2005/0176025 A1 | 8/2005 | McSwiggen et al. | |
| 2005/0203042 A1 | 9/2005 | Frieden et al. | |
| 2005/0233455 A1 | 10/2005 | Damha et al. | |
| 2005/0244851 A1 | 11/2005 | Blume et al. | |
| 2005/0246794 A1 | 11/2005 | Khvorova et al. | |
| 2005/0261218 A1 | 11/2005 | Esau et al. | |
| 2005/0272080 A1 | 12/2005 | Palma et al. | |
| 2006/0003322 A1 | 1/2006 | Bentwich | |
| 2006/0046260 A1 | 3/2006 | Kriksunov et al. | |
| 2006/0128646 A1 | 6/2006 | Christensen et al. | |
| 2006/0270624 A1 | 11/2006 | Cook et al. | |
| 2007/0032446 A1 | 2/2007 | Cook et al. | |
| 2007/0042380 A1 | 2/2007 | Bentwich et al. | |
| 2007/0111963 A1 | 5/2007 | Corey et al. | |
| 2007/0191294 A1 | 8/2007 | Elmen et al. | |
| 2007/0269815 A1 | 11/2007 | Rivory et al. | |
| 2008/0015162 A1 | 1/2008 | Bhanot et al. | |
| 2008/0176793 A1 | 7/2008 | Simons et al. | |
| 2008/0194463 A1* | 8/2008 | Weller | A61K 48/00 514/1.1 |
| 2008/0249039 A1 | 10/2008 | Elmen et al. | |
| 2008/0293655 A1 | 11/2008 | Aygun et al. | |
| 2008/0318895 A1 | 12/2008 | Lee et al. | |
| 2009/0082297 A1 | 3/2009 | Lioy et al. | |
| 2009/0092988 A1 | 4/2009 | Schwartz et al. | |
| 2009/0099066 A1* | 4/2009 | Moulton | C12N 15/87 514/1.1 |
| 2009/0099109 A1 | 4/2009 | Shames et al. | |
| 2009/0143326 A1 | 6/2009 | Obad et al. | |
| 2009/0155910 A1 | 6/2009 | McGonigle | |
| 2009/0221685 A1 | 9/2009 | Esau et al. | |
| 2009/0258925 A1 | 10/2009 | Wahlestedt | |
| 2009/0325868 A1 | 12/2009 | Liu et al. | |
| 2009/0326051 A1 | 12/2009 | Corey et al. | |
| 2010/0004314 A1 | 1/2010 | Dondero et al. | |
| 2010/0087511 A1 | 4/2010 | Singh et al. | |
| 2010/0105760 A1 | 4/2010 | Collard et al. | |
| 2010/0111982 A1 | 5/2010 | Zang et al. | |
| 2010/0112042 A1 | 5/2010 | Polisky et al. | |
| 2010/0124547 A1 | 5/2010 | Bramlage et al. | |
| 2010/0143359 A1 | 6/2010 | Ebert et al. | |
| 2010/0197762 A1 | 8/2010 | Swayze et al. | |
| 2010/0210707 A1 | 8/2010 | Li et al. | |
| 2010/0210712 A1 | 8/2010 | Hansen et al. | |
| 2010/0216238 A1 | 8/2010 | Baker et al. | |
| 2010/0247543 A1 | 9/2010 | Maes et al. | |
| 2010/0280100 A1 | 11/2010 | Collard et al. | |
| 2010/0286141 A1 | 11/2010 | Durden et al. | |
| 2010/0317606 A1 | 12/2010 | Chan et al. | |
| 2011/0039910 A1 | 2/2011 | Crooke et al. | |
| 2011/0077286 A1 | 3/2011 | Damha et al. | |
| 2011/0086833 A1 | 4/2011 | Paushkin et al. | |
| 2011/0150868 A1 | 6/2011 | Yu et al. | |
| 2011/0172292 A1 | 7/2011 | Hansen et al. | |
| 2011/0191912 A1 | 8/2011 | Alexandrov | |
| 2011/0207217 A1 | 8/2011 | Corey et al. | |
| 2011/0237606 A1 | 9/2011 | Chai et al. | |
| 2011/0237649 A1 | 9/2011 | Collard et al. | |
| 2011/0237650 A1 | 9/2011 | Collard et al. | |
| 2011/0237651 A1 | 9/2011 | Collard et al. | |
| 2011/0251261 A1 | 10/2011 | Burnett et al. | |
| 2011/0263687 A1 | 10/2011 | Mattick et al. | |
| 2011/0294870 A1 | 12/2011 | Collard et al. | |
| 2011/0319283 A1 | 12/2011 | Thompson | |
| 2011/0319317 A1 | 12/2011 | Collard et al. | |
| 2011/0319475 A1 | 12/2011 | Collard et al. | |
| 2011/0319476 A1 | 12/2011 | Collard et al. | |
| 2012/0004184 A1 | 1/2012 | Collard et al. | |
| 2012/0004278 A1 | 1/2012 | Chang et al. | |
| 2012/0010156 A1 | 1/2012 | Collard et al. | |
| 2012/0046236 A1 | 2/2012 | Collard et al. | |
| 2012/0046344 A1 | 2/2012 | Collard et al. | |
| 2012/0046345 A1 | 2/2012 | Collard et al. | |
| 2012/0064048 A1 | 3/2012 | Collard et al. | |
| 2012/0071418 A1 | 3/2012 | Copeland et al. | |
| 2012/0083596 A1 | 4/2012 | Elmen et al. | |
| 2012/0088817 A1 | 4/2012 | Collard et al. | |
| 2012/0094934 A1 | 4/2012 | Collard et al. | |
| 2012/0095079 A1 | 4/2012 | Collard et al. | |
| 2012/0095081 A1 | 4/2012 | Collard et al. | |
| 2012/0129917 A1 | 5/2012 | Collard et al. | |
| 2012/0135941 A1 | 5/2012 | Collard et al. | |
| 2012/0142610 A1 | 6/2012 | Collard et al. | |
| 2012/0142758 A1 | 6/2012 | Collard et al. | |
| 2012/0149759 A1 | 6/2012 | Collard et al. | |
| 2012/0157333 A1 | 6/2012 | Kauppinen et al. | |
| 2012/0171170 A1 | 7/2012 | Collard et al. | |
| 2012/0252869 A1 | 10/2012 | Collard et al. | |
| 2012/0264812 A1 | 10/2012 | Collard et al. | |
| 2012/0277290 A1 | 11/2012 | Collard et al. | |
| 2012/0288869 A1 | 11/2012 | Schwartz et al. | |
| 2012/0289581 A1 | 11/2012 | Chang et al. | |
| 2012/0289583 A1 | 11/2012 | Collard et al. | |
| 2012/0295952 A1 | 11/2012 | Collard et al. | |
| 2012/0295953 A1 | 11/2012 | Colalrd et al. | |
| 2012/0295954 A1 | 11/2012 | Collard et al. | |
| 2012/0295959 A1 | 11/2012 | Collard et al. | |
| 2012/0309814 A1 | 12/2012 | Collard et al. | |
| 2012/0322851 A1 | 12/2012 | Hardee et al. | |
| 2012/0322853 A1 | 12/2012 | Collard et al. | |

(56) References Cited

U.S. PATENT DOCUMENTS

| | | |
|---|---|---|
| 2012/0329727 A1 | 12/2012 | Collard et al. |
| 2012/0329855 A1 | 12/2012 | Collar et al. |
| 2013/0035372 A1 | 2/2013 | Collard et al. |
| 2013/0035373 A1 | 2/2013 | Collard et al. |
| 2013/0053428 A1 | 2/2013 | Wahlestedt |
| 2013/0065947 A1 | 3/2013 | Collard et al. |
| 2013/0072421 A1 | 3/2013 | Collard et al. |
| 2013/0072546 A1 | 3/2013 | Collard et al. |
| 2013/0079505 A1 | 3/2013 | Moeller et al. |
| 2013/0085112 A1 | 4/2013 | Collard et al. |
| 2013/0096183 A1 | 4/2013 | Collard et al. |
| 2013/0116300 A1 | 5/2013 | Collard et al. |
| 2013/0137751 A1 | 5/2013 | Collard et al. |
| 2013/0164846 A1 | 6/2013 | Saestrom |
| 2013/0184325 A9 | 7/2013 | Collard et al. |
| 2013/0245099 A1 | 9/2013 | Collard et al. |
| 2013/0261065 A1 | 10/2013 | Collard et al. |
| 2014/0142160 A1 | 5/2014 | Lee et al. |
| 2014/0187606 A1 | 7/2014 | Collard et al. |
| 2015/0133362 A1 | 5/2015 | Krieg et al. |
| 2015/0133528 A1 | 5/2015 | Krieg et al. |
| 2015/0133529 A1 | 5/2015 | Krieg et al. |
| 2015/0141320 A1 | 5/2015 | Krieg et al. |
| 2015/0152410 A1 | 6/2015 | Krieg et al. |
| 2015/0159160 A1 | 6/2015 | Krieg et al. |
| 2015/0159161 A1 | 6/2015 | Krieg et al. |
| 2015/0191722 A1 | 7/2015 | Krieg et al. |
| 2015/0218560 A1 | 8/2015 | Krieg et al. |
| 2015/0225717 A1 | 8/2015 | Lee et al. |
| 2016/0122760 A1 | 5/2016 | Barsoum et al. |
| 2017/0037396 A1 | 2/2017 | Lee et al. |

FOREIGN PATENT DOCUMENTS

| | | | |
|---|---|---|---|
| EP | 1 044 987 A2 | 10/2000 | |
| EP | 1 752 536 A1 | 5/2005 | |
| EP | 1 695 979 A2 | 8/2006 | |
| EP | 1 957 648 B1 | 11/2006 | |
| EP | 1 967 525 A2 | 9/2008 | |
| EP | 2 021 472 B1 | 6/2011 | |
| EP | 2 023 940 B1 | 6/2011 | |
| EP | 2 431 467 A2 | 3/2012 | |
| EP | 2 431 467 A3 | 5/2012 | |
| EP | 2 591 797 A1 | 5/2013 | |
| JP | 2006-522597 | 10/2006 | |
| JP | 2008-044958 A | 2/2008 | |
| JP | 2009-536037 | 10/2009 | |
| JP | 2010-507579 A | 3/2010 | |
| JP | 2010-516256 | 5/2010 | |
| JP | 2015-518714 | 7/2015 | |
| KR | 10-2011-0050134 A | 5/2011 | |
| WO | WO 89/05358 A1 | 6/1989 | |
| WO | WO 93/13121 A1 | 7/1993 | |
| WO | WO 94/02499 A1 | 2/1994 | |
| WO | WO 94/17093 A1 | 8/1994 | |
| WO | WO 0107662 A1 * | 2/2001 | ............ C12N 9/0083 |
| WO | WO 01/36627 A2 | 5/2001 | |
| WO | WO 02/103015 A2 | 12/2002 | |
| WO | WO 2004/011613 A2 | 2/2004 | |
| WO | WO 2004/099382 A2 | 11/2004 | |
| WO | WO 2004/113867 A2 | 12/2004 | |
| WO | WO 2005/042018 A2 | 5/2005 | |
| WO | WO 2005/044981 A2 | 5/2005 | |
| WO | WO 2005/061710 A1 | 7/2005 | |
| WO | WO 2005/089169 A2 | 9/2005 | |
| WO | WO 2005/094370 A2 | 10/2005 | |
| WO | WO 2006/063356 A1 | 6/2006 | |
| WO | WO 2006/130201 A1 | 12/2006 | |
| WO | WO 2007/031091 A2 | 3/2007 | |
| WO | WO 2007/086990 A2 | 8/2007 | |
| WO | WO 2007/086990 A3 | 8/2007 | |
| WO | WO 2007/115578 A1 | 10/2007 | |
| WO | WO 2007/133812 A2 | 11/2007 | |
| WO | WO 2008/024499 A2 | 2/2008 | |
| WO | WO 2008/025069 A1 | 3/2008 | |
| WO | WO 2008/029619 A1 | 3/2008 | |
| WO | WO 2008/061537 A2 | 5/2008 | |
| WO | WO 2008/103761 A2 | 8/2008 | |
| WO | WO 2008/103763 A2 | 8/2008 | |
| WO | WO 2008/113832 A2 | 9/2008 | |
| WO | WO 2008/141282 A2 | 11/2008 | |
| WO | WO 2009/043353 A2 | 4/2009 | |
| WO | WO 2009/044383 A1 | 4/2009 | |
| WO | WO 2009/046397 A2 | 4/2009 | |
| WO | WO 2009/061851 A2 | 5/2009 | |
| WO | WO 2009/090182 A1 | 7/2009 | |
| WO | WO 2009/124341 A1 | 10/2009 | |
| WO | WO 2009/134710 A2 | 11/2009 | |
| WO | WO 2009/149182 A1 | 12/2009 | |
| WO | WO 2010/000665 A1 | 1/2010 | |
| WO | WO 2010/014592 A1 | 2/2010 | |
| WO | WO 2010/065671 A2 | 6/2010 | |
| WO | WO 2010/065787 A2 | 6/2010 | |
| WO | WO 2010/083615 A1 | 7/2010 | |
| WO | WO 2010/093860 A2 | 8/2010 | |
| WO | WO 2010/093904 A2 | 8/2010 | |
| WO | WO 2010/102058 A2 | 9/2010 | |
| WO | WO 2010/107733 A2 | 9/2010 | |
| WO | WO 2010/129746 A2 | 11/2010 | |
| WO | WO 2010/129799 A2 | 11/2010 | |
| WO | WO 2010/129861 A2 | 11/2010 | |
| WO | WO 2010/135329 A2 | 11/2010 | |
| WO | WO 2010/135695 A2 | 11/2010 | |
| WO | WO 2010/138806 A2 | 12/2010 | |
| WO | WO 2010/148050 A2 | 12/2010 | |
| WO | WO 2010/148065 A2 | 12/2010 | |
| WO | WO 2010/151671 A2 | 12/2010 | |
| WO | WO 2010/151674 A2 | 12/2010 | |
| WO | WO 2011/009624 A1 | 1/2011 | |
| WO | WO 2011/010706 A1 | 1/2011 | |
| WO | WO 2011/017516 A2 | 2/2011 | |
| WO | WO 2011/019815 A2 | 2/2011 | |
| WO | WO 2011/022606 A2 | 2/2011 | |
| WO | WO 2011/025862 A2 | 3/2011 | |
| WO | WO 2011/031482 A2 | 3/2011 | |
| WO | WO 2011/032109 A1 | 3/2011 | |
| WO | WO 2011/038205 A2 | 3/2011 | |
| WO | WO 2011/038210 A2 | 3/2011 | |
| WO | WO 2011/048125 A1 | 4/2011 | |
| WO | WO 2011/079261 A2 | 6/2011 | |
| WO | WO 2011/079263 A2 | 6/2011 | |
| WO | WO 2011/082409 A2 | 7/2011 | |
| WO | WO 2011/084455 A2 | 7/2011 | |
| WO | WO 2011/085066 A2 | 7/2011 | |
| WO | WO 2011/097388 A1 | 8/2011 | |
| WO | WO 2011/097582 A2 | 8/2011 | |
| WO | WO 2011/097641 A1 | 8/2011 | |
| WO | WO 2011/123745 A2 | 10/2011 | |
| WO | WO 2011/139387 A1 | 11/2011 | |
| WO | WO 2011/146674 A2 | 11/2011 | |
| WO | WO 2011/146675 A2 | 11/2011 | |
| WO | WO 2011/150005 A1 | 12/2011 | |
| WO | WO 2011/159836 A2 | 12/2011 | |
| WO | WO 2011/161460 A2 | 12/2011 | |
| WO | WO 2011/163499 A2 | 12/2011 | |
| WO | WO 2012/009347 A2 | 1/2012 | |
| WO | WO 2012/009402 A2 | 1/2012 | |
| WO | WO 2012/018881 A2 | 2/2012 | |
| WO | WO 2012/024478 A2 | 2/2012 | |
| WO | WO 2012/047956 A2 | 4/2012 | |
| WO | WO 2012/054723 A2 | 4/2012 | |
| WO | WO 2012/058268 A2 | 5/2012 | |
| WO | WO 2012/065143 A1 | 5/2012 | |
| WO | WO 2012/068340 A2 | 5/2012 | |
| WO | WO 2012/071238 A2 | 5/2012 | |
| WO | WO 2012/087983 A1 | 6/2012 | |
| WO | WO 2012/109476 A2 | 8/2012 | |
| WO | WO 2012/144220 A1 | 10/2012 | |
| WO | WO 2012/170771 A1 | 12/2012 | |
| WO | WO 2013/006619 A1 | 1/2013 | |
| WO | WO 2013/036403 A1 | 3/2013 | |
| WO | WO 2013/040429 A1 | 3/2013 | |
| WO | WO 2013/124807 A2 | 8/2013 | |
| WO | WO 2013/138374 A2 | 9/2013 | |

(56) References Cited

FOREIGN PATENT DOCUMENTS

| WO | WO 2013/173598 A1 | 11/2013 |
|---|---|---|
| WO | WO 2013/173599 A1 | 11/2013 |
| WO | WO 2013/173601 A1 | 11/2013 |
| WO | WO 2013/173605 A1 | 11/2013 |
| WO | WO 2013/173608 A1 | 11/2013 |
| WO | WO 2013/173635 A1 | 11/2013 |
| WO | WO 2013/173637 A1 | 11/2013 |
| WO | WO 2013/173638 A1 | 11/2013 |
| WO | WO 2013/173645 A1 | 11/2013 |
| WO | WO 2013/173647 A1 | 11/2013 |
| WO | WO 2013/173652 A1 | 11/2013 |
| WO | WO 2014/043544 A1 | 3/2014 |
| WO | WO 2014/076195 A1 | 5/2014 |
| WO | WO 2014/197826 A1 | 12/2014 |
| WO | WO 2015/035476 A1 | 3/2015 |

OTHER PUBLICATIONS

Gajera et al. Physiological and Molecular Plant Pathology 2010, vol. 74, pp. 274-282.*
International Search Report and Written Opinion for Application No. PCT/US2013/041440 dated Jul. 29, 2013.
International Preliminary Report on Patentability for Application No. PCT/US2013/041440 dated Nov. 27, 2014.
International Search Report and Written Opinion for Application No. PCT/US2013/041452 dated Jul. 29, 2013.
International Preliminary Report on Patentability for Application No. PCT/US2013/041452 dated Nov. 27, 2014.
International Preliminary Report on Patentability for Application No. PCT/US2013/041382 dated Nov. 27, 2014.
International Preliminary Report on Patentability for Application No. PCT/US2013/041381 dated Nov. 27, 2014.
International Preliminary Report on Patentability for Application No. PCT/US2013/041455 dated Nov. 27, 2014.
International Preliminary Report on Patentability for Application No. PCT/US2013/041389 dated Nov. 27, 2014.
International Preliminary Report on Patentability for Application No. PCT/US2013/041385 dated Nov. 27, 2014.
International Preliminary Report on Patentability for Application No. PCT/US2013/041394 dated Nov. 27, 2014.
International Preliminary Report on Patentability for Application No. PCT/US2013/041434 dated Nov. 27, 2014.
International Preliminary Report on Patentability for Application No. PCT/US2013/041437 dated Nov. 27, 2014.
International Search Report and Written Opinion for Application No. PCT/US2013/041461 dated Aug. 21, 2013.
International Preliminary Report on Patentability for Application No. PCT/US2013/041461 dated Nov. 27, 2014.
International Search Report and Written Opinion for Application No. PCT/US2014/041345 dated Oct. 14, 2014.
Extended European Search Report for Application No. EP 11840099.3 dated Oct. 7, 2014.
International Search Report and Written Opinion for Application No. PCT/US2011/060493 dated Apr. 18, 2012.
European Search Report for Application No. EP 11852141.8 dated Jan. 19, 2015.
International Search Report and Written Opinion for Application No. PCT/US2011/065939 dated Apr. 20, 2012.
GENBANK Submission; NIH/NCBI, Accession No. AA106140. Marra et al., Feb. 4, 1997. 1 page.
GENBANK Submission; NIH/NCBI, Accession No. AL137002. Holt, Dec. 13, 2012. 29 pages.
GENBANK Submission; NIH/NCBI, Accession No. BX383579. Li et al., Dec. 23, 2010. 1 page.
GENBANK Submission; NIH/NCBI, Accession No. NM_001079668. Young et al., Jan. 18, 2014. 4 pages.
GENBANK Submission; NIH/NCBI, Accession No. NM_003317. Young et al., Jan. 18, 2014. 4 pages.
GENBANK Submission; NIH/NCBI, Accession No. NM_028475. Diez-Roux et al., Feb. 3, 2014. 6 pages.
[No Author Listed], Geneimprint. 2012. http://www.geneimprint.com/site/about-this-site [last accessed May 22, 2015]. 1 page.
[No Author Listed], Imprinted gene. Mosby's Dictionary of Medicine, Nursing and Health Professions. 8th ed. 2009;949.
Ahn et al., Retinoic acid accelerates downregulation of the Xist repressor, Oct4, and increases the likelihood of Xist activation when Tsix is deficient. BMC Develop Biol. 2010;10:90. 14 pages.
Astuti et al., Epigenetic alteration at the DLK1-GTL2 imprinted domain in human neoplasia: analysis of neuroblastoma, phaeochromocytoma and Wilms' tumour. Br J Cancer. Apr. 25, 2005;92(8):1574-80.
Beletskii et al., PNA interference mapping demonstrates functional domains in the noncoding RNA Xist. Proc Natl Acad Sci U S A. Jul. 31, 2001;98(16):9215-20.
Bernardi et al., Structure, dynamics and functions of promyelocytic leukaemia nuclear bodies. Nat Rev Mol Cell Biol. Dec. 2007;8(12):1006-16. Review.
Bernstein et al., Mouse polycomb proteins bind differentially to methylated histone H3 and RNA and are enriched in facultative heterochromatin. Mol Cell Biol. Apr. 2006;26(7):2560-9.
Bernstein et al., RNA meets chromatin. Genes Dev. Jul. 15, 2005;19(14):1635-55. Review.
Boyer et al., Polycomb complexes repress developmental regulators in murine embryonic stem cells. Nature. May 18, 2006;441(7091):349-53. Epub Apr. 19, 2006.
Brockdorff et al., The product of the mouse Xist gene is a 15 kb inactive X-specific transcript containing no conserved ORF and located in the nucleus. Cell. Oct. 30, 1992;71(3):515-26.
Brown et al., A gene from the region of the human X inactivation centre is expressed exclusively from the inactive X chromosome. Nature. Jan. 3, 1991;349:38-44.
Brown et al., The Human *XIST* Gene: Analysis of a 17 kb Inactive X-Specific RNA That Contains Conserved Repeats and is Highly Localized within the Nucleus. Cell. Oct. 30, 1992;71:527-42.
Carninci et al., The transcriptional landscape of the mammalian genome. Science. Sep. 2, 2005;309(5740):1559-63.
Chahrour et al., MeCP2, a key contributor to neurological disease, activates and represses transcription. Science. May 30, 2008;320(5880):1224-9.
Chen et al., Decoding the function of nuclear long non-coding RNAs. Curr Opin Cell Biol. Jun. 2010;22(3):357-64. doi: 10.1016/j.ceb.2010.03.003. Epub Mar. 29, 2010. Review.
Chow et al., Inducible XIST-dependent X-chromosome inactivation in human somatic cells is reversible. Proc Natl Acad Sci U S A. Jun. 12, 2007;104(24):10104-9. Epub May 30, 2007.
Clark et al., The Reality of Pervasive Transcription. PLOS Bio. Jul. 2011;9(7):e1000625. 6 pages.
Clemson et al., XIST RNA paints the inactive X chromosome at interphase: evidence for a novel RNA involved in nuclear/chromosome structure. J Cell Biol. Feb. 1996;132(3):259-75.
Cohen et al., X-chromosome inactivation and the search for chromosome-wide silencers. Curr Opin Genet Dev. 2002;12:219-24.
Coombes et al., Epigenetic properties and identification of an imprint mark in the Nesp-Gnasxl domain of the mouse Gnas imprinted locus. Mol Cell Biol. Aug. 2003;23(16):5475-88.
Core et al., Nascent RNA sequencing reveals widespread pausing and divergent initiation at human promoters. Science. Dec. 19, 2008;322(5909):1845-8. doi: 10.1126/science.1162228. Epub Dec. 4, 2008.
Costa, Non-coding RNAs: new players in eukaryotic biology. Gene. Sep. 12, 2005;357(2):83-94. Review.
Davidson et al., Singles engage the RNA interference pathway. Cell. Aug. 31, 2012;150(5):873-5. doi: 10.1016/j.cell.2012.08.008.
Denisenko et al., Point mutations in the WD40 domain of Eed block its interaction with Ezh2. Mol Cell Biol. Oct. 1998;18(10):5634-42.
Di Certo et al., The artificial gene Jazz, a transcriptional regulator of utrophin, corrects the dystrophic pathology in mdx mice. Hum Mol Genet. Mar. 1, 2010;19(5):752-60. doi: 10.1093/hmg/ddp539. Epub Dec. 4, 2009.

(56) References Cited

OTHER PUBLICATIONS

Dinger et al., NRED: a database of long noncoding RNA expression. Nucleic Acids Res. Jan. 2009;37(Database issue):D122-6. doi: 10.1093/nar/gkn617. Epub Oct. 1, 2008.
Duthie et al., Xist RNA exhibits a banded localization on the inactive X chromosome and is excluded from autosomal material in cis. Hum Mol Genet. Feb. 1999;8(2):195-204.
Edwards et al., Mechanisms regulating imprinted genes in clusters. Curr Opin Cell Biol. Jun. 2007;19(3):281-9. Review.
Engström et al., Complex Loci in human and mouse genomes. PLoS Genet. Apr. 2006;2(4):e47. Epub Apr. 28, 2006.
Faghihi et al., Expression of a noncoding RNA is elevated in Alzheimer's disease and drives rapid feed-forward regulation of [beta]—secretase. Nat Med. Jul. 2008;14(7):723-30. doi:10.1038/nm1784. Epub Feb. 23, 2010. 19 pages.
Francis et al., Reconstitution of a functional core polycomb repressive complex. Mol Cell. Sep. 2001;8(3):545-56.
Frieden et al., Expanding the design horizon of antisense oligonucleotides with alpha-L-LNA. Nucleic Acids Res. Nov. 1, 2003;31(21):6365-72.
Froberg et al., Guided by RNAs: X-inactivation as a model for lncRNA function. J Mol Biol. Oct. 9, 2013;425(19):3698-706. doi: 10.1016/j.jmb.2013.06.031. Epub Jun. 28, 2013. Review. 15 pages.
Fu et al., Mir-144 selectively regulates embryonic alpha-hemoglobin synthesis during primitive erythropoiesis. Blood. Feb. 5, 2009;113(6):1340-9.
Golding et al., Depletion of Kcnq1ot1 non-coding RNA does not affect imprinting maintenance in stem cells. Development. 2011;138:3667-8. doi:10.1242/dev.057778.
Gontan et al., Long Noncoding RNAs and X Chromosome Inactivation. Prog Mol Subcell Biol. 2011;51:43-64. doi: 10.1007/978-3-642-16502-3_3.
Guo et al., High resolution genome wide binding event finding and motif discovery reveals transcription factor spatial binding constraints. PLoS Comput Biol. 2012;8(8):e1002638. doi: 10.1371/journal.pcbi.1002638. Epub Aug. 9, 2012.
Gupta et al., Long non-coding RNA HOTAIR reprograms chromatin state to promote cancer metastasis. Nature. Apr. 15, 2010;464(7291):1071-6. doi: 10.1038/nature08975. E-pub version.
Guttman et al., Chromatin signature reveals over a thousand highly conserved large non-coding RNAs in mammals. Nature. Mar. 12, 2009;458(7235):223-7. doi: 10.1038/nature07672. Epub Sep. 30, 2009. 13 pages.
Guttman et al., Modular regulatory principles of large non-coding RNAs. Nature. Feb. 15, 2012;482(7385):339-46. Review.
Hendrich et al., Evolutionary conservation of possible functional domains of the human and murine XIST genes. Human Molec Gen. 1993;2(6):663-72.
Horike et al., Targeted disruption of the human LIT1 locus defines a putative imprinting control element playing an essential role in Beckwith-Wiedemann syndrome. Hum Mol Genet. Sep. 1, 2000;9(14):2075-83.
Inesi et al., Studies of Ca2+ ATPase (SERCA) inhibition. J Bioenerg Biomembr. Dec. 2005;37(6):365-8. Review.
Inouye, Antisense RNA: its functions and applications in gene regulation—a review. Gene. Dec. 10, 1988;72(1-2):25-34.
Jeon et al., YY1 tethers Xist RNA to the inactive X nucleation center. Cell. Jul. 8, 2011;146(1):119-33. doi: 10.1016/j.cell.2011.06.026.
Jepsen et al., Locked nucleic acid: a potent nucleic acid analog in therapeutics and biotechnology. Oligonucleotides. 2004;14(2):130-46. Review.
Jia et al., Genome-wide computational identification and manual annotation of human long noncoding RNA genes. RNA. Aug. 2010;16(8):1478-87. doi: 10.1261/rna.1951310. Epub Jun. 29, 2010.
Johansson et al., Target-specific arrest of mRNA translation by antisense 2'-O-alkyloligoribonucleotides. Nucleic Acids Res. Nov. 11, 1994;22(22):4591-8.

Johnson, Long non-coding RNAs in Huntington's disease neurodegeneration. Neurobiol Dis. 2012;46:245-54.
Kanduri et al., The length of the transcript encoded from the Kcnq1ot1 antisense promoter determines the degree of silencing. EMBO J. 2006;25:2096-106.
Kanhere et al., Short RNAs are transcribed from repressed polycomb target genes and interact with polycomb repressive complex-2. Mol Cell. Jun. 11, 2010;38(5):675-88. doi: 10.1016/j.molcel.2010.03.019.
Kapranov et al., Genome-wide transcription and the implications for genomic organization. Nat Rev Genet. Jun. 2007;8(6):413-23.
Kapranov et al., RNA maps reveal new RNA classes and a possible function for pervasive transcription. Science. Jun. 8, 2007;316(5830):1484-8.
Khalil et al., Many human large intergenic noncoding RNAs associate with chromatin-modifying complexes and affect gene expression. Proc Natl Acad Sci U S A. Jul. 14, 2009;106(28):11667-72.
Kim et al., Identification of clustered YY1 binding sites in imprinting control regions. Genome Res. Jul. 2006;16(7):901-11. Epub Jun. 7, 2006.
Klein et al., Homeostatic regulation of MeCP2 expression by a CREB-induced microRNA. Nat Neurosci. Dec. 2007;10(12):1513-4.
Krützfeldt et al., Silencing of microRNAs in vivo with 'antagomirs'. Nature. Dec. 1, 2005;438(7068):685-9. Epub Oct. 30, 2005.
Ku et al., Genomewide analysis of PRC1 and PRC2 occupancy identifies two classes of bivalent domains. PLoS Genet. Oct. 2008;4(10):e1000242. doi: 10.1371/journal.pgen.1000242. Epub Oct. 31, 2008. 14 pages.
Lee et al., A 450 kb Transgene Displays Properties of the Mammalian X-Inactivation Center. Cell. Jul. 12, 1996;86:83-94.
Lee et al., Control of developmental regulators by Polycomb in human embryonic stem cells. Cell. Apr. 21, 2006;125(2):301-13.
Lee et al., Genetic analysis of the mouse X inactivation center defines an 80-kb multifunction domain. Proc Natl Acad Sci U S A. Mar. 30, 1999;96(7):3836-41.
Lee et al., Targeted Mutagenesis of Tsix Leads to Nonrandom X Inactivation. Cell. Oct. 1, 1999;99:47-57.
Lee et al., Tsix, a gene antisense to Xist at the X-inactivation centre. Nat Genet. Apr. 1999;21:400-4.
Lee, Disruption of Imprinted X Inactivation by Parent-of-Origin Effects at Tsix. Cell. Sep. 29, 2000;103:17-27.
Lee, Epigenetic regulation by long noncoding RNAs. Science. Dec. 14, 2012;338(6113):1435-9. Review.
Lee, Homozygous Tsix mutant mice reveal a sex-ratio distortion and revert to random X-inactivation. Nat Genet. Sep. 2002;32:195-200.
Lee, Lessons from X-chromosome inactivation: long ncRNA as guides and tethers to the epigenome. Genes Dev. Aug. 15, 2009;23(16):1831-42. doi: 10.1101/gad.1811209.
Lee, The X as a Model for RNA's Niche in Epigenomic Regulation. Cold Spring Harb Perspect Biol. 2010;2:A003749. 12 pages.
Li et al., Jarid2 and PRC2, partners in regulating gene expression. Genes Dev. Feb. 15, 2010;24(4):368-80. doi: 10.1101/gad.1886410. Epub Feb. 1, 2010.
Lima et al., Single-stranded siRNAs activate RNAi in animals. Cell. Aug. 31, 2012;150(5):883-94. doi: 10.1016/j.cell.2012.08.014.
Lin et al., An in-depth map of polyadenylation sites in cancer. Nucleic Acids Res. Sep. 1, 2012;40(17):8460-71. Epub Jun. 29, 2012.
Lin et al., Asymmetric regulation of imprinting on the maternal and paternal chromosomes at the Dlk1-Gtl2 imprinted cluster on mouse chromosome 12. Nat Genet. Sep. 2003;35(1):97-102. Epub Aug. 24, 2003.
Lipovich et al., MacroRNA underdogs in a microRNA world: evolutionary, regulatory, and biomedical significance of mammalian long non-protein-coding RNA. Biochim Biophys Acta. Sep. 2010;1799(9):597-615. Review.
Margueron et al., The Polycomb complex PRC2 and its mark in life. Nature. Jan. 20, 2011;469(7330):343-9. Review.
Mercer et al., Long non-coding RNAs: insights into functions. Nat Rev Genet. Mar. 2009;10(3):155-9. Review.
Mercer et al., Structure and function of long noncoding RNAs in epigenetic regulation. Mar. 5, 2013;20:300-7.

(56) References Cited

OTHER PUBLICATIONS

Merienne et al., SCA8 CAG/CTG expansions, a tale of two TOXICities: a unique or common case? PLoS Genet. Aug. 2009;5(8):e1000593. doi: 10.1371/journal.pgen.1000593. Epub Aug. 14, 2009.

Miremadi et al., Cancer genetics of epigenetic genes. Hum Mol Genet. Apr. 15, 2007;16 Spec No. 1:R28-49. Review.

Miura et al., Utrophin upregulation for treating Duchenne or Becker muscular dystrophy: how close are we? Trends Mol Med. Mar. 2006;12(3):122-9. Epub Jan. 27, 2006.

Modarresi et al., Natural antisense inhibition results in transcriptional de-repression and gene upregulation. Nat Biotechnol. Mar. 25, 2012;30(5):453-9. doi: 10.1038/nbt.2158. 21 pages.

Montgomery et al., The murine polycomb group protein Eed is required for global histone H3 lysine-27 methylation. Curr Biol. May 24, 2005;15(10):942-7.

Morris et al., Small interfering RNA-induced transcriptional gene silencing in human cells. Science. Aug. 27, 2004;305(5688):1289-92. Epub Aug. 5, 2004.

Morris, RNA-mediated transcriptional gene silencing in human cells. Curr Top Microbiol Immunol. 2008;320:211-24. Review.

Munroe, Antisense RNA inhibits splicing of pre-mRNA in vitro. EMBO J. Aug. 1988; 7(8): 2523-32.

Nagano et al., The Air noncoding RNA epigenetically silences transcription by targeting G9a to chromatin. Science. Dec. 12, 2008;322(5908):1717-20.

Nie et al., Long non-coding RNAs: versatile master regulators of gene expression and crucial players in cancer. Am J Transl Res. 2012;4(2):127-50. Epub Apr. 8, 2012.

Numata et al., Comparative analysis of cis-encoded antisense RNAs in eukaryotes. Gene. May 1, 2007;392(1-2):134-41.

Numata et al., Identification of novel endogenous antisense transcripts by DNA microarray analysis targeting complementary strand of annotated genes. BMC Genomics. Aug. 22, 2009;10:392. doi: 10.1186/1471-2164-10-392.

Okada et al., Comparative expression analysis uncovers novel features of endogenous antisense transcription. Hum Mol Genet. Jun. 1, 2008;17(11):1631-40. doi: 10.1093/hmg/ddn051. Epub Feb. 18, 2008.

Ørom et al., LNA-modified oligonucleotides mediate specific inhibition of microRNA function. Gene. May 10, 2006;372:137-41. Epub Feb. 24, 2006.

Ozsolak et al., Comprehensive polyadenylation site maps in yeast and human reveal pervasive alternative polyadenylation. Cell. Dec. 10, 2010;143(6):1018-29. doi: 10.1016/j.cell.2010.11.020.

Pandey et al., Kcnq1ot1 antisense noncoding RNA mediates lineage-specific transcriptional silencing through chromatin-level regulation. Mol Cell. Oct. 24, 2008;32(2):232-46. doi: 10.1016/j.molcel.2008.08.022.

Paro et al., Extending the frontiers of epigenetic regulation. Curr Opin Genet Dev. Apr. 2010;20(2):107-9. doi: 10.1016/j.gde.2010.03.011.

Pasini et al., Suz12 is essential for mouse development and for EZH2 histone methyltransferase activity. EMBO J. Oct. 13, 2004;23(20):4061-71. Epub Sep. 23, 2004.

Peng et al., Jarid2/Jumonji coordinates control of PRC2 enzymatic activity and target gene occupancy in pluripotent cells. Cell. Dec. 24, 2009;139(7):1290-302. doi: 10.1016/j.cell.2009.12.002. Epub Jul. 29, 2010. 24 pages.

Penny et al., Requirement for Xist in X chromosome inactivation. Nature. Jan. 11, 1996;379(6561):131-7.

Pereira et al., Ezh2, the histone methyltransferase of PRC2, regulates the balance between self-renewal and differentiation in the cerebral cortex. Proc Natl Acad Sci U S A. Sep. 7, 2010;107(36):15957-62. doi: 10.1073/pnas.1002530107. Epub Aug. 23, 2010.

Petersen et al., LNA: a versatile tool for therapeutics and genomics. TRENDS Biotech. Feb. 2003;21(2):74-81. Review.

Pietersen et al., Stem cell regulation by polycomb repressors: postponing commitment. Curr Opin Cell Biol. Apr. 2008;20(2):201-7. doi: 10.1016/j.ceb.2008.01.004. Epub Mar. 4, 2008. Review.

Plath et al., Role of Histone H3 Lysine 27 Methylation in X Inactivation. Science. Apr. 4, 2003;300:131-5. doi: 10.1126/science.1084274.

Ponting et al., Evolution and functions of long noncoding RNAs. Cell. Feb. 20, 2009;136(4):629-41. doi: 10.1016/j.cell.2009.02.006. Review.

Qi et al., Repurposing CRISPR as an RNA-guided platform for sequence-specific control of gene expression. Cell. Feb. 28, 2013;152(5):1173-83. doi: 10.1016/j.cell.2013.02.022.

Rajasekhar et al., Concise review: roles of polycomb group proteins in development and disease: a stem cell perspective. Stem Cells. Oct. 2007;25(10):2498-510. Epub Jun. 28, 2007. Review.

Redrup et al., The long noncoding RNA Kcnq1ot1 organises a lineage-specific nuclear domain for epigenetic gene silencing. Development. Feb. 2009;136(4):525-30. doi: 10.1242/dev.031328. Epub Jan. 14, 2009. 14 pages.

Ringrose et al., Epigenetic regulation of cellular memory by the Polycomb and Trithorax group proteins. Annu Rev Genet. 2004;38:413-43. Review.

Rinn et al., Functional demarcation of active and silent chromatin domains in human HOX loci by noncoding RNAs. Cell. Jun. 29, 2007;129(7):1311-23.

Rinn et al., Genome Regulation by Long Noncoding RNAs. Annu Rev Biochem. 2012;81:145-66.

Røsok et al., Systematic identification of sense-antisense transcripts in mammalian cells. Nat Biotechnol. Jan. 2004;22(1):104-8. Epub Dec. 14, 2003.

Sankaran et al., MicroRNA-15a and -16-1 act via MYB to elevate fetal hemoglobin expression in human trisomy 13. Proc Natl Acad Sci U S A. Jan. 25, 2011;108(4):1519-24.

Sankaran, Targeted therapeutic strategies for fetal hemoglobin induction. Hematol Am Soc Hematol Educ Program. 2011;2011:459-65.

Sarma et al., Locked nucleic acids (LNAs) reveal sequence requirements and kinetics of Xist RNA localization to the X chromosome. Proc Natl Acad Sci U S A. Dec. 21, 2010;107(51):22196-201. doi: 10.1073/pnas.1009785107. Epub Dec. 6, 2010.

Saxena et al., Long non-coding RNA modifies chromatin. Bioessays. 2011;33:830-9. Review.

Schoeftner et al., Recruitment of PRC1 function at the initiation of X inactivation independent of PRC2 and silencing. EMBO J. Jul. 12, 2006;25(13):3110-22. Epub Jun. 8, 2006.

Schuettengruber et al., Genome regulation by polycomb and trithorax proteins. Cell. Feb. 23, 2007;128(4):735-45.

Schultz et al., Enhancers compete with a long non-coding RNA for regulation of the Kcnq1 domain. Nucl Acids Res. 2015;43(2):745-59.

Schwartz et al., Genome-wide analysis of Polycomb targets in *Drosophila melanogaster*. Nat Genet. Jun. 2006;38(6):700-5.

Schwartz et al., Polycomb complexes and epigenetic states. Curr Opin Cell Biol. 2008;20:266-73. doi: 10.1016/j.ceb.2008.03.002.

Seong et al., Huntingtin facilitates polycomb repressive complex 2. Hum Mol Genet. Feb. 15, 2010;19(4):573-83. doi: 10.1093/hmg/ddp524. Epub Nov. 23, 2009.

Shaver et al., Origin of the polycomb repressive complex 2 and gene silencing by an E(z) homolog in the unicellular alga Chlamydomonas. Epigenetics. May 16, 2010;5(4):301-12. Epub May 24, 2010.

Shen et al,. EZH1 mediates methylation on histone H3 lysine 27 and complements EZH2 in maintaining stem cell identity and executing pluripotency. Mol Cell. Nov. 21, 2008;32(4):491-502. doi: 10.1016/j.molcel.2008.10.016.

Shen et al., Jumonji modulates polycomb activity and self-renewal versus differentiation of stem cells. Cell. Dec. 24, 2009;139(7):1303-14. doi: 10.1016/j.cell.2009.12.003. Epub Jun. 24, 2010. 26 pages.

Shore et al., Pregnancy-induced noncoding RNA (PINC) associates with polycomb repressive complex 2 and regulates mammary epithelial differentiation. PLoS Genet. 2012;8(7):e1002840. doi: 10.1371/journal.pgen.1002840. Epub Jul. 26, 2012.

(56) References Cited

OTHER PUBLICATIONS

Simon et al., High-resolution Xist binding maps reveal two-step spreading during X-chromosome inactivation. Nature. Dec. 19, 2013;504(7480):465-9. doi: 10.1038/nature12719. Epub Oct. 27, 2013.
Simon et al., Roles of the EZH2 histone methyltransferase in cancer epigenetics. Mutat Res. Dec. 1, 2008;647(1-2):21-9. Review.
Sing et al., A vertebrate Polycomb response element governs segmentation of the posterior hindbrain. Cell. Sep. 4, 2009;138(5):885-97. doi: 10.1016/j.cell.2009.08.020.
Sparmann et al., Polycomb silencers control cell fate, development and cancer. Nat Rev Cancer. Nov. 2006;6(11):846-56. Review.
Taft et al., Non-coding RNAs: regulators of disease. J Pathol. Jan. 2010;220(2):126-39. doi: 10.1002/path.2638. Review.
Taft et al., Tiny RNAs associated with transcription start sites in animals. Nat Genet. May 2009;41(5):572-8. doi: 10.1038/ng.312. Epub Apr. 19, 2009. Erratum in: Nat Genet. Jul. 2009;41(7):859.
Takagi et al., Role of Sp1 in transcription of human ATP2A2 gene in keratinocytes. J Invest Dermatol. Jan. 2008;128(1):96-103. Epub Jun. 28, 2007.
Takahashi et al., Deletion of Gtl2, imprinted non-coding RNA, with its differentially methylated region induces lethal parent-origin-dependent defects in mice. Hum Mol Genet. May 15, 2009;18(10):1879-88. doi: 10.1093/hmg/ddp108. Epub Mar. 4, 2009.
Tano et al., MALAT-1 enhances cell motility of lung adenocarcinoma cells by influencing the expression of motility-related genes. FEBS Lett. Nov. 19, 2010;584(22):4575-80. doi: 10.1016/j.febslet.2010.10.008. Epub Oct. 13, 2010.
Thorvaldsen et al., A YY1 bridge for X inactivation. Cell. Jul. 8, 2011;146(1):11-3. doi: 10.1016/j.cell.2011.06.029.
Thorvaldsen et al., SnapShot: imprinted gene clusters. Cell. Sep. 7, 2007;130(5):958.
Tian et al., The long noncoding RNA, Jpx, is a molecular switch for X chromosome inactivation. Cell. Oct. 29, 2010;143(3):390-403. doi: 10.1016/j.cell.2010.09.049. 21 pages.
Tsai et al., Higher order chromatin structure at the X-inactivation center via looping DNA. Dev Biol. Jul. 15, 2008;319(2):416-25. doi: 10.1016/j.ydbio.2008.04.010. Epub Apr. 18, 2008. 22 pages.
Tsai et al., Long noncoding RNA as modular scaffold of histone modification complexes. Science. Aug. 6, 2010;329(5992):689-93. doi: 10.1126/science.1192002. Epub Nov. 2, 2010. 9 pages.
Vickers et al., Fully modified 2' MOE oligonucleotides redirect polyadenylation. Nucleic Acids Res. Mar. 15, 2001;29(6):1293-9.
Wahlestedt, Natural antisense and noncoding RNA transcripts as potential drug targets. Drug Discov Today. Jun. 2006;11(11-12):503-8.
Wahlestedt, Targeting long non-coding RNA to therapeutically upregulate gene expression. Nature Rev Drug Disc. Jun. 2013;12:433-46. Review.
Wan et al., Regulation of imprinting in clusters: noncoding RNAs versus insulators. Adv Genet. 2008;61:207-23. Review.
Wang et al., Long non-coding RNA UCA1a(CUDR) promotes proliferation and tumorigenesis of bladder cancer. Int J Oncol. Jul. 2012;41(1):276-84.
Wang et al., Molecular mechanisms of long noncoding RNAs. Cell Press. Sep. 16, 2011; 43(6):904-14.
Williamson et al., Identification of an imprinting control region affecting the expression of all transcripts in the Gnas cluster. Nat Genet. Mar. 2006;38(3):350-5.
Williams et al., Oligonucleotide-mediated survival of motor neuron protein expression in CNS improves phenotype in a mouse model of spinal muscular atrophy. J Neurosci. Jun. 17, 2009;29(24):7633-8. doi: 10.1523/JNEUROSCI.0950-09.2009.
Wilusz et al., A triple helix stabilizes the 3' ends of long noncoding RNAs that lack poly(A) tails. Genes Dev. Nov. 1, 2012;26(21):2392-407. doi: 10.1101/gad.204438.112. Epub Oct. 16, 2012.
Woo et al., A Region of theHuman HOXDCluster that Confers Polycomb-Group Responsiveness. Cell. Jan. 8, 2010;140:99-110.
Wutz et al., A Shift from Reversible to Irreversible X Inactivation is Triggered during ES Cell Differentiation. Molec Cell. Apr. 2000;5:695-705.
Xiong et al., Polycomb antagonizes p300/CREB-binding protein associated factor to silence FOXP3 in a Kruppel-like factor-dependent manner. J Biol Chem. Oct. 5, 2012;287(41):34372-85. doi: 10.1074/jbc.M111.325332. Epub Aug. 15, 2012.
Yang et al., Long noncoding RNAs: fresh perspectives into the RNA world. Trends Biochem Sci. Jan. 2014;39(1):35-43. doi: 10.1016/j.tibs.2013.10.002. Epub Nov. 27, 2013. Review.
Yap et al., Molecular interplay of the noncoding RNA ANRIL and methylated histone H3 lysine 27 by polycomb CBX7 in transcriptional silencing of INK4a. Mol Cell. Jun. 11, 2010;38(5):662-74. doi: 10.1016/j.molcel.2010.03.021. Epub Jun. 11, 2011. 23 pages.
Yatsuki et al., Sequence-based structural features between Kvlqt1 and Tapa1 on mouse chromosome 7F4/F5 corresponding to the Beckwith-Wiedemann syndrome region on human 11p15.5: long-stretches of unusually well conserved intronic sequences of kvlqt1 between mouse and human. DNA Res. Jun. 30, 2000;7(3):195-206.
Yu et al., Single-stranded RNAs use RNAi to potently and allele-selectively inhibit mutant huntingtin expression. Cell. Aug. 31, 2012;150(5):895-908. doi: 10.1016/j.cell.2012.08.002.
Zhang et al., Long noncoding RNA-mediated intrachromosomal interactions promote imprinting at the Kcnq1 locus. J Cell Biol. 2014;204(1):61-75.
Zhang et al., NATsDB: Natural Antisense Transcripts DataBase. Nucleic Acids Res. Jan. 2007;35(Database issue):D156-61. Epub Nov. 1, 2006.
Zhang et al., Perinucleolar Targeting of the Inactive X during S Phase: Evidence for a Role in the Maintenance of Silencing. Cell. May 18, 2007;129:693-706.
Zhao et al., Genome-wide identification of polycomb-associated RNAs by RIP-seq. Mol Cell. Dec. 22, 2010;40(6):939-53.
Zhao et al., Polycomb proteins targeted by a short repeat RNA to the mouse X-chromosome. Science. 2008; 322(5902):750-756. doi:10.1126/science.1163045. E-pub version.
Submission. EBI Accession No. EMBL:GC092872. Palma et al. Aug. 31, 2008.
GENBANK Submission; NCBI, Accession No. NM_022876.2. Apr. 2010. 5 pages.
GENBANK Submission; NCBI, Accession No. AM911724.1; Talwar et al. Nov. 26, 2007.
[No Author Listed] Catalogue of Parent of Origin Effects, Imprinted Genes and Related Effects, Parental Origins of de novo Mutations, downloaded at http://igc.otago.ac.nz/home.html on May 22, 2015, 2 pgs.
[No Author Listed] Locked Nucleic Acid. Exiqon. 2009. Retrieved from http://www.exiqon.com/ls/documents/scientific/lna_folder.pdf on Jun. 6, 2016.
[No Author Listed] New England BioLabs 1998/99 Catalog. 121, 284.
[No Author Listed] UCSC Genome Browser on Human Feb. 2009 (GRCh37/hg19) Assembly. Retrieved from http:/ /genome.ucsc.edu/cgi-bin/hgTracks?db=hg1 9&position=chr5%3A 702 11 956-7027 1 955&hgsid=452570083 _sxavccF ldzrwhzM3tcNOyMcxbye 7 on Nov. 9, 2015.
Buck et al., Design strategies and performance of custom DNA sequencing primers. Biotechniques. Sep. 1999;27(3):528-36.
Crea et al., Pharmacologic disruption of Polycomb Repressive Complex 2 inhibits tumorigenicity and tumor progression in prostate cancer. Mol Cancer. Apr. 18, 2011;10:40. doi: 10.1186/1476-4598-10-40.
Davidovich et al., Toward a consensus on the binding specificity and promiscuity of PRC2 for RNA. Mol Cell. Feb. 5, 2015;57(3):552-8. doi: 10.1016/j.molcel.2014.12.017. Epub Jan. 15, 2015.
Dheda et al., Validation of housekeeping genes for normalizing RNA expression in real-time PCR. Biotechniques. Jul. 2004;37(1):112-4, 116, 118-9.
Dias et al., Antisense oligonucleotides: basic concepts and mechanisms. Mol Cancer Ther. Mar. 2002;1(5):347-55.
Eddy, Non-coding RNA genes and the modern RNA world. Nat Rev Genet. Dec. 2001;2(12):919-29.

(56) References Cited

OTHER PUBLICATIONS

Fish et al., Hypoxia-inducible expression of a natural cis-antisense transcript inhibits endothelial nitric-oxide synthase. J Biol Chem. May 25, 2007;282(21):15652-66. Epub Apr. 2, 2007.
Hernandez et al., Degradation of nuclease-stabilized RNA oligonucleotides in Mycoplasma-contaminated cell culture media. Nucleic Acid Ther. Feb. 2012;22(1):58-68. doi: 10.1089/nat.2011.0316. Epub Jan. 9, 2012.
Huang, Shoujun et al., Non-encoding RNA and development of animals, Science China Life Science, Dec. 31, 2009; pp. 21-30.
Inoue et al., Synthesis and hybridization studies on two complementary nona(2'-O-methyl)pribonucleotides. Nucleic Acids Res. Aug. 11, 1987;15(15):6131-48.
Jackson et al., Expression profiling reveals off-target gene regulation by RNAi. Nat Biotechnol. Jun. 2003;21(6):635-7. Epub May 18, 2003.
Lapointe et al., Gene expression profiling identifies clinically relevant subtypes of prostate cancer. Proc Natl Acad Sci U S A. Jan. 20, 2004;101(3):811-6. Epub Jan. 7, 2004.
Latorra et al., Design considerations and effects of LNA in PCR primers. Mol Cell Probes. Oct. 2003;17(5):253-9.
Lennox et al., Improved Performance of Anti-miRNA Oligonucleotides Using a Novel Non-Nucleotide Modifier. Mol Ther Nucleic Acids. Aug. 27, 2013;2:e117. doi: 10.1038/mtna.2013.46.
Nishida et al., Synthesis, RNA selective hybridization and high nuclease resistance of an oligonucleotide containing novel bridged nucleic acid with cyclic urea structure. Chem Commun (Camb). Aug. 7, 2010;46(29):5283-5. doi: 10.1039/c0cc00154f. Epub Jun. 22, 2010.
Rozen et al., Primer3 on the WWW for general users and for biologist programmers. Methods Mol Biol. 2000;132:365-86.
Schadt et al., An integrative genomics approach to infer causal associations between gene expression and disease. Nat Genet. Jul. 2005;37(7):710-7. Epub Jun. 19, 2005.
Taylor et al., Antisense oligonucleotides: a systematic high-throughput approach to target validation and gene function determination. Drug Discov Today. Dec. 1999;4(12):562-567.
Varela et al., Natural Antisense Makes Sense for Gene-specific Activation in Brain. Mol Ther Nucleic Acids. May 15, 2012;1:e24. doi: 10.1038/mtna.2012.17.
Venter et al., The sequence of the human genome. Science. Feb. 16, 2001;291(5507):1304-51. Erratum in: Science Jun. 5, 2001;292(5523):1838.
Whitehead et al., Variation in tissue-specific gene expression among natural populations. Genome Biol. 2005;6(2):R13. Epub Jan. 26, 2005.
Wilusz et al., Long noncoding RNAs: functional surprises from the RNA world. Genes Dev. Jul. 1, 2009;23(13):1494-504. doi:10.1101/gad.1800909.
Yang et al., High fidelity PCR with an off/on switch mediated by proofreading polymerases combining with phosphorothioate-modified primer. Biochem Biophys Res Commun. Mar. 4, 2005;328(1):265-72. Erratum in: Biochem Biophys Res Commun. Jun. 3, 2005;331(2):682. Zhang, Jia [removed]; Li, Kai [removed].
U.S. Appl. No. 14/401,194, filed Nov. 14, 2014, Krieg et al.
U.S. Appl. No. 14/401,201, filed Nov. 14, 2014, Krieg et al.
U.S. Appl. No. 14/401,214, filed Nov. 14, 2014, Krieg et al.
U.S. Appl. No. 14/401,223, filed Nov. 14, 2014, Krieg et al.
U.S. Appl. No. 14/401,227, filed Nov. 14, 2014, Krieg et al.
U.S. Appl. No. 14/401,234, filed Nov. 14, 2014, Krieg et al.
U.S. Appl. No. 14/401,237, filed Nov. 14, 2014, Krieg et al.
U.S. Appl. No. 14/401,240, filed Nov. 14, 2014, Krieg et al.
U.S. Appl. No. 14/401,248, filed Nov. 14, 2014, Krieg et al.
U.S. Appl. No. 14/401,252, filed Nov. 14, 2014, Krieg et al.
U.S. Appl. No. 14/691,361, filed Apr. 20, 2015, Krieg et al.
PCT/US2013/041440, Jul. 29, 2013, International Search Report and Written Opinion.
EP 13790617.8, Dec. 2, 2015, Extended European Search Report.
[No Author Listed] ncRNA. 2011;29(11):1716-1721.
Aartsma-Rus et al., Antisense-induced multiexon skipping for Duchenne muscular dystrophy makes more sense. Am J Hum Genet. Jan. 2004;74(1):83-92.
Bauer et al., The quest for mammalian Polycomb response elements: are we there yet? Chromosoma. Jun. 2016;125(3):471-96. doi:10.1007/s00412-015-0539-4.
Behlke et al., Designing antisense oligonucleotides. Integrated DNA Technologies. 2005. 1-17.
Broderick et al., MicroRNA therapeutics. Gene Ther. Dec. 2011;18(12):1104-10. doi: 10.1038/gt.2011.50. Epub Apr. 28, 2011.
Cantàfora et al., Evaluation of RNA messengers involved in lipid trafficking of human intestinal cells by reverse-transcription polymerase chain reaction with competimer technology and microchip electrophoresis. Electrophoresis. Nov. 2003;24(21):3748-54.
Cuddapah et al., A novel human polycomb binding site acts as a functional polycomb response element in *Drosophila*. PLoS One. 2012;7(5):e36365. doi: 10.1371/journal.pone.0036365. Epub May 3, 2012.
Davidovich et al., The recruitment of chromatin modifiers by long noncoding RNAs: lessons from PRC2. RNA. Dec. 2015;21(12):2007-22. doi:10.1261/rna.053918.115.
Ebralidze et al., PU.1 expression is modulated by the balance of functional sense and antisense RNAs regulated by a shared cis-regulatory element. Genes Dev. Aug. 1, 2008;22(15):2085-92. doi:10.1101/gad.1654808. Supplemental Data.
Ganguli et al., Antagomirbase—a putative antagomir database. Bioinformation. 2011;7(1):41-3.
He et al., Polycomb repressive complex 2 regulates normal development of the mouse heart. Circ Res. Feb. 3, 2012;110(3):406-15. doi: 10.1161/CIRCRESAHA.111.252205. Epub Dec. 8, 2011.
Kao et al., Tumor necrosis factor-alpha decreases sarcoplasmic reticulum Ca2+-ATPase expressions via the promoter methylation in cardiomyocytes. Crit Care Med. Jan. 2010;38(1):217-22. doi: 10.1097/CCM.0b013e3181b4a854.
Kierzek et al., The influence of locked nucleic acid residues on the thermodynamic properties of 2'-O-methyl RNA/RNA heteroduplexes. Nucleic Acids Res. Sep. 9, 2005;33(16):5082-93. Print 2005.
Kiss T. Small nucleolar RNA-guided post-transcriptional modification of cellular RNAs. EMBO J. Jul. 16, 2001;20(14):3617-22.
Kutyavin et al., Reduced aggregation and improved specificity of G-rich oligodeoxyribonucleotides containing pyrazolo[3,4-d]pyrimidine guanine bases. Nucleic Acids Res. Nov. 15, 2002;30(22):4952-9.
Li et al., CTCF regulates allelic expression of Igf2 by orchestrating a promoter-polycomb repressive complex 2 intrachromosomal loop. Mol Cell Biol. Oct. 2008;28(20):6473-82. doi: 10.1128/MCB.00204-08. Epub Jul. 28, 2008.
Mencía et al., Mutations in the seed region of human miR-96 are responsible for nonsyndromic progressive hearing loss. Nat Genet. May 2009;41(5):609-13. doi: 10.1038/ng.355. Epub Apr. 12, 2009.
Mendenhall et al., GC-rich sequence elements recruit PRC2 in mammalian ES cells. PLoS Genet. Dec. 9, 2010;6(12):e1001244. doi: 10.1371/journal.pgen.1001244.
Mirguet et al., From ApoA1 upregulation to BET family bromodomain inhibition:discovery of I-BET151. Bioorg Med Chem Lett. Apr. 15, 2012;22(8):2963-7. doi:10.1016/j.bmcl.2012.01.125. Epub Feb. 8, 2012.
Morse et al., Depleting regulatory T cells with arginine-rich, cell-penetrating, peptide-conjugated morpholino oligomer targeting FOXP3 inhibits regulatory T-cell function. Cancer Gene Ther. Jan. 2012;19(1):30-7. doi: 10.1038/cgt.2011.63.
Prensner et al., Transcriptome sequencing across a prostate cancer cohort identifies PCAT-1, an unannotated lincRNA implicated in disease progression. Nat Biotechnol. Jul. 31, 2011;29(8):742-9. doi: 10.1038/nbt.1914.
Rader, Molecular regulation of HDL metabolism and function: implications for novel therapies. J Clin Invest. Dec. 2006;116(12):3090-100.
Schlesinger et al., Polycomb-mediated methylation on Lys27 of histone H3 pre-marks genes for de novo methylation in cancer. Nat Genet. Feb. 2007;39(2):232-6. Epub Dec. 31, 2006.

(56) References Cited

OTHER PUBLICATIONS

Schwartz et al., Polycomb silencing mechanisms and the management of genomic programmes. Nat Rev Genet. Jan. 2007;8(1):9-22.
Sun et al., SNPs in human miRNA genes affect biogenesis and function. RNA. Sep. 2009;15(9):1640-51. doi: 10.1261/rna.1560209. Epub Jul. 17, 2009.
Tae et al., Bromodomain protein 7 interacts with PRMT5 and PRC2, and is involved in transcriptional repression of their target genes. Nucleic Acids Res. Jul. 2011;39(13):5424-38. doi: 10.1093/nar/gkr170.
Van Peer et al., miRBase Tracker: keeping track of microRNA annotation changes. Database (Oxford). Aug. 25, 2014;2014. pii:bau080. doi: 10.1093/database/bau080. Print 2014.
Wu et al., Binding interactions between long noncoding RNA HOTAIR and PRC2 proteins. Biochemistry. Dec. 31, 2013;52(52):9519-27. doi: 10.1021/bi401085h.
Yang et al., The histone code regulating expression of the imprinted mouse Igf2r gene. Endocrinology. Dec. 2003;144(12):5658-70.
Zhou et al., Targeting RNA-splicing for SMA treatment. Mol Cells. Mar. 2012;33(3):223-8. doi: 10.1007/s10059-012-0005-6.
Alvarez-Salas, Nucleic acids as therapeutic agents. Curr Top Med Chem. 2008;8(15):1379-404.

\* cited by examiner

COMPOSITIONS AND METHODS FOR MODULATING UTRN EXPRESSION

CROSS-REFERENCE TO RELATED APPLICATIONS

This application is a national stage filing under U.S.C. § 371 of PCT International Application PCT/US2013/041452, with an international filing date of May 16, 2013, which claims the benefit under 35 U.S.C. § 119(e) of U.S. Provisional Application No. 61/647,886, entitled "COMPOSITIONS AND METHODS FOR MODULATING UTRN EXPRESSION", filed May 16, 2012, which is incorporated herein by reference in its entirety.

FIELD OF THE INVENTION

The invention relates to oligonucleotide based compositions, as well as methods of using oligonucleotide based compositions for treating disease.

BACKGROUND OF THE INVENTION

Muscular dystrophy (MD) is a group of inherited diseases characterized by damage to muscle fibers and includes Duchenne's muscular dystrophy, Becker's muscular dystrophy, and myotonic dystrophy. Duchenne's muscular dystrophy (DMD) is a recessive X-linked form of muscular dystrophy resulting from mutation in the dystrophin gene. Dystrophin is a structural component of muscle tissue that stabilized the dystroglycan complex and is important for connecting the cytoskeleton of muscle fibers to the basal lamina. When dystrophin is mutated, excess calcium penetrates the cell membrane of muscle cells, causing mitochondrial damage from an influx of water. This mitochondrial damage results in increased oxidative stress and cell death, leading to necrosis of muscle fibers. The destruction of muscle fibers causes the symptoms of DMD, including gradual muscular degeneration, gait ataxia, difficulty breathing, and eventually, death. Becker's Muscular dystrophy (BMD) is a less severe form of muscular dystrophy characterized by progressive muscle weakness in the legs and pelvis. BMD is also caused by a mutation in dystrophin, but unlike DMD, some functional dystrophin is present. Myotonic dystrophy is an autosomal dominant disease characterized by wasting of the muscles, cataracts, heart conduction defects, endocrine changes, and myotonia. Utrophin, encoded by the UTRN gene, is a component of the cytoskeleton located at the neuromuscular synapse and myotendinous junctions, and is involved in membrane maintenance and acetylchoine receptor clustering. Utrophin has homology with dystrophin, especially in the actin binding domain, and can partially compensate for a lack of dystrophin in mice.

SUMMARY OF THE INVENTION

Aspects of the invention disclosed herein provide methods and compositions that are useful for overexpression of Utrophin (UTRN) for the treatment and/or prevention of diseases associated with reduced expression of UTRN, or for which enhanced expression of UTRN would be beneficial (e.g., muscular dystrophies, including Duchenne muscular dystrophy (DMD), Becker Muscular Dystrophy (BMD), and myotonic dystrophy). In certain aspects, the invention provides methods and compositions that are useful for upregulating UTRN in a cell. In some embodiments, the methods and compositions are useful for the treatment and/or prevention (e.g., reducing the risk or delaying the onset) of muscular dystrophies, including DMD, BMD, and myotonic dystrophy. In some embodiments, single stranded oligonucleotides are provided that target a PRC2-associated region of a UTRN gene (e.g., human UTRN) and thereby cause upregulation of the gene. In some embodiments, single stranded oligonucleotides are provided that target a PRC2-associated region of the gene encoding UTRN. In some embodiments, these single stranded oligonucleotides activate or enhance expression of UTRN by relieving or preventing PRC2 mediated repression of UTRN.

Further aspects of the invention provide methods for selecting oligonucleotides for activating or enhancing expression of UTRN. In some embodiments, methods are provided for selecting a set of oligonucleotides that is enriched in candidates (e.g., compared with a random selection of oligonucleotides) for activating or enhancing expression of UTRN. Accordingly, the methods may be used to establish sets of clinical candidates that are enriched in oligonucleotides that activate or enhance expression of UTRN. Such libraries may be utilized, for example, to identify lead oligonucleotides for developing therapeutics to treat UTRN. Furthermore, in some embodiments, oligonucleotide chemistries are provided that are useful for controlling the pharmacokinetics, biodistribution, bioavailability and/or efficacy of the single stranded oligonucleotides for activating expression of UTRN.

According to some aspects of the invention single stranded oligonucleotides are provided that have a region of complementarity that is complementarity with (e.g., at least 8 consecutive nucleotides of) a PRC2-associated region of a UTRN gene, e.g., a PRC2-associated region of the nucleotide sequence set forth as SEQ ID NO: 1 or 2. In some embodiments, the oligonucleotide has at least one of the following features: a) a sequence that is 5'X-Y-Z, in which X is any nucleotide and in which X is at the 5' end of the oligonucleotide, Y is a nucleotide sequence of 6 nucleotides in length that is not a human seed sequence of a microRNA, and Z is a nucleotide sequence of 1 to 23 nucleotides in length; b) a sequence that does not comprise three or more consecutive guanosine nucleotides; c) a sequence that has less than a threshold level of sequence identity with every sequence of nucleotides, of equivalent length to the second nucleotide sequence, that are between 50 kilobases upstream of a 5'-end of an off-target gene and 50 kilobases downstream of a 3'-end of the off-target gene; d) a sequence that is complementary to a PRC2-associated region that encodes an RNA that forms a secondary structure comprising at least two single stranded loops; and e) a sequence that has greater than 60% G-C content. In some embodiments, the single stranded oligonucleotide has at least two of features a), b), c), d), and e), each independently selected. In some embodiments, the single stranded oligonucleotide has at least three of features a), b), c), d), and e), each independently selected. In some embodiments, the single stranded oligonucleotide has at least four of features a), b), c), d), and e), each independently selected. In some embodiments, the single stranded oligonucleotide has each of features a), b), c), d), and e). In certain embodiments, the oligonucleotide has the sequence 5'X-Y-Z, in which the oligonucleotide is 8-50 nucleotides in length.

According to some aspects of the invention, single stranded oligonucleotides are provided that have a sequence X-Y-Z, in which X is any nucleotide, Y is a nucleotide sequence of 6 nucleotides in length that is not a seed sequence of a human microRNA, and Z is a nucleotide sequence of 1 to 23 nucleotides in length, in which the single stranded oligonucleotide is complementary with a PRC2-associated region of a UTRN gene, e.g., a PRC2-associated region of the nucleotide sequence set forth as SEQ ID NO: 1 or 2. In some aspects of the invention, single stranded oligonucleotides are provided that have a sequence 5'-X-Y-Z, in which X is any nucleotide, Y is a nucleotide sequence of 6 nucleotides in length that is not a seed sequence of a human microRNA, and Z is a nucleotide sequence of 1 to 23 nucleotides in length, in which the single stranded oligonucleotide is complementary with at least 8 consecutive nucleotides of a PRC2-associated region of a UTRN gene, e.g., a PRC2-associated region of the nucleotide sequence set forth as SEQ ID NO: 1 or 2. In some embodiments, Y is a sequence selected from Table 1. In some embodiments, the PRC2-associated region is a sequence listed in any one of SEQ ID NOS: 5 to 462.

In some embodiments, the single stranded oligonucleotide comprises a nucleotide sequence as set forth in any one of SEQ ID NOS: 463 to 497728, or a fragment thereof that is at least 8 nucleotides. In some embodiments, the single stranded oligonucleotide comprises a nucleotide sequence as set forth in any one of SEQ ID NOS: 463 to 497728, in which the 5' end of the nucleotide sequence provided is the 5' end of the oligonucleotide. In some embodiments, the region of complementarity (e.g., the at least 8 consecutive nucleotides) is also present within the nucleotide sequence set forth as SEQ ID NO: 3 or 4.

In some embodiments, the single stranded oligonucleotide comprises a nucleotide sequence as set forth in any one of SEQ ID NOS: 463 to 497728. In some embodiments, the single stranded oligonucleotide comprises a fragment of at least 8 nucleotides of a nucleotide sequence as set forth in any one of SEQ ID NOS: 463 to 497728.

In some embodiments, the PRC2-associated region is a sequence listed in any one of SEQ ID NOS: 5 to 328. In some embodiments, the single stranded oligonucleotide comprises a nucleotide sequence as set forth in any one of SEQ ID NOS: 463-307980 or a fragment thereof that is at least 8 nucleotides. In some embodiments, the single stranded oligonucleotide comprises a nucleotide sequence as set forth in any one of SEQ ID NOS: 463-307980, wherein the 5' end of the nucleotide sequence provided is the 5' end of the oligonucleotide. In some embodiments, the at least 8 consecutive nucleotides are also present within the nucleotide sequence set forth as SEQ ID NO: 3.

In some embodiments, the PRC2-associated region is a sequence listed in any one of SEQ ID NOS: 329 to 462. In some embodiments, the single stranded oligonucleotide comprises a nucleotide sequence as set forth in any one of SEQ ID NOS: 306018-497728 or a fragment thereof that is at least 8 nucleotides. In some embodiments, the single stranded oligonucleotide comprises a nucleotide sequence as set forth in any one of SEQ ID NOS: 306018-497728 wherein the 5' end of the nucleotide sequence provided is the 5' end of the oligonucleotide. In some embodiments, the at least 8 consecutive nucleotides are present within the nucleotide sequence set forth as SEQ ID NO: 4. In some embodiments, a single stranded oligonucleotide comprises a nucleotide sequence as set forth in Table 4. In some embodiments, the single stranded oligonucleotide comprises a fragment of at least 8 nucleotides of a nucleotide sequence as set forth in Table 4. In some embodiments, a single stranded oligonucleotide consists of a nucleotide sequence as set forth in Table 4.

In some embodiments, the single stranded oligonucleotide does not comprise three or more consecutive guanosine nucleotides. In some embodiments, the single stranded oligonucleotide does not comprise four or more consecutive guanosine nucleotides.

In some embodiments, the single stranded oligonucleotide is 8 to 30 nucleotides in length. In some embodiments, the single stranded oligonucleotide is up to 50 nucleotides in length. In some embodiments, the single stranded oligonucleotide is 8 to 10 nucleotides in length and all but 1, 2, or 3 of the nucleotides of the complementary sequence of the PRC2-associated region are cytosine or guanosine nucleotides.

In some embodiments, the single stranded oligonucleotide is complementary with at least 8 consecutive nucleotides of a PRC2-associated region of a UTRN gene, e.g., a PRC2-associated region of a nucleotide sequence set forth as SEQ ID NO: 1 or 2, in which the nucleotide sequence of the single stranded oligonucleotide comprises one or more of a nucleotide sequence selected from the group consisting of (a) (X)Xxxxxx, (X)xXxxxx, (X)xxXxxx, (X)xxxXxx, (X)xxxxXx and (X)xxxxxX, (b) (X)XXxxxx, (X)XxXxxx, (X)XxxXxx, (X)XxxxXx, (X)XxxxxX, (X)xXXxxx, (X)xXxXxx, (X)xXxxXx, (X)xXxxxX, (X)xxXXxx, (X)xxXxXx, (X)xxXxxX, (X)xxxXXx, (X)xxxXxX and (X)xxxxXX, (c) (X)XXXxxx, (X)xXXXxx, (X)xxXXXx, (X)xxxXXX, (X)XXxxXx, (X)XXxxXx, (x)XXxxxX, (X)xXXxXx, (X)xXXxxX, (X)xxXXxX, (X)XxXXxx, (X)XxxXXx (x)XxxxXX, (X)xXxXXx, (X)xXxxXX, (X)xxXxXX, (X)xXxXxX and (X)XxXxXx, (d) (X)xxXXX, (X)xXxXXX, (X)xXXxXX, (X)xXXXxX, (X)xXXXXx, (X)XxxXXX, (X)XxXxXX, (X)XxXXxX, (X)XxXXXx, (X)XXxxXX, (X)XXxXxX, (x)XXxXXx, (X)XXXxxX, (X)XXXxXx, and (X)XXXXxx, (e) (X)xXXXXX, (X)XxXXXX, (X)XXxXXX, (X)XXXxXX, (X)XXXXxX and (x)XXXXXx, and (f) XXXXXX, XxXXXXX, XXxXXXX, XXXxXXX, XXXXxXX, XXXXXxX and XXXXXXx, wherein "X" denotes a nucleotide analogue, (X) denotes an optional nucleotide analogue, and "x" denotes a DNA or RNA nucleotide unit.

In some embodiments, at least one nucleotide of the oligonucleotide is a nucleotide analogue. In some embodiments, the at least one nucleotide analogue results in an increase in Tm of the oligonucleotide in a range of 1 to 5° C. compared with an oligonucleotide that does not have the at least one nucleotide analogue.

In some embodiments, at least one nucleotide of the oligonucleotide comprises a 2' O-methyl. In some embodiments, each nucleotide of the oligonucleotide comprises a 2' O-methyl. In some embodiments, the oligonucleotide comprises at least one ribonucleotide, at least one deoxyribonucleotide, or at least one bridged nucleotide. In some embodiments, the bridged nucleotide is a LNA nucleotide, a cEt nucleotide or a ENA modified nucleotide. In some embodiments, each nucleotide of the oligonucleotide is a LNA nucleotide.

In some embodiments, the nucleotides of the oligonucleotide comprise alternating deoxyribonucleotides and 2'-fluoro-deoxyribonucleotides. In some embodiments, the nucleotides of the oligonucleotide comprise alternating deoxyribonucleotides and 2'-O-methyl nucleotides. In some embodiments, the nucleotides of the oligonucleotide comprise alternating deoxyribonucleotides and ENA nucleotide analogues. In some embodiments, the nucleotides of the oligonucleotide comprise alternating deoxyribonucleotides and LNA nucleotides. In some embodiments, the 5' nucleotide of the oligonucleotide is a deoxyribonucleotide. In some embodiments, the nucleotides of the oligonucleotide comprise alternating LNA nucleotides and 2'-O-methyl nucleotides. In some embodiments, the 5' nucleotide of the oligonucleotide is a LNA nucleotide. In some embodiments, the nucleotides of the oligonucleotide comprise deoxyribonucleotides flanked by at least one LNA nucleotide on each of the 5' and 3' ends of the deoxyribonucleotides.

In some embodiments, the single stranded oligonucleotide comprises modified internucleotide linkages (e.g., phosphorothioate internucleotide linkages or other linkages) between at least two, at least three, at least four, at least five or more nucleotides. In some embodiments, the single stranded oligonucleotide comprises modified internucleotide linkages (e.g., phosphorothioate internucleotide linkages or other linkages) between all nucleotides.

In some embodiments, the nucleotide at the 3' position of the oligonucleotide has a 3' hydroxyl group. In some embodiments, the nucleotide at the 3' position of the oligonucleotide has a 3' thiophosphate. In some embodiments, the single stranded oligonucleotide has a biotin moiety or other moiety conjugated to its 5' or 3' nucleotide. In some embodiments, the single stranded oligonucleotide has cholesterol, Vitamin A, folate, sigma receptor ligands, aptamers, peptides, such as CPP, hydrophobic molecules, such as lipids, ASGPR or dynamic polyconjugates and variants thereof at its 5' or 3' end.

According to some aspects of the invention compositions are provided that comprise any of the oligonucleotides disclosed herein, and a carrier. In some embodiments, compositions are provided that comprise any of the oligonucleotides in a buffered solution. In some embodiments, the oligonucleotide is conjugated to the carrier. In some embodiments, the carrier is a peptide. In some embodiments, the carrier is a steroid. According to some aspects of the invention pharmaceutical compositions are provided that comprise any of the oligonucleotides disclosed herein, and a pharmaceutically acceptable carrier.

According to other aspects of the invention, kits are provided that comprise a container housing any of the compositions disclosed herein.

According to some aspects of the invention, methods of increasing expression of UTRN in a cell are provided. In some embodiments, the methods involve delivering any one or more of the single stranded oligonucleotides disclosed herein into the cell. In some embodiments, delivery of the single stranded oligonucleotide into the cell results in a level of expression of UTRN that is greater (e.g., at least 50% greater) than a level of expression of UTRN in a control cell that does not comprise the single stranded oligonucleotide.

According to some aspects of the invention, methods of increasing levels of UTRN in a subject are provided. According to some aspects of the invention, methods of treating a condition (e.g., muscular dystrophies, including DMD, BMD, and myotonic dystrophy) associated with decreased levels of UTRN in a subject are provided. In some embodiments, the methods involve administering any one or more of the single stranded oligonucleotides disclosed herein to the subject.

BRIEF DESCRIPTION OF TABLES

Table 1: Hexamers that are not seed sequences of human miRNAs

Table 2: Oligonucleotide sequences made for testing. RQ (column 3) and RQ SE (column 4) shows the activity of the oligo relative to a control well (usually carrier alone) and the standard error or the triplicate replicates of the experiment. [oligo] is shown in nanomolar for in vitro experiments and in milligrams per kilogram of body weight for in vivo experiments. The Formatted Sequence column sequence of each oligonucleotide, including any modified nucleotides, is shown in Table 4.

Table 3: A listing of oligonucleotide modifications

Table 4: Formatted oligonucleotide sequences made for testing showing nucleotide modifications. The table shows the sequence of the modified nucleotides, where lnaX represents an LNA nucleotide with 3' phosphorothioate linkage, omeX is a 2'-O-methyl nucleotide, dX is a deoxy nucleotide. An s at the end of a nucleotide code indicates that the nucleotide had a 3' phosphorothioate linkage. The "-Sup" at the end of the sequence marks the fact that the 3' end lacks either a phosphate or thiophosphate on the 3' linkage. The Formatted Sequence column shows the sequence of the oligonucleotide, including modified nucleotides, for the oligonucleotides tested in Table 2.

Table 5: Cell lines

DETAILED DESCRIPTION OF CERTAIN EMBODIMENTS OF THE INVENTION

Aspects of the invention provided herein relate to the discovery of polycomb repressive complex 2 (PRC2)-interacting RNAs. Polycomb repressive complex 2 (PRC2) is a histone methyltransferase and a known epigenetic regulator involved in silencing of genomic regions through methylation of histone H3. Among other functions, PRC2 interacts with long noncoding RNAs (lncRNAs), such as RepA, Xist, and Tsix, to catalyze trimethylation of histone H3-lysine-27. PRC2 contains four subunits, Eed, Suz12, RbAp48, and Ezh2. Aspects of the invention relate to the recognition that single stranded oligonucleotides that bind to PRC2-associated regions of RNAs (e.g., lncRNAs) that are expressed from within a genomic region that encompasses or that is in functional proximity to the UTRN gene can induce or enhance expression of UTRN. In some embodiments, this upregulation is believed to result from inhibition of PRC2 mediated repression of UTRN.

As used herein, the term "PRC2-associated region" refers to a region of a nucleic acid that comprises or encodes a sequence of nucleotides that interact directly or indirectly with a component of PRC2. A PRC2-associated region may be present in a RNA (e.g., a long non-coding RNA (lncRNA)) that that interacts with a PRC2. A PRC2-associated region may be present in a DNA that encodes an RNA that interacts with PRC2. In some cases, the PRC2-associated region is equivalently referred to as a PRC2-interacting region.

In some embodiments, a PRC2-associated region is a region of an RNA that crosslinks to a component of PRC2 in response to in situ ultraviolet irradiation of a cell that expresses the RNA, or a region of genomic DNA that encodes that RNA region. In some embodiments, a PRC2-associated region is a region of an RNA that immunoprecipitates with an antibody that targets a component of PRC2, or a region of genomic DNA that encodes that RNA region. In some embodiments, a PRC2-associated region is a region of an RNA that immunoprecipitates with an antibody that binds specifically to SUZ12, EED, EZH2 or RBBP4 (which as noted above are components of PRC2), or a region of genomic DNA that encodes that RNA region.

In some embodiments, a PRC2-associated region is a region of an RNA that is protected from nucleases (e.g., RNases) in an RNA-immunoprecipitation assay that employs an antibody that targets a component of PRC2, or a region of genomic DNA that encodes that protected RNA region. In some embodiments, a PRC2-associated region is a region of an RNA that is protected from nucleases (e.g., RNases) in an RNA-immunoprecipitation assay that employs an antibody that targets SUZ12, EED, EZH2 or RBBP4, or a region of genomic DNA that encodes that protected RNA region.

In some embodiments, a PRC2-associated region is a region of an RNA within which occur a relatively high frequency of sequence reads in a sequencing reaction of products of an RNA-immunoprecipitation assay that employs an antibody that targets a component of PRC2, or a region of genomic DNA that encodes that RNA region. In some embodiments, a PRC2-associated region is a region of an RNA within which occur a relatively high frequency of sequence reads in a sequencing reaction of products of an RNA-immunoprecipitation assay that employs an antibody that binds specifically to SUZ12, EED, EZH2 or RBBP4, or a region of genomic DNA that encodes that protected RNA region. In such embodiments, the PRC2-associated region may be referred to as a "peak."

In some embodiments, a PRC2-associated region comprises a sequence of 40 to 60 nucleotides that interact with PRC2 complex. In some embodiments, a PRC2-associated region comprises a sequence of 40 to 60 nucleotides that encode an RNA that interacts with PRC2. In some embodiments, a PRC2-associated region comprises a sequence of up to 5 kb in length that comprises a sequence (e.g., of 40 to 60 nucleotides) that interacts with PRC2. In some embodiments, a PRC2-associated region comprises a sequence of up to 5 kb in length within which an RNA is encoded that has a sequence (e.g., of 40 to 60 nucleotides) that is known to interact with PRC2. In some embodiments, a PRC2-associated region comprises a sequence of about 4 kb in length that comprise a sequence (e.g., of 40 to 60 nucleotides) that interacts with PRC2. In some embodiments, a PRC2-associated region comprises a sequence of about 4 kb in length within which an RNA is encoded that includes a sequence (e.g., of 40 to 60 nucleotides) that is known to interact with PRC2. In some embodiments, a PRC2-associated region has a sequence as set forth in any one of SEQ ID NOS: 5 to 462.

In some embodiments, single stranded oligonucleotides are provided that specifically bind to, or are complementary to, a PRC2-associated region in a genomic region that encompasses or that is in proximity to the UTRN gene. In some embodiments, single stranded oligonucleotides are provided that specifically bind to, or are complementary to, a PRC2-associated region that has a sequence as set forth in any one of SEQ ID NOS: 5 to 462. In some embodiments, single stranded oligonucleotides are provided that specifically bind to, or are complementary to, a PRC2-associated region that has a sequence as set forth in any one of SEQ ID NOS: 4 to 462 combined with up to 2 kb, up to 5 kb, or up to 10 kb of flanking sequences from a corresponding genomic region to which these SEQ IDs map (e.g., in a human genome). In some embodiments, single stranded oligonucleotides have a sequence as set forth in any one of SEQ ID NOS: 463 to 497728. In some embodiments, single stranded oligonucleotides have a sequence as set forth in Table 4.

Without being bound by a theory of invention, these oligonucleotides are able to interfere with the binding of and function of PRC2, by preventing recruitment of PRC2 to a specific chromosomal locus. For example, a single administration of single stranded oligonucleotides designed to specifically bind a PRC2-associated region lncRNA can stably displace not only the lncRNA, but also the PRC2 that binds to the lncRNA, from binding chromatin. After displacement, the full complement of PRC2 is not recovered for up to 24 hours. Further, lncRNA can recruit PRC2 in a cis fashion, repressing gene expression at or near the specific chromosomal locus from which the lncRNA was transcribed.

Methods of modulating gene expression are provided, in some embodiments, that may be carried out in vitro, ex vivo, or in vivo. It is understood that any reference to uses of compounds throughout the description contemplates use of the compound in preparation of a pharmaceutical composition or medicament for use in the treatment of muscular dystrophies, including DMD, BMD, and myotonic dystrophy. Thus, as one nonlimiting example, this aspect of the invention includes use of such single stranded oligonucleotides in the preparation of a medicament for use in the treatment of disease, wherein the treatment involves upregulating expression of UTRN.

In further aspects of the invention, methods are provided for selecting a candidate oligonucleotide for activating expression of UTRN. The methods generally involve selecting as a candidate oligonucleotide, a single stranded oligonucleotide comprising a nucleotide sequence that is complementary to a PRC2-associated region (e.g., a nucleotide sequence as set forth in any one of SEQ ID NOS: 5 to 462). In some embodiments, sets of oligonucleotides may be selected that are enriched (e.g., compared with a random selection of oligonucleotides) in oligonucleotides that activate expression of UTRN.

Single Stranded Oligonucleotides for Modulating Expression of UTRN

In one aspect of the invention, single stranded oligonucleotides complementary to the PRC2-associated regions are provided for modulating expression of UTRN in a cell. In some embodiments, expression of UTRN is upregulated or increased. In some embodiments, single stranded oligonucleotides complementary to these PRC2-associated regions inhibit the interaction of PRC2 with long RNA transcripts such that gene expression is upregulated or increased. In some embodiments, single stranded oligonucleotides complementary to these PRC2-associated regions inhibit the interaction of PRC2 with long RNA transcripts, resulting in reduced methylation of histone H3 and reduced gene inactivation, such that gene expression is upregulated or increased. In some embodiments, this interaction may be disrupted or inhibited due to a change in the structure of the long RNA that prevents or reduces binding to PRC2. The oligonucleotide may be selected using any of the methods disclosed herein for selecting a candidate oligonucleotide for activating expression of UTRN.

The single stranded oligonucleotide may comprise a region of complementarity that is complementary with a PRC2-associated region of a nucleotide sequence set forth in any one of SEQ ID NOS: 1 to 4. The region of complementarity of the single stranded oligonucleotide may be complementary with at least 6, e.g., at least 7, at least 8, at least 9, at least 10, at least 15 or more consecutive nucleotides of the PRC2-associated region.

The PRC2-associated region may map to a position in a chromosome between 50 kilobases upstream of a 5'-end of the UTRN gene and 50 kilobases downstream of a 3'-end of the UTRN gene. The PRC2-associated region may map to a position in a chromosome between 25 kilobases upstream of a 5'-end of the UTRN gene and 25 kilobases downstream of a 3'-end of the UTRN gene. The PRC2-associated region may map to a position in a chromosome between 12 kilobases upstream of a 5'-end of the UTRN gene and 12 kilobases downstream of a 3'-end of the UTRN gene. The PRC2-associated region may map to a position in a chromosome between 5 kilobases upstream of a 5'-end of the UTRN gene and 5 kilobases downstream of a 3'-end of the UTRN gene.

The genomic position of the selected PRC2-associated region relative to the UTRN gene may vary. For example, the PRC2-associated region may be upstream of the 5' end of the UTRN gene. The PRC2-associated region may be downstream of the 3' end of the UTRN gene. The PRC2-associated region may be within an intron of the UTRN gene. The PRC2-associated region may be within an exon of the UTRN gene. The PRC2-associated region may traverse an intron-exon junction, a 5'-UTR-exon junction or a 3'-UTR-exon junction of the UTRN gene.

The single stranded oligonucleotide may comprise a sequence having the formula X-Y-Z, in which X is any nucleotide, Y is a nucleotide sequence of 6 nucleotides in length that is not a human seed sequence of a microRNA, and Z is a nucleotide sequence of varying length. In some embodiments X is the 5' nucleotide of the oligonucleotide. In some embodiments, when X is anchored at the 5' end of the oligonucleotide, the oligonucleotide does not have any nucleotides or nucleotide analogs linked 5' to X. In some embodiments, other compounds such as peptides or sterols may be linked at the 5' end in this embodiment as long as they are not nucleotides or nucleotide analogs. In some embodiments, the single stranded oligonucleotide has a sequence 5'X-Y-Z and is 8-50 nucleotides in length. Oligonucleotides that have these sequence characteristics are predicted to avoid the miRNA pathway. Therefore, in some embodiments, oligonucleotides having these sequence characteristics are unlikely to have an unintended consequence of functioning in a cell as a miRNA molecule. The Y sequence may be a nucleotide sequence of 6 nucleotides in length set forth in Table 1.

The single stranded oligonucleotide may have a sequence that does not contain guanosine nucleotide stretches (e.g., 3 or more, 4 or more, 5 or more, 6 or more consecutive guanosine nucleotides). In some embodiments, oligonucleotides having guanosine nucleotide stretches have increased non-specific binding and/or off-target effects, compared with oligonucleotides that do not have guanosine nucleotide stretches.

The single stranded oligonucleotide may have a sequence that has less than a threshold level of sequence identity with every sequence of nucleotides, of equivalent length, that map to a genomic position encompassing or in proximity to an off-target gene. For example, an oligonucleotide may be designed to ensure that it does not have a sequence that maps to genomic positions encompassing or in proximity with all known genes (e.g., all known protein coding genes) other than UTRN. In a similar embodiment, an oligonucleotide may be designed to ensure that it does not have a sequence that maps to any other known PRC2-associated region, particularly PRC2-associated regions that are functionally related to any other known gene (e.g., any other known protein coding gene). In either case, the oligonucleotide is expected to have a reduced likelihood of having off-target effects. The threshold level of sequence identity may be 50%, 60%, 70%, 80%, 85%, 90%, 95%, 99% or 100% sequence identity.

The single stranded oligonucleotide may have a sequence that is complementary to a PRC2-associated region that encodes an RNA that forms a secondary structure comprising at least two single stranded loops. In has been discovered that, in some embodiments, oligonucleotides that are complementary to a PRC2-associated region that encodes an RNA that forms a secondary structure comprising one or more single stranded loops (e.g., at least two single stranded loops) have a greater likelihood of being active (e.g., of being capable of activating or enhancing expression of a target gene) than a randomly selected oligonucleotide. In some cases, the secondary structure may comprise a double stranded stem between the at least two single stranded loops. Accordingly, the region of complementarity between the oligonucleotide and the PRC2-associated region may be at a location of the PRC2 associated region that encodes at least a portion of at least one of the loops. In some cases, the region of complementarity between the oligonucleotide and the PRC2-associated region may be at a location of the PRC2-associated region that encodes at least a portion of at least two of the loops. In some cases, the region of complementarity between the oligonucleotide and the PRC2-associated region may be at a location of the PRC2 associated region that encodes at least a portion of the double stranded stem. In some embodiments, a PRC2-associated region (e.g., of an lncRNA) is identified (e.g., using RIP-Seq methodology or information derived therefrom). In some embodiments, the predicted secondary structure RNA (e.g., lncRNA) containing the PRC2-associated region is determined using RNA secondary structure prediction algorithms, e.g., RNAfold, mfold. In some embodiments, oligonucleotides are designed to target a region of the RNA that forms a secondary structure comprising one or more single stranded loop (e.g., at least two single stranded loops) structures which may comprise a double stranded stem between the at least two single stranded loops.

The single stranded oligonucleotide may have a sequence that is has greater than 30% G-C content, greater than 40% G-C content, greater than 50% G-C content, greater than 60% G-C content, greater than 70% G-C content, or greater than 80% G-C content. The single stranded oligonucleotide may have a sequence that has up to 100% G-C content, up to 95% G-C content, up to 90% G-C content, or up to 80% G-C content. In some embodiments in which the oligonucleotide is 8 to 10 nucleotides in length, all but 1, 2, 3, 4, or 5 of the nucleotides of the complementary sequence of the PRC2-associated region are cytosine or guanosine nucleotides. In some embodiments, the sequence of the PRC2-associated region to which the single stranded oligonucleotide is complementary comprises no more than 3 nucleotides selected from adenine and uracil.

The single stranded oligonucleotide may be complementary to a chromosome of a different species (e.g., a mouse, rat, rabbit, goat, monkey, etc.) at a position that encompasses or that is in proximity to that species' homolog of UTRN. The single stranded oligonucleotide may be complementary to a human genomic region encompassing or in proximity to the UTRN gene and also be complementary to a mouse genomic region encompassing or in proximity to the mouse homolog of UTRN. For example, the single stranded oligonucleotide may be complementary to a sequence as set forth in SEQ ID NO: 1 or 2, which is a human genomic region encompassing or in proximity to the UTRN gene, and also be complementary to a sequence as set forth in SEQ ID NO: 3 or 4, which is a mouse genomic region encompassing or in proximity to the mouse homolog of the UTRN gene. Oligonucleotides having these characteristics may be tested in vivo or in vitro for efficacy in multiple species (e.g., human and mouse). This approach also facilitates development of clinical candidates for treating human disease by selecting a species in which an appropriate animal exists for the disease.

In some embodiments, the region of complementarity of the single stranded oligonucleotide is complementary with at least 8 to 15, 8 to 30, 8 to 40, or 10 to 50, or 5 to 50, or 5 to 40 bases, e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 consecutive nucleotides of a PRC2-associated region. In some embodiments, the region of complementarity is complementary with at least 8 consecutive nucleotides of a PRC2-associated region. In some embodiments the sequence of the single stranded oligonucleotide is based on an RNA sequence that binds to PRC2, or a portion thereof, said portion having a length of from 5 to 40 contiguous base pairs, or about 8 to 40 bases, or about 5 to 15, or about 5 to 30, or about 5 to 40 bases, or about 5 to 50 bases.

Complementary, as the term is used in the art, refers to the capacity for precise pairing between two nucleotides. For example, if a nucleotide at a certain position of an oligonucleotide is capable of hydrogen bonding with a nucleotide at the same position of PRC2-associated region, then the single stranded nucleotide and PRC2-associated region are considered to be complementary to each other at that position. The single stranded nucleotide and PRC2-associated region are complementary to each other when a sufficient number of corresponding positions in each molecule are occupied by nucleotides that can hydrogen bond with each other through their bases. Thus, "complementary" is a term which is used to indicate a sufficient degree of complementarity or precise pairing such that stable and specific binding occurs between the single stranded nucleotide and PRC2-associated region. For example, if a base at one position of a single stranded nucleotide is capable of hydrogen bonding with a base at the corresponding position of a PRC2-associated region, then the bases are considered to be complementary to each other at that position. 100% complementarity is not required.

The single stranded oligonucleotide may be at least 80% complementary to (optionally one of at least 85%, 90%, 91%, 92%, 93%, 94%, 95%, 96%, 97%, 98%, 99% or 100% complementary to) the consecutive nucleotides of a PRC2-associated region. In some embodiments the single stranded oligonucleotide may contain 1, 2 or 3 base mismatches compared to the portion of the consecutive nucleotides of a PRC2-associated region. In some embodiments the single stranded oligonucleotide may have up to 3 mismatches over 15 bases, or up to 2 mismatches over 10 bases.

It is understood in the art that a complementary nucleotide sequence need not be 100% complementary to that of its target to be specifically hybridizable. In some embodiments, a complementary nucleic acid sequence for purposes of the present disclosure is specifically hybridizable when binding of the sequence to the target molecule (e.g., lncRNA) interferes with the normal function of the target (e.g., lncRNA) to cause a loss of activity (e.g., inhibiting PRC2-associated repression with consequent up-regulation of gene expression) and there is a sufficient degree of complementarity to avoid non-specific binding of the sequence to non-target sequences under conditions in which avoidance of non-specific binding is desired, e.g., under physiological conditions in the case of in vivo assays or therapeutic treatment, and in the case of in vitro assays, under conditions in which the assays are performed under suitable conditions of stringency.

In some embodiments, the single stranded oligonucleotide is 7, 8, 9, 10, 11, 12, 13, 14, 15, 16, 17, 18, 19, 20, 21, 22, 23, 24, 25, 26, 27, 28, 29, 30, 35, 40, 45, 50 or more nucleotides in length. In a preferred embodiment, the oligonucleotide is 8 to 30 nucleotides in length.

In some embodiments, the PRC2-associated region occurs on the same DNA strand as a gene sequence (sense). In some embodiments, the PRC2-associated region occurs on the opposite DNA strand as a gene sequence (anti-sense). Oligonucleotides complementary to a PRC2-associated region can bind either sense or anti-sense sequences. Base pairings may include both canonical Watson-Crick base pairing and non-Watson-Crick base pairing (e.g., Wobble base pairing and Hoogsteen base pairing). It is understood that for complementary base pairings, adenosine-type bases (A) are complementary to thymidine-type bases (T) or uracil-type bases (U), that cytosine-type bases (C) are complementary to guanosine-type bases (G), and that universal bases such as 3-nitropyrrole or 5-nitroindole can hybridize to and are considered complementary to any A, C, U, or T. Inosine (I) has also been considered in the art to be a universal base and is considered complementary to any A, C, U or T.

In some embodiments, any one or more thymidine (T) nucleotides (or modified nucleotide thereof) or uridine (U) nucleotides (or a modified nucleotide thereof) in a sequence provided herein, including a sequence provided in the sequence listing, may be replaced with any other nucleotide suitable for base pairing (e.g., via a Watson-Crick base pair) with an adenosine nucleotide. In some embodiments, any one or more thymidine (T) nucleotides (or modified nucleotide thereof) or uridine (U) nucleotides (or a modified nucleotide thereof) in a sequence provided herein, including a sequence provided in the sequence listing, may be suitably replaced with a different pyrimidine nucleotide or vice versa. In some embodiments, any one or more thymidine (T) nucleotides (or modified nucleotide thereof) in a sequence provided herein, including a sequence provided in the sequence listing, may be suitably replaced with a uridine (U) nucleotide (or a modified nucleotide thereof) or vice versa.

In some embodiments, GC content of the single stranded oligonucleotide is preferably between about 30-60%. Contiguous runs of three or more Gs or Cs may not be preferable in some embodiments. Accordingly, in some embodiments, the oligonucleotide does not comprise a stretch of three or more guanosine nucleotides.

In some embodiments, the single stranded oligonucleotide specifically binds to, or is complementary to an RNA that is encoded in a genome (e.g., a human genome) as a single contiguous transcript (e.g., as a non-spliced RNA). In some embodiments, the single stranded oligonucleotide specifically binds to, or is complementary to an RNA that is encoded in a genome (e.g., a human genome), in which the distance in the genome between the 5' end of the coding region of the RNA and the 3' end of the coding region of the RNA is less than 1 kb, less than 2 kb, less than 3 kb, less than 4 kb, less than 5 kb, less than 7 kb, less than 8 kb, less than 9 kb, less than 10 kb, or less than 20 kb.

It is to be understood that any oligonucleotide provided herein can be excluded. In some embodiments, a single stranded oligonucleotide is not complementary to SEQ ID NO: 497807.

In some embodiments, a single-stranded oligonucleotide is complementary to a sequence within nucleotides 1 to 2897 or 2931 to 4046 of SEQ ID NO: 272. In some embodiments, a single-stranded oligonucleotide is complementary to a sequence within nucleotides 1 to 2737 or 3137 to 4024 of SEQ ID NO: 399.

In some embodiments, it has been found that single stranded oligonucleotides disclosed herein may increase expression of mRNA corresponding to the gene by at least about 50% (i.e. 150% of normal or 1.5 fold), or by about 2 fold to about 5 fold. In some embodiments, expression may be increased by at least about 15 fold, 20 fold, 30 fold, 40 fold, 50 fold or 100 fold, or any range between any of the foregoing numbers. It has also been found that increased mRNA expression has been shown to correlate to increased protein expression.

In some or any of the embodiments of the oligonucleotides described herein, or processes for designing or synthesizing them, the oligonucleotides will upregulate gene expression and may specifically bind or specifically hybridize or be complementary to the PRC2 binding RNA that is transcribed from the same strand as a protein coding reference gene. The oligonucleotide may bind to a region of the PRC2 binding RNA that originates within or overlaps an intron, exon, intron exon junction, 5' UTR, 3' UTR, a translation initiation region, or a translation termination region of a protein coding sense strand of a reference gene (refGene).

In some or any of the embodiments of oligonucleotides described herein, or processes for designing or synthesizing them, the oligonucleotides will upregulate gene expression and may specifically bind or specifically hybridize or be complementary to a PRC2 binding RNA that transcribed from the opposite strand (the antisense strand) of a protein coding reference gene. The oligonucleotide may bind to a region of the PRC2 binding RNA that originates within or overlaps an intron, exon, intron exon junction, 5' UTR, 3' UTR, a translation initiation region, or a translation termination region of a protein coding antisense strand of a reference gene The oligonucleotides described herein may be modified, e.g., comprise a modified sugar moiety, a modified internucleoside linkage, a modified nucleotide and/or combinations thereof. In addition, the oligonucleotides can exhibit one or more of the following properties: do not induce substantial cleavage or degradation of the target RNA; do not cause substantially complete cleavage or degradation of the target RNA; do not activate the RNAse H pathway; do not activate RISC; do not recruit any Argonaute family protein; are not cleaved by Dicer; do not mediate alternative splicing; are not immune stimulatory; are nuclease resistant; have improved cell uptake compared to unmodified oligonucleotides; are not toxic to cells or mammals; may have improved endosomal exit; do interfere with interaction of lncRNA with PRC2, preferably the Ezh2 subunit but optionally the Suz12, Eed, RbAp46/48 subunits or accessory factors such as Jarid2; do decrease histone H3 lysine-27 methylation and/or do upregulate gene expression.

Oligonucleotides that are designed to interact with RNA to modulate gene expression are a distinct subset of base sequences from those that are designed to bind a DNA target (e.g., are complementary to the underlying genomic DNA sequence from which the RNA is transcribed).

Any of the oligonucleotides disclosed herein may be linked to one or more other oligonucleotides disclosed herein by a linker, e.g., a cleavable linker.

Method for Selecting Candidate Oligonucleotides for Activating Expression of UTRN Methods are provided herein for selecting a candidate oligonucleotide for activating or enhancing expression of UTRN. The target selection methods may generally involve steps for selecting single stranded oligonucleotides having any of the structural and functional characteristics disclosed herein. Typically, the methods involve one or more steps aimed at identifying oligonucleotides that target a PRC2-associated region that is functionally related to UTRN, for example a PRC2-associated region of a lncRNA that regulates expression of UTRN by facilitating (e.g., in a cis-regulatory manner) the recruitment of PRC2 to the UTRN gene. Such oligonucleotides are expected to be candidates for activating expression of UTRN because of their ability to hybridize with the PRC2-associated region of a nucleic acid (e.g., a lncRNA). In some embodiments, this hybridization event is understood to disrupt interaction of PRC2 with the nucleic acid (e.g., a lncRNA) and as a result disrupt recruitment of PRC2 and its associated co-repressors (e.g., chromatin remodeling factors) to the UTRN gene locus.

Methods of selecting a candidate oligonucleotide may involve selecting a PRC2-associated region (e.g., a nucleotide sequence as set forth in any one of SEQ ID NOS: 5 to 462) that maps to a chromosomal position encompassing or in proximity to the UTRN gene (e.g., a chromosomal position having a sequence as set forth in any one of SEQ ID NOS: 1 to 4). The PRC2-associated region may map to the strand of the chromosome comprising the sense strand of the UTRN gene, in which case the candidate oligonucleotide is complementary to the sense strand of the UTRN gene (i.e., is antisense to the UTRN gene). Alternatively, the PRC2-associated region may map to the strand of the first chromosome comprising the antisense strand of the UTRN gene, in which case the oligonucleotide is complementary to the antisense strand (the template strand) of the UTRN gene (i.e., is sense to the UTRN gene).

Methods for selecting a set of candidate oligonucleotides that is enriched in oligonucleotides that activate expression of UTRN may involve selecting one or more PRC2-associated regions that map to a chromosomal position that encompasses or that is in proximity to the UTRN gene and selecting a set of oligonucleotides, in which each oligonucleotide in the set comprises a nucleotide sequence that is complementary with the one or more PRC2-associated regions. As used herein, the phrase, "a set of oligonucleotides that is enriched in oligonucleotides that activate expression of" refers to a set of oligonucleotides that has a greater number of oligonucleotides that activate expression of a target gene (e.g., UTRN) compared with a random selection of oligonucleotides of the same physicochemical properties (e.g., the same GC content, $T_m$, length etc.) as the enriched set.

Where the design and/or synthesis of a single stranded oligonucleotide involves design and/or synthesis of a sequence that is complementary to a nucleic acid or PRC2-associated region described by such sequence information, the skilled person is readily able to determine the complementary sequence, e.g., through understanding of Watson Crick base pairing rules which form part of the common general knowledge in the field.

In some embodiments design and/or synthesis of a single stranded oligonucleotide involves manufacture of an oligonucleotide from starting materials by techniques known to those of skill in the art, where the synthesis may be based on a sequence of a PRC2-associated region, or portion thereof.

Methods of design and/or synthesis of a single stranded oligonucleotide may involve one or more of the steps of:

Identifying and/or selecting PRC2-associated region;

Designing a nucleic acid sequence having a desired degree of sequence identity or complementarity to a PRC2-associated region or a portion thereof;

Synthesizing a single stranded oligonucleotide to the designed sequence;

Purifying the synthesized single stranded oligonucleotide; and

Optionally mixing the synthesized single stranded oligonucleotide with at least one pharmaceutically acceptable diluent, carrier or excipient to form a pharmaceutical composition or medicament.

Single stranded oligonucleotides so designed and/or synthesized may be useful in method of modulating gene expression as described herein.

Preferably, single stranded oligonucleotides of the invention are synthesized chemically. Oligonucleotides used to practice this invention can be synthesized in vitro by well-known chemical synthesis techniques.

Oligonucleotides of the invention can be stabilized against nucleolytic degradation such as by the incorporation of a modification, e.g., a nucleotide modification. For example, nucleic acid sequences of the invention include a phosphorothioate at least the first, second, or third internucleotide linkage at the 5' or 3' end of the nucleotide sequence. As another example, the nucleic acid sequence can include a 2'-modified nucleotide, e.g., a 2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA). As another example, the nucleic acid sequence can include at least one 2'-O-methyl-modified nucleotide, and in some embodiments, all of the nucleotides include a 2'-O-methyl modification. In some embodiments, the nucleic acids are "locked," i.e., comprise nucleic acid analogues in which the ribose ring is "locked" by a methylene bridge connecting the 2'-O atom and the 4'-C atom.

It is understood that any of the modified chemistries or formats of single stranded oligonucleotides described herein can be combined with each other, and that one, two, three, four, five, or more different types of modifications can be included within the same molecule.

In some embodiments, the method may further comprise the steps of amplifying the synthesized single stranded oligonucleotide, and/or purifying the single stranded oligonucleotide (or amplified single stranded oligonucleotide), and/or sequencing the single stranded oligonucleotide so obtained.

As such, the process of preparing a single stranded oligonucleotide may be a process that is for use in the manufacture of a pharmaceutical composition or medicament for use in the treatment of disease, optionally wherein the treatment involves modulating expression of a gene associated with a PRC2-associated region.

In the methods described above a PRC2-associated region may be, or have been, identified, or obtained, by a method that involves identifying RNA that binds to PRC2.

Such methods may involve the following steps: providing a sample containing nuclear ribonucleic acids, contacting the sample with an agent that binds specifically to PRC2 or a subunit thereof, allowing complexes to form between the agent and protein in the sample, partitioning the complexes, synthesizing nucleic acid that is complementary to nucleic acid present in the complexes.

Where the single stranded oligonucleotide is based on a PRC2-associated region, or a portion of such a sequence, it may be based on information about that sequence, e.g., sequence information available in written or electronic form, which may include sequence information contained in publicly available scientific publications or sequence databases.

Nucleotide Analogues

In some embodiments, the oligonucleotide may comprise at least one ribonucleotide, at least one deoxyribonucleotide, and/or at least one bridged nucleotide. In some embodiments, the oligonucleotide may comprise a bridged nucleotide, such as a locked nucleic acid (LNA) nucleotide, a constrained ethyl (cEt) nucleotide, or an ethylene bridged nucleic acid (ENA) nucleotide. Examples of such nucleotides are disclosed herein and known in the art. In some embodiments, the oligonucleotide comprises a nucleotide analog disclosed in one of the following United States patent or patent application Publications: U.S. Pat. Nos. 7,399,845, 7,741,457, 8,022,193, 7,569,686, 7,335,765, 7,314,923, 7,335,765, and 7,816,333, US 20110009471, the entire contents of each of which are incorporated herein by reference for all purposes. The oligonucleotide may have one or more 2' O-methyl nucleotides. The oligonucleotide may consist entirely of 2' O-methyl nucleotides.

Often the single stranded oligonucleotide has one or more nucleotide analogues. For example, the single stranded oligonucleotide may have at least one nucleotide analogue that results in an increase in $T_m$ of the oligonucleotide in a range of 1° C., 2° C., 3° C., 4° C., or 5° C. compared with an oligonucleotide that does not have the at least one nucleotide analogue. The single stranded oligonucleotide may have a plurality of nucleotide analogues that results in a total increase in $T_m$ of the oligonucleotide in a range of 2° C., 3° C., 4° C., 5° C., 6° C., 7° C., 8° C., 9° C., 10° C., 15° C., 20° C., 25° C., 30° C., 35° C., 40° C., 45° C. or more compared with an oligonucleotide that does not have the nucleotide analogue.

The oligonucleotide may be of up to 50 nucleotides in length in which 2 to 10, 2 to 15, 2 to 16, 2 to 17, 2 to 18, 2 to 19, 2 to 20, 2 to 25, 2 to 30, 2 to 40, 2 to 45, or more nucleotides of the oligonucleotide are nucleotide analogues. The oligonucleotide may be of 8 to 30 nucleotides in length in which 2 to 10, 2 to 15, 2 to 16, 2 to 17, 2 to 18, 2 to 19, 2 to 20, 2 to 25, 2 to 30 nucleotides of the oligonucleotide are nucleotide analogues. The oligonucleotide may be of 8 to 15 nucleotides in length in which 2 to 4, 2 to 5, 2 to 6, 2 to 7, 2 to 8, 2 to 9, 2 to 10, 2 to 11, 2 to 12, 2 to 13, 2 to 14 nucleotides of the oligonucleotide are nucleotide analogues. Optionally, the oligonucleotides may have every nucleotide except 1, 2, 3, 4, 5, 6, 7, 8, 9, or 10 nucleotides modified.

The oligonucleotide may consist entirely of bridged nucleotides (e.g., LNA nucleotides, cEt nucleotides, ENA nucleotides). The oligonucleotide may comprise alternating deoxyribonucleotides and 2'-fluoro-deoxyribonucleotides. The oligonucleotide may comprise alternating deoxyribonucleotides and 2'-O-methyl nucleotides. The oligonucleotide may comprise alternating deoxyribonucleotides and ENA nucleotide analogues. The oligonucleotide may comprise alternating deoxyribonucleotides and LNA nucleotides. The oligonucleotide may comprise alternating LNA nucleotides and 2'-O-methyl nucleotides. The oligonucleotide may have a 5' nucleotide that is a bridged nucleotide (e.g., a LNA nucleotide, cEt nucleotide, ENA nucleotide). The oligonucleotide may have a 5' nucleotide that is a deoxyribonucleotide.

The oligonucleotide may comprise deoxyribonucleotides flanked by at least one bridged nucleotide (e.g., a LNA nucleotide, cEt nucleotide, ENA nucleotide) on each of the 5' and 3' ends of the deoxyribonucleotides. The oligonucleotide may comprise deoxyribonucleotides flanked by 1, 2, 3, 4, 5, 6, 7, 8 or more bridged nucleotides (e.g., LNA nucleotides, cEt nucleotides, ENA nucleotides) on each of the 5' and 3' ends of the deoxyribonucleotides. The 3' position of the oligonucleotide may have a 3' hydroxyl group. The 3' position of the oligonucleotide may have a 3' thiophosphate.

The oligonucleotide may be conjugated with a label. For example, the oligonucleotide may be conjugated with a biotin moiety, cholesterol, Vitamin A, folate, sigma receptor ligands, aptamers, peptides, such as CPP, hydrophobic molecules, such as lipids, ASGPR or dynamic polyconjugates and variants thereof at its 5' or 3' end.

Preferably the single stranded oligonucleotide comprises one or more modifications comprising: a modified sugar moiety, and/or a modified internucleoside linkage, and/or a modified nucleotide and/or combinations thereof. It is not necessary for all positions in a given oligonucleotide to be uniformly modified, and in fact more than one of the modifications described herein may be incorporated in a single oligonucleotide or even at within a single nucleoside within an oligonucleotide.

In some embodiments, the single stranded oligonucleotides are chimeric oligonucleotides that contain two or more chemically distinct regions, each made up of at least one nucleotide. These oligonucleotides typically contain at least one region of modified nucleotides that confers one or more beneficial properties (such as, for example, increased nuclease resistance, increased uptake into cells, increased binding affinity for the target) and a region that is a substrate for enzymes capable of cleaving RNA:DNA or RNA:RNA hybrids. Chimeric single stranded oligonucleotides of the invention may be formed as composite structures of two or more oligonucleotides, modified oligonucleotides, oligonucleosides and/or oligonucleotide mimetics as described above. Such compounds have also been referred to in the art as hybrids or gapmers. Representative United States patents that teach the preparation of such hybrid structures comprise, but are not limited to, U.S. Pat. Nos. 5,013,830; 5,149,797; 5,220,007; 5,256,775; 5,366,878; 5,403,711; 5,491,133; 5,565,350; 5,623,065; 5,652,355; 5,652,356; and 5,700,922, each of which is herein incorporated by reference.

In some embodiments, the single stranded oligonucleotide comprises at least one nucleotide modified at the 2' position of the sugar, most preferably a 2'-O-alkyl, 2'-O-alkyl-O-alkyl or 2'-fluoro-modified nucleotide. In other preferred embodiments, RNA modifications include 2'-fluoro, 2'-amino and 2' O-methyl modifications on the ribose of pyrimidines, abasic residues or an inverted base at the 3' end of the RNA. Such modifications are routinely incorporated into oligonucleotides and these oligonucleotides have been shown to have a higher Tm (i.e., higher target binding affinity) than 2'-deoxyoligonucleotides against a given target.

A number of nucleotide and nucleoside modifications have been shown to make the oligonucleotide into which they are incorporated more resistant to nuclease digestion than the native oligodeoxynucleotide; these modified oligos survive intact for a longer time than unmodified oligonucleotides. Specific examples of modified oligonucleotides include those comprising modified backbones, for example, phosphorothioates, phosphotriesters, methyl phosphonates, short chain alkyl or cycloalkyl intersugar linkages or short chain heteroatomic or heterocyclic intersugar linkages. Most preferred are oligonucleotides with phosphorothioate backbones and those with heteroatom backbones, particularly $CH_2$—NH—O—$CH_2$, CH, ~N($CH_3$)~O~$CH_2$ (known as a methylene(methylimino) or MMI backbone, $CH_2$—O—N($CH_3$)—$CH_2$, $CH_2$—N($CH_3$)—N($CH_3$)—$CH_2$ and O—N($CH_3$)—$CH_2$—$CH_2$ backbones, wherein the native phosphodiester backbone is represented as O—P—O—$CH_,$); amide backbones (see De Mesmaeker et al. Acc. Chem. Res. 1995, 28:366-374); morpholino backbone structures (see Summerton and Weller, U.S. Pat. No. 5,034,506); peptide nucleic acid (PNA) backbone (wherein the phosphodiester backbone of the oligonucleotide is replaced with a polyamide backbone, the nucleotides being bound directly or indirectly to the aza nitrogen atoms of the polyamide backbone, see Nielsen et al., Science 1991, 254, 1497). Phosphorus-containing linkages include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'; see U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050.

Morpholino-based oligomeric compounds are described in Dwaine A. Braasch and David R. Corey, Biochemistry, 2002, 41(14), 4503-4510); Genesis, volume 30, issue 3, 2001; Heasman, J., Dev. Biol., 2002, 243, 209-214; Nasevicius et al., Nat. Genet., 2000, 26, 216-220; Lacerra et al., Proc. Natl. Acad. Sci., 2000, 97, 9591-9596; and U.S. Pat. No. 5,034,506, issued Jul. 23, 1991. In some embodiments, the morpholino-based oligomeric compound is a phosphorodiamidate morpholino oligomer (PMO) (e.g., as described in Iverson, Curr. Opin. Mol. Ther., 3:235-238, 2001; and Wang et al., J. Gene Med., 12:354-364, 2010; the disclosures of which are incorporated herein by reference in their entireties).

Cyclohexenyl nucleic acid oligonucleotide mimetics are described in Wang et al., J. Am. Chem. Soc., 2000, 122, 8595-8602.

Modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These comprise those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH2$ component parts; see U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439, each of which is herein incorporated by reference.

Modified oligonucleotides are also known that include oligonucleotides that are based on or constructed from arabinonucleotide or modified arabinonucleotide residues. Arabinonucleosides are stereoisomers of ribonucleosides, differing only in the configuration at the 2'-position of the sugar ring. In some embodiments, a 2'-arabino modification is 2'-F arabino. In some embodiments, the modified oligonucleotide is 2'-fluoro-D-arabinonucleic acid (FANA) (as described in, for example, Lon et al., Biochem., 41:3457-3467, 2002 and Min et al., Bioorg. Med. Chem. Lett., 12:2651-2654, 2002; the disclosures of which are incorporated herein by reference in their entireties). Similar modifications can also be made at other positions on the sugar, particularly the 3' position of the sugar on a 3' terminal nucleoside or in 2'-5' linked oligonucleotides and the 5' position of 5' terminal nucleotide.

PCT Publication No. WO 99/67378 discloses arabinonucleic acids (ANA) oligomers and their analogues for improved sequence specific inhibition of gene expression via association to complementary messenger RNA.

Other preferred modifications include ethylene-bridged nucleic acids (ENAs) (e.g., International Patent Publication No. WO 2005/042777, Morita et al., Nucleic Acid Res., Suppl 1:241-242, 2001; Surono et al., Hum. Gene Ther., 15:749-757, 2004; Koizumi, Curr. Opin. Mol. Ther., 8:144-149, 2006 and Horie et al., Nucleic Acids Symp. Ser (Oxf), 49:171-172, 2005; the disclosures of which are incorporated herein by reference in their entireties). Preferred ENAs include, but are not limited to, 2'-O,4'-C-ethylene-bridged nucleic acids.

Examples of LNAs are described in WO/2008/043753 and include compounds of the following general formula.

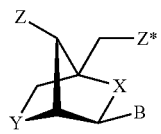

where X and Y are independently selected among the groups —O—,
—S—, —N(H)—, N(R)—, —CH$_2$— or —CH— (if part of a double bond),
—CH$_2$—O—, —CH$_2$—S—, —CH$_2$—N(H)—, —CH$_2$—N(R)—, —CH$_2$—CH$_2$— or —CH$_2$—CH— (if part of a double bond),
—CH=CH—, where R is selected from hydrogen and C$_{1-4}$-alkyl; Z and Z* are independently selected among an internucleoside linkage, a terminal group or a protecting group; B constitutes a natural or non-natural nucleotide base moiety; and the asymmetric groups may be found in either orientation.

Preferably, the LNA used in the oligonucleotides described herein comprises at least one LNA unit according any of the formulas

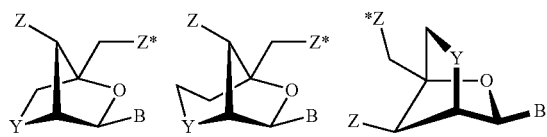

wherein Y is —O—, —S—, —NH—, or N(R$^H$); Z and Z* are independently selected among an internucleoside linkage, a terminal group or a protecting group; B constitutes a natural or non-natural nucleotide base moiety, and RH is selected from hydrogen and C$_{1-4}$-alkyl.

In some embodiments, the Locked Nucleic Acid (LNA) used in the oligonucleotides described herein comprises at least one Locked Nucleic Acid (LNA) unit according any of the formulas shown in Scheme 2 of PCT/DK2006/000512.

In some embodiments, the LNA used in the oligomer of the invention comprises internucleoside linkages selected from —O—P(O)$_2$—O—, —O—P(O,S)—O—, —O—P(S)$_2$—O—, —S—P(O)$_2$—O—, —S—P(O,S)—O—, —S—P(S)$_2$—O—, —O—P(O)$_2$—S—, —O—P(O,S)—S—, —S—P(O)$_2$—S—, —O—PO(R$^H$)—O—, O—PO(OCH$_3$)—O—, —O—PO(NR$^H$)—O—, —O—PO(OCH$_2$CH$_2$S—R)—O—, —O—PO(BH$_3$)—O—, —O—PO(NHR$^H$)—O—, —O—P(O)$_2$—NR$^H$—, —NR$^H$—P(O)$_2$—O—, —NR$^H$—CO—O—, where R$^H$ is selected from hydrogen and C$_{1-4}$-alkyl.

Specifically preferred LNA units are shown in scheme 2:

Scheme 2

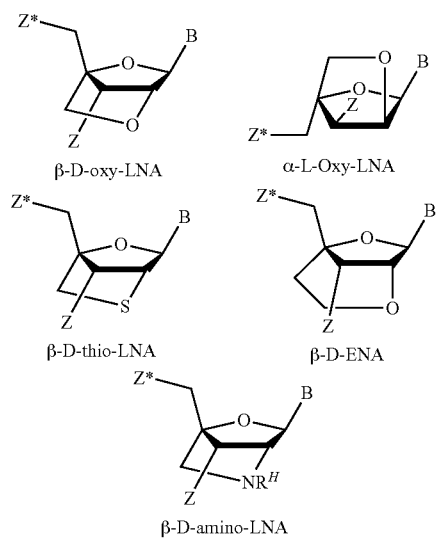

β-D-oxy-LNA  α-L-Oxy-LNA

β-D-thio-LNA  β-D-ENA

β-D-amino-LNA

The term "thio-LNA" comprises a locked nucleotide in which at least one of X or Y in the general formula above is selected from S or —CH$_2$—S—. Thio-LNA can be in both beta-D and alpha-L-configuration.

The term "amino-LNA" comprises a locked nucleotide in which at least one of X or Y in the general formula above is selected from —N(H)—, N(R)—, CH$_2$—N(H)—, and —CH$_2$—N(R)—where R is selected from hydrogen and C$_{1-4}$-alkyl. Amino-LNA can be in both beta-D and alpha-L-configuration.

The term "oxy-LNA" comprises a locked nucleotide in which at least one of X or Y in the general formula above represents —O— or —CH$_2$—O—. Oxy-LNA can be in both beta-D and alpha-L-configuration.

The term "ena-LNA" comprises a locked nucleotide in which Y in the general formula above is —CH$_2$—O— (where the oxygen atom of —CH$_2$—O— is attached to the 2'-position relative to the base B).

LNAs are described in additional detail herein.

One or more substituted sugar moieties can also be included, e.g., one of the following at the 2' position: OH, SH, SCH$_3$, F, OCN, OCH$_3$ OCH$_3$, OCH$_3$ O(CH$_2$)n CH$_3$, O(CH$_2$)n NH$_2$ or O(CH$_2$)n CH$_3$ where n is from 1 to about 10; C1 to C10 lower alkyl, alkoxyalkoxy, substituted lower alkyl, alkaryl or aralkyl; Cl; Br; CN; CF$_3$; OCF$_3$; O—, S—, or N-alkyl; O—, S—, or N-alkenyl; SOCH$_3$; SO$_2$ CH$_3$;

ONO$_2$; NO$_2$, N$_3$; NH2; heterocycloalkyl; heterocycloalkaryl; amino alkylamino; polyalkylamino; substituted silyl; an RNA cleaving group; a reporter group; an intercalator; a group for improving the pharmacokinetic properties of an oligonucleotide; or a group for improving the pharmacodynamic properties of an oligonucleotide and other substituents having similar properties. A preferred modification includes 2'-methoxyethoxy [2'-O—CH$_2$CH$_2$OCH$_3$, also known as 2'-O-(2-methoxyethyl)](Martin et al, Helv. Chim. Acta, 1995, 78, 486). Other preferred modifications include 2'-methoxy (2'-O—CH$_3$), 2'-propoxy (2'-OCH$_2$CH$_2$CH$_3$) and 2'-fluoro (2'-F). Similar modifications may also be made at other positions on the oligonucleotide, particularly the 3' position of the sugar on the 3' terminal nucleotide and the 5' position of 5' terminal nucleotide. Oligonucleotides may also have sugar mimetics such as cyclobutyls in place of the pentofuranosyl group.

Single stranded oligonucleotides can also include, additionally or alternatively, nucleobase (often referred to in the art simply as "base") modifications or substitutions. As used herein, "unmodified" or "natural" nucleobases include adenine (A), guanine (G), thymine (T), cytosine (C) and uracil (U). Modified nucleobases include nucleobases found only infrequently or transiently in natural nucleic acids, e.g., hypoxanthine, 6-methyladenine, 5-Me pyrimidines, particularly 5-methylcytosine (also referred to as 5-methyl-2' deoxycytosine and often referred to in the art as 5-Me-C), 5-hydroxymethylcytosine (HMC), glycosyl HMC and gentobiosyl HMC, isocytosine, pseudoisocytosine, as well as synthetic nucleobases, e.g., 2-aminoadenine, 2-(methylamino)adenine, 2-(imidazolylalkyl)adenine, 2-(aminoalkylamino)adenine or other heterosubstituted alkyladenines, 2-thiouracil, 2-thiothymine, 5-bromouracil, 5-hydroxymethyluracil, 5-propynyluracil, 8-azaguanine, 7-deazaguanine, N6 (6-aminohexyl)adenine, 6-aminopurine, 2-aminopurine, 2-chloro-6-aminopurine and 2,6-diaminopurine or other diaminopurines. See, e.g., Kornberg, "DNA Replication," W. H. Freeman & Co., San Francisco, 1980, pp 75-77; and Gebeyehu, G., et al. Nucl. Acids Res., 15:4513 (1987)). A "universal" base known in the art, e.g., inosine, can also be included. 5-Me-C substitutions have been shown to increase nucleic acid duplex stability by 0.6-1.2° C. (Sanghvi, in Crooke, and Lebleu, eds., Antisense Research and Applications, CRC Press, Boca Raton, 1993, pp. 276-278) and may be used as base substitutions.

It is not necessary for all positions in a given oligonucleotide to be uniformly modified, and in fact more than one of the modifications described herein may be incorporated in a single oligonucleotide or even at within a single nucleoside within an oligonucleotide.

In some embodiments, both a sugar and an internucleoside linkage, i.e., the backbone, of the nucleotide units are replaced with novel groups. The base units are maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide is replaced with an amide containing backbone, for example, an aminoethylglycine backbone. The nucleobases are retained and are bound directly or indirectly to aza nitrogen atoms of the amide portion of the backbone. Representative United States patents that teach the preparation of PNA compounds include, but are not limited to, U.S. Pat. Nos. 5,539,082; 5,714,331; and 5,719,262, each of which is herein incorporated by reference. Further teaching of PNA compounds can be found in Nielsen et al, Science, 1991, 254, 1497-1500.

Single stranded oligonucleotides can also include one or more nucleobase (often referred to in the art simply as "base") modifications or substitutions. As used herein, "unmodified" or "natural" nucleobases comprise the purine bases adenine (A) and guanine (G), and the pyrimidine bases thymine (T), cytosine (C) and uracil (U). Modified nucleobases comprise other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudo-uracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylquanine and 7-methyladenine, 8-azaguanine and 8-azaadenine, 7-deazaguanine and 7-deazaadenine and 3-deazaguanine and 3-deazaadenine.

Further, nucleobases comprise those disclosed in U.S. Pat. No. 3,687,808, those disclosed in "The Concise Encyclopedia of Polymer Science And Engineering", pages 858-859, Kroschwitz, ed. John Wiley & Sons, 1990, those disclosed by Englisch et al., Angewandle Chemie, International Edition, 1991, 30, page 613, and those disclosed by Sanghvi, Chapter 15, Antisense Research and Applications," pages 289-302, Crooke, and Lebleu, eds., CRC Press, 1993. Certain of these nucleobases are particularly useful for increasing the binding affinity of the oligomeric compounds of the invention. These include 5-substituted pyrimidines, 6-azapyrimidines and N-2, N-6 and 0-6 substituted purines, comprising 2-aminopropyladenine, 5-propynyluracil and 5-propynylcytosine. 5-methylcytosine substitutions have been shown to increase nucleic acid duplex stability by 0.6-1.2<0>C (Sanghvi, et al., eds, "Antisense Research and Applications," CRC Press, Boca Raton, 1993, pp. 276-278) and are presently preferred base substitutions, even more particularly when combined with 2'-O-methoxyethyl sugar modifications. Modified nucleobases are described in U.S. Pat. No. 3,687,808, as well as U.S. Pat. Nos. 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,596,091; 5,614,617; 5,750,692, and 5,681,941, each of which is herein incorporated by reference.

In some embodiments, the single stranded oligonucleotides are chemically linked to one or more moieties or conjugates that enhance the activity, cellular distribution, or cellular uptake of the oligonucleotide. For example, one or more single stranded oligonucleotides, of the same or different types, can be conjugated to each other; or single stranded oligonucleotides can be conjugated to targeting moieties with enhanced specificity for a cell type or tissue type. Such moieties include, but are not limited to, lipid moieties such as a cholesterol moiety (Letsinger et al., Proc. Natl. Acad. Sci. USA, 1989, 86, 6553-6556), cholic acid (Manoharan et al., Bioorg. Med. Chem. Let., 1994, 4, 1053-1060), a thioether, e.g., hexyl-S-tritylthiol (Manoharan et al, Ann. N.Y. Acad. Sci., 1992, 660, 306-309; Manoharan et al., Bioorg. Med. Chem. Let., 1993, 3, 2765-2770), a thiocholesterol (Oberhauser et al., Nucl. Acids Res., 1992, 20, 533-538), an aliphatic chain, e.g., dodecandiol or undecyl residues (Kabanov et al., FEBS Lett., 1990, 259, 327-

330; Svinarchuk et al., Biochimie, 1993, 75, 49-54), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36, 3651-3654; Shea et al., Nucl. Acids Res., 1990, 18, 3777-3783), a polyamine or a polyethylene glycol chain (Mancharan et al., Nucleosides & Nucleotides, 1995, 14, 969-973), or adamantane acetic acid (Manoharan et al., Tetrahedron Lett., 1995, 36, 3651-3654), a palmityl moiety (Mishra et al., Biochim. Biophys. Acta, 1995, 1264, 229-237), or an octadecylamine or hexylamino-carbonyl-t oxycholesterol moiety (Crooke et al., J. Pharmacol. Exp. Ther., 1996, 277, 923-937). See also U.S. Pat. Nos. 4,828,979; 4,948,882; 5,218,105; 5,525,465; 5,541,313; 5,545,730; 5,552,538; 5,578,717; 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941, each of which is herein incorporated by reference.

These moieties or conjugates can include conjugate groups covalently bound to functional groups such as primary or secondary hydroxyl groups. Conjugate groups of the invention include intercalators, reporter molecules, polyamines, polyamides, polyethylene glycols, polyethers, groups that enhance the pharmacodynamic properties of oligomers, and groups that enhance the pharmacokinetic properties of oligomers. Typical conjugate groups include cholesterols, lipids, phospholipids, biotin, phenazine, folate, phenanthridine, anthraquinone, acridine, fluoresceins, rhodamines, coumarins, and dyes. Groups that enhance the pharmacodynamic properties, in the context of this invention, include groups that improve uptake, enhance resistance to degradation, and/or strengthen sequence-specific hybridization with the target nucleic acid. Groups that enhance the pharmacokinetic properties, in the context of this invention, include groups that improve uptake, distribution, metabolism or excretion of the compounds of the present invention. Representative conjugate groups are disclosed in International Patent Application No. PCT/US92/09196, filed Oct. 23, 1992, and U.S. Pat. No. 6,287,860, which are incorporated herein by reference. Conjugate moieties include, but are not limited to, lipid moieties such as a cholesterol moiety, cholic acid, a thioether, e.g., hexyl-5-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxy cholesterol moiety. See, e.g., U.S. Pat. Nos. 4,828,979; 4,948,882; 5,218,105; 5,525,465; 5,541,313; 5,545,730; 5,552,538; 5,578,717; 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941.

In some embodiments, single stranded oligonucleotide modification include modification of the 5' or 3' end of the oligonucleotide. In some embodiments, the 3' end of the oligonucleotide comprises a hydroxyl group or a thiophosphate. It should be appreciated that additional molecules (e.g. a biotin moiety or a fluorophor) can be conjugated to the 5' or 3' end of the single stranded oligonucleotide. In some embodiments, the single stranded oligonucleotide comprises a biotin moiety conjugated to the 5' nucleotide.

In some embodiments, the single stranded oligonucleotide comprises locked nucleic acids (LNA), ENA modified nucleotides, 2'-O-methyl nucleotides, or 2'-fluoro-deoxyribonucleotides. In some embodiments, the single stranded oligonucleotide comprises alternating deoxyribonucleotides and 2'-fluoro-deoxyribonucleotides. In some embodiments, the single stranded oligonucleotide comprises alternating deoxyribonucleotides and 2'-O-methyl nucleotides. In some embodiments, the single stranded oligonucleotide comprises alternating deoxyribonucleotides and ENA modified nucleotides. In some embodiments, the single stranded oligonucleotide comprises alternating deoxyribonucleotides and locked nucleic acid nucleotides. In some embodiments, the single stranded oligonucleotide comprises alternating locked nucleic acid nucleotides and 2'-O-methyl nucleotides.

In some embodiments, the 5' nucleotide of the oligonucleotide is a deoxyribonucleotide. In some embodiments, the 5' nucleotide of the oligonucleotide is a locked nucleic acid nucleotide. In some embodiments, the nucleotides of the oligonucleotide comprise deoxyribonucleotides flanked by at least one locked nucleic acid nucleotide on each of the 5' and 3' ends of the deoxyribonucleotides. In some embodiments, the nucleotide at the 3' position of the oligonucleotide has a 3' hydroxyl group or a 3' thiophosphate.

In some embodiments, the single stranded oligonucleotide comprises phosphorothioate internucleotide linkages. In some embodiments, the single stranded oligonucleotide comprises phosphorothioate internucleotide linkages between at least two nucleotides. In some embodiments, the single stranded oligonucleotide comprises phosphorothioate internucleotide linkages between all nucleotides.

It should be appreciated that the single stranded oligonucleotide can have any combination of modifications as described herein.

The oligonucleotide may comprise a nucleotide sequence having one or more of the following modification patterns.

(a) (X)Xxxxxx, (X)xXxxxx, (X)xxXxxx, (X)xxxXxx, (X)xxxxXx and (X)xxxxxX, (b) (X)XXxxxx, (X)XxXxxx, (X)XxxXxx, (X)XxxxXx, (X)XxxxxX, (X)xXXxxx, (x)xXxXxx, (X)xXxxXx, (X)xXxxxX, (X)xxXXxx, (X)xxXxXx, (X)xxXxxX, (X)xxxXXx, (X)xxxXxX and (X)xxxxXX, (c) (X)XXXxxx, (X)xXXXxx, (X)xxXXXx, (X)xxxXXX, (X)XXxXxx, (X)XXxxXx, (x)XXxxxX, (X)xXXxXx, (X)xXXxxX, (X)xxXXxX, (X)XxXXxx, (X)XxxXXx (x)XxxxXX, (X)xXxXXx, (X)xXxxXX, (X)xxXxXX, (X)xXxXxX and (X)XxXxXx, (d) (X)xxXXX, (X)xXxXXX, (X)xXXxXX, (X)xXXXxX, (X)xXXXXx, (X)XxxXXX, (X)XxXxXX, (X)XxXXxX, (X)XxXXXx, (X)XXxxXX, (X)XXxXxX, (X)XXxXXx, (x)XXxXXx, (X)XXXxxX, (X)XXXxXx, and (X)XXXXxx, (e) (X)xXXXXX, (X)XxXXXX, (X)XXxXXX, (X)XXXxXX, (X)XXXXxX and (x)XXXXXx, and (f) XXXXXX, XxXXXXX, XXxXXXX, XXXxXXX, XXXXxXX, XXXXXxX and XXXXXXx, in which "X" denotes a nucleotide analogue, (X) denotes an optional nucleotide analogue, and "x" denotes a DNA or RNA nucleotide unit. Each of the above listed patterns may appear one or more times within an oligonucleotide, alone or in combination with any of the other disclosed modification patterns.

Methods for Modulating Gene Expression

In one aspect, the invention relates to methods for modulating gene expression in a cell (e.g., a cell for which UTRN levels are reduced (e.g., a muscle cell)) for research purposes (e.g., to study the function of the gene in the cell). In another aspect, the invention relates to methods for modulating gene expression in a cell (e.g., a cell for which UTRN levels are reduced) for gene or epigenetic therapy. The cells can be in vitro, ex vivo, or in vivo (e.g., in a subject who has a disease resulting from reduced expression of UTRN, (e.g., a muscular dystrophy, including DMD, BMD, and myotonic dystrophy)). In some embodiments, methods for modulating gene expression in a cell comprise delivering a single stranded oligonucleotide as described herein. In some embodiments, delivery of the single stranded oligonucleotide to the cell results in a level of expression of gene that is at least 5%, 10%, 20%, 30%, 40%, 50%, 60%, 70%, 80%, 90%, 100%, 200% or more greater than a level of expression of gene in a control cell to which the single stranded oligonucleotide has not been delivered. In certain embodiments, delivery of the single stranded oligonucleotide to the cell results in a level of expression of gene that is at least 50% greater than a level of expression of gene in a control cell to which the single stranded oligonucleotide has not been delivered.

In another aspect of the invention, methods comprise administering to a subject (e.g. a human) a composition comprising a single stranded oligonucleotide as described herein to increase protein levels in the subject. In some embodiments, the increase in protein levels is at least 5%, 10%, 20%, 30%, 40%, 50%, 60%, 70%, 80%, 90%, 100%, 200%, or more, higher than the amount of a protein in the subject before administering.

As another example, to increase expression of UTRN in a cell, the methods include introducing into the cell a single stranded oligonucleotide that is sufficiently complementary to a PRC2-associated region (e.g., of a long non-coding RNA) that maps to a genomic position encompassing or in proximity to the UTRN gene.

In another aspect of the invention provides methods of treating a condition (e.g., MD) associated with decreased levels of expression of UTRN in a subject, the method comprising administering a single stranded oligonucleotide as described herein.

A subject can include a non-human mammal, e.g. mouse, rat, guinea pig, rabbit, cat, dog, goat, cow, or horse. In preferred embodiments, a subject is a human. Single stranded oligonucleotides have been employed as therapeutic moieties in the treatment of disease states in animals, including humans. Single stranded oligonucleotides can be useful therapeutic modalities that can be configured to be useful in treatment regimes for the treatment of cells, tissues and animals, especially humans.

For therapeutics, an animal, preferably a human, suspected of having MD is treated by administering single stranded oligonucleotide in accordance with this invention. For example, in one non-limiting embodiment, the methods comprise the step of administering to the animal in need of treatment, a therapeutically effective amount of a single stranded oligonucleotide as described herein.

Formulation, Delivery, And Dosing

The oligonucleotides described herein can be formulated for administration to a subject for treating muscular dystrophies, including DMD, BMD, and myotonic dystrophy. It should be understood that the formulations, compositions and methods can be practiced with any of the oligonucleotides disclosed herein.

The formulations may conveniently be presented in unit dosage form and may be prepared by any methods well known in the art of pharmacy. The amount of active ingredient (e.g., an oligonucleotide or compound of the invention) which can be combined with a carrier material to produce a single dosage form will vary depending upon the host being treated, the particular mode of administration, e.g., intradermal or inhalation. The amount of active ingredient which can be combined with a carrier material to produce a single dosage form will generally be that amount of the compound which produces a therapeutic effect, e.g. tumor regression.

Pharmaceutical formulations of this invention can be prepared according to any method known to the art for the manufacture of pharmaceuticals. Such formulations can contain sweetening agents, flavoring agents, coloring agents and preserving agents. A formulation can be admixtured with nontoxic pharmaceutically acceptable excipients which are suitable for manufacture. Formulations may comprise one or more diluents, emulsifiers, preservatives, buffers, excipients, etc. and may be provided in such forms as liquids, powders, emulsions, lyophilized powders, sprays, creams, lotions, controlled release formulations, tablets, pills, gels, on patches, in implants, etc.

A formulated single stranded oligonucleotide composition can assume a variety of states. In some examples, the composition is at least partially crystalline, uniformly crystalline, and/or anhydrous (e.g., less than 80, 50, 30, 20, or 10% water). In another example, the single stranded oligonucleotide is in an aqueous phase, e.g., in a solution that includes water. The aqueous phase or the crystalline compositions can, e.g., be incorporated into a delivery vehicle, e.g., a liposome (particularly for the aqueous phase) or a particle (e.g., a microparticle as can be appropriate for a crystalline composition). Generally, the single stranded oligonucleotide composition is formulated in a manner that is compatible with the intended method of administration.

In some embodiments, the composition is prepared by at least one of the following methods: spray drying, lyophilization, vacuum drying, evaporation, fluid bed drying, or a combination of these techniques; or sonication with a lipid, freeze-drying, condensation and other self-assembly.

A single stranded oligonucleotide preparation can be formulated or administered (together or separately) in combination with another agent, e.g., another therapeutic agent or an agent that stabilizes a single stranded oligonucleotide, e.g., a protein that complexes with single stranded oligonucleotide. Still other agents include chelators, e.g., EDTA (e.g., to remove divalent cations such as $Mg^{2+}$), salts, RNAse inhibitors (e.g., a broad specificity RNAse inhibitor such as RNAsin) and so forth.

In one embodiment, the single stranded oligonucleotide preparation includes another single stranded oligonucleotide, e.g., a second single stranded oligonucleotide that modulates expression of a second gene or a second single stranded oligonucleotide that modulates expression of the first gene. Still other preparation can include at least 3, 5, ten, twenty, fifty, or a hundred or more different single stranded oligonucleotide species. Such single stranded oligonucleotides can mediated gene expression with respect to a similar number of different genes. In one embodiment, the single stranded oligonucleotide preparation includes at least a second therapeutic agent (e.g., an agent other than an oligonucleotide).

Route of Delivery

A composition that includes a single stranded oligonucleotide can be delivered to a subject by a variety of routes. Exemplary routes include: intravenous, intradermal, topical, rectal, parenteral, anal, intravaginal, intranasal, pulmonary, ocular. The term "therapeutically effective amount" is the amount of oligonucleotide present in the composition that is needed to provide the desired level of UTRN expression in the subject to be treated to give the anticipated physiological response. The term "physiologically effective amount" is that amount delivered to a subject to give the desired palliative or curative effect. The term "pharmaceutically acceptable carrier" means that the carrier can be administered to a subject with no significant adverse toxicological effects to the subject.

The single stranded oligonucleotide molecules of the invention can be incorporated into pharmaceutical compositions suitable for administration. Such compositions typically include one or more species of single stranded oligonucleotide and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

The pharmaceutical compositions of the present invention may be administered in a number of ways depending upon whether local or systemic treatment is desired and upon the area to be treated. Administration may be topical (including ophthalmic, vaginal, rectal, intranasal, transdermal), oral or parenteral. Parenteral administration includes intravenous drip, subcutaneous, intraperitoneal or intramuscular injection, or intrathecal or intraventricular administration.

The route and site of administration may be chosen to enhance targeting. For example, to target muscle cells, intramuscular injection into the muscles of interest would be a logical choice. Lung cells might be targeted by administering the single stranded oligonucleotide in aerosol form. The vascular endothelial cells could be targeted by coating a balloon catheter with the single stranded oligonucleotide and mechanically introducing the oligonucleotide.

Topical administration refers to the delivery to a subject by contacting the formulation directly to a surface of the subject. The most common form of topical delivery is to the skin, but a composition disclosed herein can also be directly applied to other surfaces of the body, e.g., to the eye, a mucous membrane, to surfaces of a body cavity or to an internal surface. As mentioned above, the most common topical delivery is to the skin. The term encompasses several routes of administration including, but not limited to, topical and transdermal. These modes of administration typically include penetration of the skin's permeability barrier and efficient delivery to the target tissue or stratum. Topical administration can be used as a means to penetrate the epidermis and dermis and ultimately achieve systemic delivery of the composition. Topical administration can also be used as a means to selectively deliver oligonucleotides to the epidermis or dermis of a subject, or to specific strata thereof, or to an underlying tissue.

Formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable. Coated condoms, gloves and the like may also be useful.

Transdermal delivery is a valuable route for the administration of lipid soluble therapeutics. The dermis is more permeable than the epidermis and therefore absorption is much more rapid through abraded, burned or denuded skin. Inflammation and other physiologic conditions that increase blood flow to the skin also enhance transdermal adsorption. Absorption via this route may be enhanced by the use of an oily vehicle (inunction) or through the use of one or more penetration enhancers. Other effective ways to deliver a composition disclosed herein via the transdermal route include hydration of the skin and the use of controlled release topical patches. The transdermal route provides a potentially effective means to deliver a composition disclosed herein for systemic and/or local therapy. In addition, iontophoresis (transfer of ionic solutes through biological membranes under the influence of an electric field), phonophoresis or sonophoresis (use of ultrasound to enhance the absorption of various therapeutic agents across biological membranes, notably the skin and the cornea), and optimization of vehicle characteristics relative to dose position and retention at the site of administration may be useful methods for enhancing the transport of topically applied compositions across skin and mucosal sites.

Both the oral and nasal membranes offer advantages over other routes of administration. For example, oligonucleotides administered through these membranes may have a rapid onset of action, provide therapeutic plasma levels, avoid first pass effect of hepatic metabolism, and avoid exposure of the oligonucleotides to the hostile gastrointestinal (GI) environment. Additional advantages include easy access to the membrane sites so that the oligonucleotide can be applied, localized and removed easily.

In oral delivery, compositions can be targeted to a surface of the oral cavity, e.g., to sublingual mucosa which includes the membrane of ventral surface of the tongue and the floor of the mouth or the buccal mucosa which constitutes the lining of the cheek. The sublingual mucosa is relatively permeable thus giving rapid absorption and acceptable bioavailability of many agents. Further, the sublingual mucosa is convenient, acceptable and easily accessible.

A pharmaceutical composition of single stranded oligonucleotide may also be administered to the buccal cavity of a human being by spraying into the cavity, without inhalation, from a metered dose spray dispenser, a mixed micellar pharmaceutical formulation as described above and a propellant. In one embodiment, the dispenser is first shaken prior to spraying the pharmaceutical formulation and propellant into the buccal cavity.

Compositions for oral administration include powders or granules, suspensions or solutions in water, syrups, slurries, emulsions, elixirs or non-aqueous media, tablets, capsules, lozenges, or troches. In the case of tablets, carriers that can be used include lactose, sodium citrate and salts of phosphoric acid. Various disintegrants such as starch, and lubricating agents such as magnesium stearate, sodium lauryl sulfate and talc, are commonly used in tablets. For oral administration in capsule form, useful diluents are lactose and high molecular weight polyethylene glycols. When aqueous suspensions are required for oral use, the nucleic acid compositions can be combined with emulsifying and suspending agents. If desired, certain sweetening and/or flavoring agents can be added.

Parenteral administration includes intravenous drip, subcutaneous, intraperitoneal or intramuscular injection, intrathecal or intraventricular administration. In some embodiments, parental administration involves administration directly to the site of disease (e.g. injection into a tumor).

Formulations for parenteral administration may include sterile aqueous solutions which may also contain buffers, diluents and other suitable additives. Intraventricular injection may be facilitated by an intraventricular catheter, for example, attached to a reservoir. For intravenous use, the total concentration of solutes should be controlled to render the preparation isotonic.

Any of the single stranded oligonucleotides described herein can be administered to ocular tissue. For example, the compositions can be applied to the surface of the eye or nearby tissue, e.g., the inside of the eyelid. For ocular administration, ointments or droppable liquids may be delivered by ocular delivery systems known to the art such as applicators or eye droppers. Such compositions can include mucomimetics such as hyaluronic acid, chondroitin sulfate, hydroxypropyl methylcellulose or poly(vinyl alcohol), preservatives such as sorbic acid, EDTA or benzylchronium chloride, and the usual quantities of diluents and/or carriers. The single stranded oligonucleotide can also be administered to the interior of the eye, and can be introduced by a needle or other delivery device which can introduce it to a selected area or structure.

Pulmonary delivery compositions can be delivered by inhalation by the patient of a dispersion so that the composition, preferably single stranded oligonucleotides, within the dispersion can reach the lung where it can be readily absorbed through the alveolar region directly into blood circulation. Pulmonary delivery can be effective both for systemic delivery and for localized delivery to treat diseases of the lungs.

Pulmonary delivery can be achieved by different approaches, including the use of nebulized, aerosolized, micellular and dry powder-based formulations. Delivery can be achieved with liquid nebulizers, aerosol-based inhalers, and dry powder dispersion devices. Metered-dose devices are preferred. One of the benefits of using an atomizer or inhaler is that the potential for contamination is minimized because the devices are self-contained. Dry powder dispersion devices, for example, deliver agents that may be readily formulated as dry powders. A single stranded oligonucleotide composition may be stably stored as lyophilized or spray-dried powders by itself or in combination with suitable powder carriers. The delivery of a composition for inhalation can be mediated by a dosing timing element which can include a timer, a dose counter, time measuring device, or a time indicator which when incorporated into the device enables dose tracking, compliance monitoring, and/or dose triggering to a patient during administration of the aerosol medicament.

The term "powder" means a composition that consists of finely dispersed solid particles that are free flowing and capable of being readily dispersed in an inhalation device and subsequently inhaled by a subject so that the particles reach the lungs to permit penetration into the alveoli. Thus, the powder is said to be "respirable." Preferably the average particle size is less than about 10 µm in diameter preferably with a relatively uniform spheroidal shape distribution. More preferably the diameter is less than about 7.5 µm and most preferably less than about 5.0 µm. Usually the particle size distribution is between about 0.1 µm and about 5 µm in diameter, particularly about 0.3 µm to about 5 µm.

The term "dry" means that the composition has a moisture content below about 10% by weight (% w) water, usually below about 5% w and preferably less it than about 3% w. A dry composition can be such that the particles are readily dispersible in an inhalation device to form an aerosol.

The types of pharmaceutical excipients that are useful as carrier include stabilizers such as human serum albumin (HSA), bulking agents such as carbohydrates, amino acids and polypeptides; pH adjusters or buffers; salts such as sodium chloride; and the like. These carriers may be in a crystalline or amorphous form or may be a mixture of the two.

Suitable pH adjusters or buffers include organic salts prepared from organic acids and bases, such as sodium citrate, sodium ascorbate, and the like; sodium citrate is preferred. Pulmonary administration of a micellar single stranded oligonucleotide formulation may be achieved through metered dose spray devices with propellants such as tetrafluoroethane, heptafluoroethane, dimethylfluoropropane, tetrafluoropropane, butane, isobutane, dimethyl ether and other non-CFC and CFC propellants.

Exemplary devices include devices which are introduced into the vasculature, e.g., devices inserted into the lumen of a vascular tissue, or which devices themselves form a part of the vasculature, including stents, catheters, heart valves, and other vascular devices. These devices, e.g., catheters or stents, can be placed in the vasculature of the lung, heart, or leg.

Other devices include non-vascular devices, e.g., devices implanted in the peritoneum, or in organ or glandular tissue, e.g., artificial organs. The device can release a therapeutic substance in addition to a single stranded oligonucleotide, e.g., a device can release insulin.

In one embodiment, unit doses or measured doses of a composition that includes single stranded oligonucleotide are dispensed by an implanted device. The device can include a sensor that monitors a parameter within a subject. For example, the device can include pump, e.g., and, optionally, associated electronics.

Tissue, e.g., cells or organs can be treated with a single stranded oligonucleotide, ex vivo and then administered or implanted in a subject. The tissue can be autologous, allogeneic, or xenogeneic tissue. E.g., tissue can be treated to reduce graft v. host disease. In other embodiments, the tissue is allogeneic and the tissue is treated to treat a disorder characterized by unwanted gene expression in that tissue. E.g., tissue, e.g., hematopoietic cells, e.g., bone marrow hematopoietic cells, can be treated to inhibit unwanted cell proliferation. Introduction of treated tissue, whether autologous or transplant, can be combined with other therapies. In some implementations, the single stranded oligonucleotide treated cells are insulated from other cells, e.g., by a semipermeable porous barrier that prevents the cells from leaving the implant, but enables molecules from the body to reach the cells and molecules produced by the cells to enter the body. In one embodiment, the porous barrier is formed from alginate.

In one embodiment, a contraceptive device is coated with or contains a single stranded oligonucleotide. Exemplary devices include condoms, diaphragms, IUD (implantable uterine devices, sponges, vaginal sheaths, and birth control devices.

Dosage

In one aspect, the invention features a method of administering a single stranded oligonucleotide (e.g., as a compound or as a component of a composition) to a subject (e.g., a human subject). In one embodiment, the unit dose is between about 10 mg and 25 mg per kg of bodyweight. In one embodiment, the unit dose is between about 1 mg and 100 mg per kg of bodyweight. In one embodiment, the unit dose is between about 0.1 mg and 500 mg per kg of bodyweight. In some embodiments, the unit dose is more than 0.001, 0.005, 0.01, 0.05, 0.1, 0.5, 1, 2, 5, 10, 25, 50 or 100 mg per kg of bodyweight.

The defined amount can be an amount effective to treat or prevent a disease or disorder, e.g., a disease or disorder associated with the UTRN. The unit dose, for example, can be administered by injection (e.g., intravenous or intramuscular), an inhaled dose, or a topical application.

In some embodiments, the unit dose is administered daily. In some embodiments, less frequently than once a day, e.g., less than every 2, 4, 8 or 30 days. In another embodiment, the unit dose is not administered with a frequency (e.g., not a regular frequency). For example, the unit dose may be administered a single time. In some embodiments, the unit dose is administered more than once a day, e.g., once an hour, two hours, four hours, eight hours, twelve hours, etc.

In one embodiment, a subject is administered an initial dose and one or more maintenance doses of a single stranded oligonucleotide. The maintenance dose or doses are generally lower than the initial dose, e.g., one-half less of the initial dose. A maintenance regimen can include treating the subject with a dose or doses ranging from 0.0001 to 100 mg/kg of body weight per day, e.g., 100, 10, 1, 0.1, 0.01, 0.001, or 0.0001 mg per kg of bodyweight per day. The maintenance doses may be administered no more than once every 1, 5, 10, or 30 days. Further, the treatment regimen may last for a period of time which will vary depending upon the nature of the particular disease, its severity and the overall condition of the patient. In some embodiments the dosage may be delivered no more than once per day, e.g., no more than once per 24, 36, 48, or more hours, e.g., no more than once for every 5 or 8 days. Following treatment, the patient can be monitored for changes in his condition and for alleviation of the symptoms of the disease state. The dosage of the oligonucleotide may either be increased in the event the patient does not respond significantly to current dosage levels, or the dose may be decreased if an alleviation of the symptoms of the disease state is observed, if the disease state has been ablated, or if undesired side-effects are observed.

The effective dose can be administered in a single dose or in two or more doses, as desired or considered appropriate under the specific circumstances. If desired to facilitate repeated or frequent infusions, implantation of a delivery device, e.g., a pump, semi-permanent stent (e.g., intravenous, intraperitoneal, intracisternal or intracapsular), or reservoir may be advisable.

In some embodiments, the oligonucleotide pharmaceutical composition includes a plurality of single stranded oligonucleotide species. In another embodiment, the single stranded oligonucleotide species has sequences that are non-overlapping and non-adjacent to another species with respect to a naturally occurring target sequence (e.g., a PRC2-associated region). In another embodiment, the plurality of single stranded oligonucleotide species is specific for different PRC2-associated regions. In another embodiment, the single stranded oligonucleotide is allele specific.

In some cases, a patient is treated with a single stranded oligonucleotide in conjunction with other therapeutic modalities.

Following successful treatment, it may be desirable to have the patient undergo maintenance therapy to prevent the recurrence of the disease state, wherein the compound of the invention is administered in maintenance doses, ranging from 0.0001 mg to 100 mg per kg of body weight.

The concentration of the single stranded oligonucleotide composition is an amount sufficient to be effective in treating or preventing a disorder or to regulate a physiological condition in humans. The concentration or amount of single stranded oligonucleotide administered will depend on the parameters determined for the agent and the method of administration, e.g. nasal, buccal, pulmonary. For example, nasal formulations may tend to require much lower concentrations of some ingredients in order to avoid irritation or burning of the nasal passages. It is sometimes desirable to dilute an oral formulation up to 10-100 times in order to provide a suitable nasal formulation.

Certain factors may influence the dosage required to effectively treat a subject, including but not limited to the severity of the disease or disorder, previous treatments, the general health and/or age of the subject, and other diseases present. Moreover, treatment of a subject with a therapeutically effective amount of a single stranded oligonucleotide can include a single treatment or, preferably, can include a series of treatments. It will also be appreciated that the effective dosage of a single stranded oligonucleotide used for treatment may increase or decrease over the course of a particular treatment. For example, the subject can be monitored after administering a single stranded oligonucleotide composition. Based on information from the monitoring, an additional amount of the single stranded oligonucleotide composition can be administered.

Dosing is dependent on severity and responsiveness of the disease condition to be treated, with the course of treatment lasting from several days to several months, or until a cure is effected or a diminution of disease state is achieved. Optimal dosing schedules can be calculated from measurements of UTRN expression levels in the body of the patient. Persons of ordinary skill can easily determine optimum dosages, dosing methodologies and repetition rates. Optimum dosages may vary depending on the relative potency of individual compounds, and can generally be estimated based on EC50s found to be effective in in vitro and in vivo animal models. In some embodiments, the animal models include transgenic animals that express a human UTRN. In another embodiment, the composition for testing includes a single stranded oligonucleotide that is complementary, at least in an internal region, to a sequence that is conserved between UTRN in the animal model and the UTRN in a human.

In one embodiment, the administration of the single stranded oligonucleotide composition is parenteral, e.g. intravenous (e.g., as a bolus or as a diffusible infusion), intradermal, intraperitoneal, intramuscular, intrathecal, intraventricular, intracranial, subcutaneous, transmucosal, buccal, sublingual, endoscopic, rectal, oral, vaginal, topical, pulmonary, intranasal, urethral or ocular. Administration can be provided by the subject or by another person, e.g., a health care provider. The composition can be provided in measured doses or in a dispenser which delivers a metered dose. Selected modes of delivery are discussed in more detail below.

Kits

In certain aspects of the invention, kits are provided, comprising a container housing a composition comprising a single stranded oligonucleotide. In some embodiments, the composition is a pharmaceutical composition comprising a single stranded oligonucleotide and a pharmaceutically acceptable carrier. In some embodiments, the individual components of the pharmaceutical composition may be provided in one container. Alternatively, it may be desirable to provide the components of the pharmaceutical composition separately in two or more containers, e.g., one container for single stranded oligonucleotides, and at least another for a carrier compound. The kit may be packaged in a number of different configurations such as one or more containers in a single box. The different components can be combined, e.g., according to instructions provided with the kit. The components can be combined according to a method described herein, e.g., to prepare and administer a pharmaceutical composition. The kit can also include a delivery device.

The present invention is further illustrated by the following Examples, which in no way should be construed as further limiting. The entire contents of all of the references (including literature references, issued patents, published patent applications, and co-pending patent applications) cited throughout this application are hereby expressly incorporated by reference.

EXAMPLES

The invention is further described in the following examples, which do not limit the scope of the invention described in the claims.

Materials and Methods:

Real Time PCR

RNA was harvested from the cells using Promega SV 96 Total RNA Isolation system or Trizol omitting the DNAse step. In separate pilot experiments, 50 ng of RNA was determined to be sufficient template for the reverse transcriptase reaction. RNA harvested from cells was normalized so that 50 ng of RNA was input to each reverse transcription reaction. For the few samples that were too dilute to reach this limit, the maximum input volume was added. Reverse transcriptase reaction was performed using the Superscript II kit and real time PCR performed on cDNA samples using icycler SYBR green chemistry (Biorad). A baseline level of mRNA expression for UTRN was determined through quantitative PCR as outlined above. Baseline levels were also determined for mRNA of various housekeeping genes which are constitutively expressed. A "control" housekeeping gene with approximately the same level of baseline expression as the target gene was chosen for comparison purposes.

Cell Culture

Human hepatocyte Hep3B, human hepatocyte HepG2 cells, mouse hepatoma Hepa1-6 cells, and human renal proximal tubule epithelial cells (RPTEC) were cultured using conditions known in the art (see, e.g. Current Protocols in Cell Biology). Details of the cell lines used in the experiments described herein are provided in Table 5.

TABLE 5

Cell lines

| Cell Line | Source | Species | Gender | Type | Tissue | Status | Culture Conditions |
|---|---|---|---|---|---|---|---|
| RD RMS | ATCC | human | F | rhabdomyosarcoma | skeletal muscle | immortalized | DMEM + 10% FBS |
| HSKM | Gibco | human | M | muscle | skeletal muscle | normal | DMEM + 10% FBS |
| SK-N-AS | ATCC | human | F | neuroblast | brain | immortalized | MEM + 10% FBS |
| am002fDMD | DVBiologics | human | M | muscle | skeletal muscle | normal | M-gro + supplement |

Oligonucleotide Design

Oligonucleotides were designed within PRC2-interacting regions in order to upregulate UTRN. The sequence and structure of each oligonucleotide is shown in Table 2. The following table provides a description of the nucleotide analogs, modifications and intranucleotide linkages used for certain oligonucleotides tested and described in Table 2.

TABLE 3

Oligonucleotide Modifications

| Symbol | Feature Description |
|---|---|
| bio | 5' biotin |
| dAs | DNA w/3' thiophosphate |
| dCs | DNA w/3' thiophosphate |
| dGs | DNA w/3' thiophosphate |
| dTs | DNA w/3' thiophosphate |
| dG | DNA w/3' phosphate |
| dU | deoxyuridine w/3' phosphate |
| enaAs | ENA w/3' thiophosphate |
| enaCs | ENA w/3' thiophosphate |
| enaGs | ENA w/3' thiophosphate |
| enaTs | ENA w/3' thiophosphate |
| fluAs | 2'-fluoro w/3' thiophosphate |
| fluCs | 2'-fluoro w/3' thiophosphate |
| fluGs | 2'-fluoro w/3' thiophosphate |
| fluUs | 2'-fluoro w/3' thiophosphate |
| lnaAs | LNA w/3' thiophosphate |
| lnaCs | LNA w/3' thiophosphate |
| lnaGs | LNA w/3' thiophosphate |
| lnaTs | LNA w/3' thiophosphate |
| omeAs | 2'-OMe w/3' thiophosphate |
| omeCs | 2'-OMe w/3' thiophosphate |
| omeGs | 2'-OMe w/3' thiophosphate |
| omeTs | 2'-OMe w/3' thiophosphate |
| lnaAs-Sup | LNA w/3' thiophosphate at 3' terminus |
| lnaCs-Sup | LNA w/3' thiophosphate at 3' terminus |
| lnaGs-Sup | LNA w/3' thiophosphate at 3' terminus |
| lnaTs-Sup | LNA w/3' thiophosphate at 3' terminus |
| lnaA-Sup | LNA w/3' OH at 3' terminus |
| lnaC-Sup | LNA w/3' OH at 3' terminus |
| lnaG-Sup | LNA w/3' OH at 3' terminus |
| lnaT-Sup | LNA w/3' OH at 3' terminus |
| omeA-Sup | 2'-OMe w/3' OH at 3' terminus |
| omeC-Sup | 2'-OMe w/3' OH at 3' terminus |
| omeG-Sup | 2'-OMe w/3' OH at 3' terminus |
| omeU-Sup | 2'-OMe w/3' OH at 3' terminus |
| dAs-Sup | DNA w/3' thiophosphate at 3' terminus |
| dCs-Sup | DNA w/3' thiophosphate at 3' terminus |

TABLE 3-continued

Oligonucleotide Modifications

| Symbol | Feature Description |
|---|---|
| dGs-Sup | DNA w/3' thiophosphate at 3' terminus |
| dTs-Sup | DNA w/3' thiophosphate at 3' terminus |
| dA-Sup | DNA w/3' OH at 3' terminus |
| dC-Sup | DNA w/3' OH at 3' terminus |
| dG-Sup | DNA w/3' OH at 3' terminus |

In Vitro Transfection of Cells with Oligonucleotides

Cells were seeded into each well of 24-well plates at a density of 25,000 cells per 500 uL and transfections were performed with Lipofectamine and the single stranded oligonucleotides. Control wells contained Lipofectamine alone. At 48 hours post-transfection, approximately 200 uL of cell culture supernatants were stored at −80 C for ELISA. At 48 hours post-transfection, RNA was harvested from the cells and quantitative PCR was carried out as outlined above. The percent induction of target mRNA expression by each oligonucleotide was determined by normalizing mRNA levels in the presence of the oligonucleotide to the mRNA levels in the presence of control (Lipofectamine alone). This was compared side-by-side with the increase in mRNA expression of the "control" housekeeping gene.

Results:

In Vitro Delivery of Single Stranded Oligonucleotides Upregulated UTRN Expression Oligonucleotides were designed as candidates for upregulating UTRN expression. A total of 65 single stranded oligonucleotides were designed to be complementary to a PRC2-interacting region within a sequence as set forth in SEQ ID NO: 1 or 2. Each of the oligonucleotides was tested in at least duplicate. The sequence and structural features of the oligonucleotides are set forth in Table 2. Briefly, cells were transfected in vitro with each of the oligonucleotides as described above. UTRN expression in cells following treatment was evaluated by qRT-PCR. Oligonucleotides that upregulated UTRN expression were identified. Further details are outlined in Table 2.

Tables

TABLE 1

Hexamers that are not seed sequences of human miRNAs

AAAAAA, AAAAAG, AAAACA, AAAAGA, AAAAGC, AAAAGG, AAAAUA, AAACAA, AAACAC, AAACAG,

AAACAU, AAACCC, AAACCU, AAACGA, AAACGC, AAACGU, AAACUA, AAACUC, AAACUU, AAAGAU,

AAAGCC, AAAGGA, AAAGGG, AAAGUC, AAAUAC, AAAUAU, AAAUCG, AAAUCU, AAAUGC, AAAUGU,

AAAUUA, AAAUUG, AACAAC, AACAAG, AACAAU, AACACA, AACACG, AACAGA, AACAGC, AACAGG,

AACAUC, AACAUG, AACCAA, AACCAC, AACCAG, AACCAU, AACCCC, AACCCG, AACCGA, AACCGC,

AACCGG, AACCUA, AACCUU, AACGAA, AACGAC, AACGAG, AACGAU, AACGCU, AACGGG, AACGGU,

AACGUA, AACGUC, AACGUG, AACGUU, AACUAU, AACUCA, AACUCC, AACUCG, AACUGA, AACUGC,

AACUGU, AACUUA, AACUUC, AACUUG, AACUUU, AAGAAA, AAGAAG, AAGAAU, AAGACG, AAGAGA,

AAGAGC, AAGAGG, AAGAGU, AAGAUU, AAGCAA, AAGCAC, AAGCAG, AAGCAU, AAGCCA, AAGCCC,

AAGCCG, AAGCCU, AAGCGA, AAGCGG, AAGCGU, AAGCUA, AAGGAA, AAGGAC, AAGGCU, AAGGGC,

AAGGGU, AAGGUU, AAGUAA, AAGUAC, AAGUAU, AAGUCC, AAGUCG, AAGUGA, AAGUGG, AAGUUA,

AAGUUU, AAUAAA, AAUAAC, AAUAAG, AAUAAU, AAUACA, AAUACC, AAUACG, AAUAGA, AAUAGC,

AAUAGG, AAUAGU, AAUAUC, AAUAUU, AAUCAA, AAUCAU, AAUCCA, AAUCCC, AAUCCG, AAUCGA,

AAUCGC, AAUCGU, AAUCUA, AAUCUG, AAUCUU, AAUGAA, AAUGAC, AAUGAG, AAUGAU, AAUGCG,

AAUGCU, AAUGGA, AAUGGU, AAUGUA, AAUGUC, AAUGUG, AAUUAA, AAUUAC, AAUUAG, AAUUCC,

AAUUCG, AAUUGA, AAUUGG, AAUUGU, AAUUUC, AAUUUG, ACAAAA, ACAAAC, ACAAAG, ACAAAU,

ACAACC, ACAACG, ACAACU, ACAAGA, ACAAGC, ACAAGU, ACAAUC, ACAAUG, ACAAUU, ACACAG,

ACACCA, ACACCC, ACACCG, ACACCU, ACACGA, ACACGC, ACACGU, ACACUC, ACACUG, ACACUU,

ACAGAA, ACAGAC, ACAGCC, ACAGCG, ACAGCU, ACAGGG, ACAGUC, ACAGUG, ACAGUU, ACAUAA,

ACAUAC, ACAUCC, ACAUCG, ACAUCU, ACAUGA, ACAUGC, ACAUGU, ACAUUG, ACAUUU, ACCAAA,

ACCAAC, ACCAAG, ACCAAU, ACCACC, ACCACG, ACCAGA, ACCAGU, ACCAUA, ACCAUG, ACCAUU,

ACCCAA, ACCCAC, ACCCCA, ACCCCG, ACCCGA, ACCCGC, ACCCUA, ACCCUC, ACCCUU, ACCGAA,

ACCGAC, ACCGAU, ACCGCA, ACCGCC, ACCGCG, ACCGCU, ACCGGA, ACCGGC, ACCGGU, ACCGUA,

ACCGUC, ACCGUG, ACCGUU, ACCUAA, ACCUAC, ACCUAG, ACCUAU, ACCUCA, ACCUCC, ACCUCG,

ACCUCU, ACCUGA, ACCUGC, ACCUGU, ACCUUA, ACCUUC, ACCUUU, ACGAAA, ACGAAC, ACGAAG,

TABLE 1-continued

Hexamers that are not seed sequences of human miRNAs

ACGAAU, ACGACA, ACGACC, ACGACG, ACGACU, ACGAGA, ACGAGC, ACGAGG, ACGAGU, ACGAUA,
ACGAUC, ACGAUG, ACGAUU, ACGCAA, ACGCAG, ACGCAU, ACGCCC, ACGCCG, ACGCCU, ACGCGA,
ACGCGG, ACGCGU, ACGCUA, ACGCUG, ACGCUU, ACGGAA, ACGGAC, ACGGAG, ACGGAU, ACGGCC,
ACGGCG, ACGGCU, ACGGGC, ACGGGG, ACGGGU, ACGGUA, ACGGUC, ACGGUG, ACGGUU, ACGUAA,
ACGUAC, ACGUAU, ACGUCC, ACGUCG, ACGUCU, ACGUGA, ACGUGC, ACGUGG, ACGUGU, ACGUUA,
ACGUUC, ACGUUG, ACGUUU, ACUAAA, ACUAAG, ACUAAU, ACUACA, ACUACC, ACUACG, ACUACU,
ACUAGG, ACUAUC, ACUAUG, ACUAUU, ACUCAU, ACUCCC, ACUCCG, ACUCCU, ACUCGA, ACUCGC,
ACUCGG, ACUCUC, ACUCUU, ACUGAG, ACUGAU, ACUGCC, ACUGCG, ACUGCU, ACUGGG, ACUGGU,
ACUGUC, ACUUAA, ACUUAC, ACUUAU, ACUUCA, ACUUCC, ACUUCG, ACUUCU, ACUUGA, ACUUGC,
ACUUGU, ACUUUA, ACUUUC, ACUUUG, AGAAAA, AGAAAC, AGAAAG, AGAACC, AGAACG, AGAACU,
AGAAGC, AGAAGU, AGAAUA, AGAAUC, AGAAUG, AGAAUU, AGACAA, AGACAC, AGACAU, AGACCA,
AGACCC, AGACCG, AGACCU, AGACGA, AGACGC, AGACGU, AGACUA, AGACUC, AGACUU, AGAGAC,
AGAGAG, AGAGAU, AGAGCC, AGAGCG, AGAGCU, AGAGGC, AGAGGG, AGAGGU, AGAGUA, AGAGUU,
AGAUAC, AGAUAG, AGAUAU, AGAUCC, AGAUCG, AGAUCU, AGAUGA, AGAUGC, AGAUGG, AGAUUA,
AGAUUC, AGAUUG, AGAUUU, AGCAAC, AGCACA, AGCACG, AGCACU, AGCAGA, AGCAUA, AGCAUC,
AGCAUG, AGCCAA, AGCCAU, AGCCCA, AGCCGA, AGCCGC, AGCCGG, AGCCGU, AGCCUA, AGCCUC,
AGCGAA, AGCGAG, AGCGAU, AGCGCA, AGCGCC, AGCGCG, AGCGCU, AGCGGA, AGCGGC, AGCGGU,
AGCGUA, AGCGUC, AGCGUG, AGCGUU, AGCUAA, AGCUAC, AGCUAG, AGCUAU, AGCUCA, AGCUCC,
AGCUCG, AGCUCU, AGCUGA, AGCUGG, AGCUGU, AGCUUC, AGCUUU, AGGAAU, AGGACC, AGGACG,
AGGAGA, AGGAGU, AGGAUA, AGGCAA, AGGCAU, AGGCCG, AGGCGA, AGGCGC, AGGCGG, AGGCUA,
AGGCUC, AGGCUU, AGGGAC, AGGGAU, AGGGGA, AGGGGU, AGGGUA, AGGGUG, AGGUAA,
AGGUAC, AGGUCA, AGGUCC, AGGUCU, AGGUGA, AGGUGC, AGGUGG, AGGUGU, AGGUUC,
AGGUUG, AGUAAA, AGUAAG, AGUAAU, AGUACA, AGUACG, AGUAGC, AGUAGG, AGUAUA, AGUAUC,
AGUAUG, AGUAUU, AGUCAA, AGUCAC, AGUCAG, AGUCAU, AGUCCA, AGUCCG, AGUCCU, AGUCGA,
AGUCGC, AGUCGG, AGUCGU, AGUCUA, AGUCUC, AGUCUG, AGUCUU, AGUGAA, AGUGAC, AGUGCG,
AGUGGG, AGUGUC, AGUUAA, AGUUAC, AGUUAG, AGUUCC, AGUUCG, AGUUGA, AGUUGC,
AGUUGU, AGUUUA, AGUUUC, AGUUUG, AGUUUU, AUAAAC, AUAAAU, AUAACA, AUAACC, AUAACG,
AUAACU, AUAAGA, AUAAGC, AUAAGG, AUAAGU, AUAAUC, AUAAUG, AUAAUU, AUACAC, AUACAG,
AUACAU, AUACCA, AUACCC, AUACCG, AUACGA, AUACGC, AUACGG, AUACGU, AUACUA, AUACUC,
AUACUG, AUACUU, AUAGAA, AUAGAC, AUAGAU, AUAGCA, AUAGCG, AUAGCU, AUAGGA, AUAGGU,
AUAGUA, AUAGUC, AUAGUG, AUAGUU, AUAUAC, AUAUAG, AUAUCC, AUAUCG, AUAUCU, AUAUGA,
AUAUGC, AUAUGG, AUAUGU, AUAUUC, AUAUUG, AUAUUU, AUCAAA, AUCAAC, AUCAAG, AUCAAU,
AUCACA, AUCACC, AUCACG, AUCAGC, AUCAGG, AUCCAA, AUCCAU, AUCCCC, AUCCCG, AUCCGA,
AUCCGC, AUCCGG, AUCCUA, AUCCUC, AUCCUG, AUCGAA, AUCGAC, AUCGAG, AUCGAU, AUCGCA,
AUCGCC, AUCGCG, AUCGCU, AUCGGC, AUCGGG, AUCGGU, AUCGUC, AUCGUG, AUCGUU, AUCUAA,
AUCUAC, AUCUAG, AUCUAU, AUCUCC, AUCUCG, AUCUGU, AUCUUG, AUCUUU, AUGAAA, AUGAAC,
AUGAAG, AUGAAU, AUGACC, AUGACU, AUGAGG, AUGAGU, AUGAUA, AUGAUC, AUGAUU, AUGCAA,
AUGCAG, AUGCCA, AUGCCC, AUGCCG, AUGCGA, AUGCGG, AUGCGU, AUGCUC, AUGCUU, AUGGAC,
AUGGCC, AUGGGA, AUGGGC, AUGGGU, AUGGUC, AUGGUG, AUGUAC, AUGUAU, AUGUCA,

TABLE 1-continued

Hexamers that are not seed sequences of human miRNAs

AUGUCC, AUGUCG, AUGUGU, AUGUUA, AUGUUC, AUUAAA, AUUAAC, AUUAAG, AUUAAU, AUUACA,
AUUACC, AUUACG, AUUACU, AUUAGA, AUUAGC, AUUAGG, AUUAGU, AUUAUA, AUUAUC, AUUAUG,
AUUCAC, AUUCCA, AUUCCG, AUUCCU, AUUCGA, AUUCGC, AUUCGG, AUUCGU, AUUCUA, AUUCUC,
AUUCUU, AUUGAA, AUUGAC, AUUGAU, AUUGCC, AUUGCG, AUUGCU, AUUGGA, AUUGGC,
AUUGGG, AUUGGU, AUUGUA, AUUGUC, AUUGUG, AUUGUU, AUUUAA, AUUUAG, AUUUAU,
AUUUCC, AUUUCG, AUUUCU, AUUUGA, AUUUGC, AUUUGU, AUUUUA, AUUUUC, AUUUUG,
AUUUUU, CAAAAG, CAAACA, CAAACC, CAAACG, CAAACU, CAAAGA, CAAAGG, CAAAUA, CAAAUU,
CAACAC, CAACAU, CAACCA, CAACCC, CAACCG, CAACGA, CAACGC, CAACGG, CAACGU, CAACUA,
CAACUC, CAACUG, CAACUU, CAAGAA, CAAGAC, CAAGAU, CAAGCA, CAAGCC, CAAGCG, CAAGCU,
CAAGGA, CAAGGG, CAAGUC, CAAGUG, CAAGUU, CAAUAA, CAAUAC, CAAUAG, CAAUCC, CAAUCG,
CAAUCU, CAAUGA, CAAUGC, CAAUGG, CAAUGU, CAAUUC, CAAUUG, CAAUUU, CACAAU, CACACA,
CACACG, CACACU, CACAGA, CACAGC, CACAGG, CACAUA, CACAUC, CACAUU, CACCAA, CACCAC,
CACCAU, CACCCA, CACCCC, CACCCG, CACCGA, CACCGC, CACCGG, CACCGU, CACCUA, CACCUU,
CACGAA, CACGAC, CACGAG, CACGAU, CACGCA, CACGCC, CACGCU, CACGGA, CACGGC, CACGGG,
CACGGU, CACGUA, CACGUC, CACGUG, CACGUU, CACUAA, CACUAG, CACUAU, CACUCA, CACUCG,
CACUGA, CACUGC, CACUGG, CACUUA, CACUUC, CACUUU, CAGAAA, CAGAAG, CAGAAU, CAGACC,
CAGACG, CAGAGC, CAGAUA, CAGAUC, CAGCCG, CAGCCU, CAGCGA, CAGCGC, CAGCGG, CAGCGU,
CAGCUC, CAGCUU, CAGGAU, CAGGGG, CAGGGU, CAGGUA, CAGGUC, CAGGUU, CAGUAC, CAGUCG,
CAGUUG, CAUAAA, CAUAAC, CAUAAG, CAUAAU, CAUACA, CAUACC, CAUACG, CAUACU, CAUAGA,
CAUAGG, CAUAGU, CAUAUA, CAUAUC, CAUAUG, CAUCAA, CAUCAC, CAUCAG, CAUCAU, CAUCCA,
CAUCCC, CAUCCG, CAUCGA, CAUCGC, CAUCGG, CAUCGU, CAUCUA, CAUCUC, CAUCUG, CAUCUU,
CAUGAA, CAUGAC, CAUGAG, CAUGAU, CAUGCA, CAUGCC, CAUGCG, CAUGCU, CAUGGC, CAUGGG,
CAUGGU, CAUGUA, CAUGUC, CAUGUU, CAUUAA, CAUUAC, CAUUAG, CAUUCA, CAUUCC, CAUUCG,
CAUUCU, CAUUGA, CAUUGG, CAUUUC, CAUUUG, CAUUUU, CCAAAA, CCAAAC, CCAAAG, CCAAAU,
CCAACA, CCAACC, CCAACG, CCAACU, CCAAGA, CCAAGC, CCAAGG, CCAAUC, CCAAUG, CCAAUU,
CCACAA, CCACAC, CCACAG, CCACAU, CCACCA, CCACCC, CCACCG, CCACCU, CCACGA, CCACGC,
CCACGG, CCACGU, CCACUA, CCACUC, CCACUU, CCAGAA, CCAGAC, CCAGAG, CCAGCC, CCAGGU,
CCAGUC, CCAGUU, CCAUAA, CCAUAC, CCAUAG, CCAUAU, CCAUCA, CCAUCC, CCAUCU, CCAUGA,
CCAUGC, CCAUGG, CCAUUC, CCAUUG, CCAUUU, CCCAAC, CCCAAG, CCCAAU, CCCACA, CCCAGA,
CCCAGC, CCCAGU, CCCAUA, CCCAUC, CCCAUG, CCCAUU, CCCCAA, CCCCAG, CCCCAU, CCCCCC,
CCCCCG, CCCCCU, CCCCGA, CCCCGC, CCCCGU, CCCCUA, CCCCUC, CCCGAA, CCCGAC, CCCGAU,
CCCGCA, CCCGCU, CCCGGA, CCCGGC, CCCGUA, CCCGUG, CCCGUU, CCCUAA, CCCUAG, CCCUCA,
CCCUCU, CCCUGC, CCCUUA, CCCUUC, CCCUUU, CCGAAA, CCGAAC, CCGAAU, CCGACA, CCGACC,
CCGACG, CCGACU, CCGAGA, CCGAGG, CCGAGU, CCGAUA, CCGAUC, CCGAUG, CCGAUU, CCGCAA,
CCGCAC, CCGCAG, CCGCAU, CCGCCA, CCGCCC, CCGCCG, CCGCCU, CCGCGA, CCGCGC, CCGCGG,
CCGCGU, CCGCUA, CCGCUC, CCGCUG, CCGCUU, CCGGAA, CCGGAU, CCGGCA, CCGGCC, CCGGCG,
CCGGCU, CCGGGA, CCGGGC, CCGGGG, CCGGGU, CCGGUA, CCGGUC, CCGGUG, CCGUAA, CCGUAG,
CCGUAU, CCGUCA, CCGUCC, CCGUCG, CCGUGA, CCGUGU, CCGUUA, CCGUUC, CCGUUG, CCGUUU,
CCUAAC, CCUAAG, CCUAAU, CCUACA, CCUACC, CCUACG, CCUACU, CCUAGA, CCUAGC, CCUAGG,

TABLE 1-continued

Hexamers that are not seed sequences of human miRNAs

CCUAGU, CCUAUA, CCUAUC, CCUAUG, CCUAUU, CCUCAA, CCUCAC, CCUCAG, CCUCAU, CCUCCA,
CCUCCC, CCUCCG, CCUCGA, CCUCGC, CCUCGG, CCUCGU, CCUCUA, CCUCUG, CCUGAC, CCUGAU,
CCUGCA, CCUGGG, CCUGGU, CCUGUU, CCUUAA, CCUUAC, CCUUAG, CCUUAU, CCUUCG, CCUUGA,
CCUUGU, CCUUUA, CCUUUC, CCUUUU, CGAAAA, CGAAAC, CGAAAG, CGAAAU, CGAACA, CGAACC,
CGAACG, CGAACU, CGAAGA, CGAAGC, CGAAGG, CGAAGU, CGAAUA, CGAAUC, CGAAUG, CGAAUU,
CGACAA, CGACAC, CGACAU, CGACCA, CGACCU, CGACGA, CGACGC, CGACGG, CGACGU, CGACUA,
CGACUG, CGACUU, CGAGAA, CGAGAC, CGAGAG, CGAGAU, CGAGCA, CGAGCC, CGAGCG, CGAGCU,
CGAGGC, CGAGGG, CGAGGU, CGAGUA, CGAGUC, CGAGUG, CGAGUU, CGAUAA, CGAUAC, CGAUAG,
CGAUAU, CGAUCA, CGAUCC, CGAUCG, CGAUCU, CGAUGA, CGAUGC, CGAUGG, CGAUGU, CGAUUA,
CGAUUC, CGAUUG, CGAUUU, CGCAAA, CGCAAC, CGCAAG, CGCAAU, CGCACA, CGCACC, CGCACG,
CGCAGA, CGCAGC, CGCAGG, CGCAGU, CGCAUA, CGCAUC, CGCAUG, CGCAUU, CGCCAA, CGCCAC,
CGCCAG, CGCCAU, CGCCCA, CGCCCC, CGCCCG, CGCCGA, CGCCGC, CGCCGG, CGCCGU, CGCCUA,
CGCCUG, CGCCUU, CGCGAA, CGCGAC, CGCGAG, CGCGAU, CGCGCA, CGCGCC, CGCGCG, CGCGCU,
CGCGGA, CGCGGC, CGCGGG, CGCGGU, CGCGUA, CGCGUC, CGCGUG, CGCGUU, CGCUAA, CGCUAC,
CGCUAG, CGCUAU, CGCUCA, CGCUCC, CGCUCG, CGCUCU, CGCUGA, CGCUGC, CGCUGG, CGCUGU,
CGCUUA, CGCUUC, CGCUUG, CGGAAA, CGGAAC, CGGAAG, CGGACA, CGGACC, CGGACG, CGGACU,
CGGAGC, CGGAGG, CGGAGU, CGGAUA, CGGAUU, CGGCAA, CGGCAC, CGGCAG, CGGCCA, CGGCCC,
CGGCCG, CGGCGC, CGGCGG, CGGCGU, CGGCUA, CGGCUC, CGGCUG, CGGCUU, CGGGAA, CGGGAC,
CGGGAG, CGGGAU, CGGGCA, CGGGCC, CGGGCG, CGGGCU, CGGGGU, CGGGUA, CGGGUC, CGGGUG,
CGGUAA, CGGUAC, CGGUAG, CGGUAU, CGGUCA, CGGUCG, CGGUCU, CGGUGA, CGGUGG, CGGUGU,
CGGUUA, CGGUUC, CGGUUG, CGGUUU, CGUAAA, CGUAAC, CGUAAG, CGUAAU, CGUACA, CGUACG,
CGUACU, CGUAGA, CGUAGC, CGUAGG, CGUAGU, CGUAUA, CGUAUC, CGUAUG, CGUAUU, CGUCAA,
CGUCAC, CGUCAG, CGUCAU, CGUCCA, CGUCCC, CGUCCG, CGUCCU, CGUCGA, CGUCGG, CGUCGU,
CGUCUA, CGUCUC, CGUCUG, CGUCUU, CGUGAA, CGUGAC, CGUGAG, CGUGAU, CGUGCC, CGUGCG,
CGUGCU, CGUGGA, CGUGGG, CGUGGU, CGUGUA, CGUGUG, CGUUAA, CGUUAC, CGUUAG,
CGUUAU, CGUUCA, CGUUCC, CGUUCG, CGUUCU, CGUUGA, CGUUGC, CGUUGU, CGUUUA, CGUUUC,
CGUUUU, CUAAAA, CUAAAC, CUAAAU, CUAACA, CUAACC, CUAACG, CUAACU, CUAAGA, CUAAGC,
CUAAGU, CUAAUA, CUAAUC, CUAAUG, CUACAC, CUACAU, CUACCA, CUACCC, CUACCG, CUACCU,
CUACGA, CUACGC, CUACGG, CUACGU, CUACUA, CUACUC, CUACUG, CUAGAA, CUAGAG, CUAGAU,
CUAGCA, CUAGCC, CUAGCG, CUAGCU, CUAGGA, CUAGGG, CUAGGU, CUAGUG, CUAGUU, CUAUAA,
CUAUAG, CUAUAU, CUAUCA, CUAUCC, CUAUCG, CUAUCU, CUAUGA, CUAUGC, CUAUGG, CUAUGU,
CUAUUA, CUAUUG, CUCAAC, CUCAAG, CUCAAU, CUCACC, CUCACG, CUCAGC, CUCAUA, CUCAUC,
CUCAUG, CUCAUU, CUCCAC, CUCCCC, CUCCCG, CUCCGA, CUCCGC, CUCCGG, CUCCUA, CUCCUC,
CUCCUU, CUCGAA, CUCGAC, CUCGAG, CUCGAU, CUCGCA, CUCGCC, CUCGCG, CUCGGG, CUCGGU,
CUCGUA, CUCGUC, CUCGUG, CUCGUU, CUCUAA, CUCUAC, CUCUAU, CUCUCA, CUCUCC, CUCUCU,
CUCUGC, CUCUGU, CUCUUA, CUCUUG, CUGAAG, CUGACC, CUGACG, CUGAGC, CUGAUA, CUGAUC,
CUGCCG, CUGCCU, CUGCGA, CUGCUA, CUGCUU, CUGGAG, CUGGAU, CUGGCG, CUGGGU, CUGUAC,
CUGUCA, CUGUCC, CUGUCG, CUGUGG, CUGUGU, CUGUUA, CUGUUU, CUUAAC, CUUAAG, CUUAAU,
CUUACC, CUUACG, CUUAGA, CUUAGC, CUUAGG, CUUAGU, CUUAUA, CUUAUC, CUUAUG, CUUAUU,

TABLE 1-continued

Hexamers that are not seed sequences of human miRNAs

CUUCAG, CUUCAU, CUUCCA, CUUCCC, CUUCCG, CUUCCU, CUUCGA, CUUCGC, CUUCGG, CUUCGU, CUUCUA, CUUGAC, CUUGAG, CUUGAU, CUUGCA, CUUGCC, CUUGCG, CUUGCU, CUUGGC, CUUGGU, CUUGUU, CUUUAC, CUUUAG, CUUUAU, CUUUCA, CUUUCG, CUUUCU, CUUUGA, CUUUGC, CUUUGU, CUUUUA, CUUUUC, CUUUUG, CUUUUU, GAAAAA, GAAAAG, GAAAAU, GAAACC, GAAACG, GAAAGA, GAAAGC, GAAAGU, GAAAUA, GAAAUC, GAAAUG, GAAAUU, GAACAA, GAACAC, GAACAG, GAACAU, GAACCA, GAACCC, GAACCG, GAACCU, GAACGA, GAACGC, GAACGG, GAACGU, GAACUA, GAACUG, GAACUU, GAAGAC, GAAGAG, GAAGCA, GAAGCG, GAAGCU, GAAGUC, GAAUAA, GAAUAC, GAAUAG, GAAUAU, GAAUCC, GAAUCG, GAAUCU, GAAUGA, GAAUGC, GAAUGU, GAAUUA, GAAUUC, GAAUUU, GACAAA, GACAAG, GACAAU, GACACC, GACAGA, GACAGG, GACAUA, GACAUG, GACAUU, GACCAA, GACCAC, GACCAG, GACCCA, GACCCC, GACCCG, GACCGC, GACCGG, GACCGU, GACCUA, GACCUC, GACCUU, GACGAA, GACGAC, GACGAG, GACGAU, GACGCA, GACGCC, GACGCG, GACGCU, GACGGA, GACGGC, GACGGG, GACGGU, GACGUA, GACGUC, GACGUG, GACGUU, GACUAA, GACUAC, GACUAG, GACUAU, GACUCA, GACUCC, GACUCG, GACUGG, GACUGU, GACUUA, GACUUG, GACUUU, GAGAAU, GAGAGA, GAGAGC, GAGAGG, GAGAUA, GAGAUC, GAGCAA, GAGCAU, GAGCCA, GAGCGA, GAGCGG, GAGCGU, GAGGGU, GAGGUC, GAGGUG, GAGUAA, GAGUAG, GAGUCC, GAGUUC, GAGUUU, GAUAAA, GAUAAC, GAUAAG, GAUAAU, GAUACA, GAUACC, GAUACG, GAUACU, GAUAGA, GAUAGC, GAUAGG, GAUAGU, GAUAUA, GAUCAA, GAUCAC, GAUCAU, GAUCCA, GAUCCC, GAUCCU, GAUCGC, GAUCGG, GAUCGU, GAUCUA, GAUCUG, GAUCUU, GAUGAA, GAUGAC, GAUGAG, GAUGCA, GAUGCC, GAUGCG, GAUGCU, GAUGGC, GAUGGG, GAUGGU, GAUGUG, GAUGUU, GAUUAA, GAUUAC, GAUUAG, GAUUAU, GAUUCA, GAUUCG, GAUUCU, GAUUGA, GAUUGC, GAUUUA, GAUUUC, GAUUUG, GAUUUU, GCAAAC, GCAAAG, GCAAAU, GCAACA, GCAACC, GCAAGC, GCAAGU, GCAAUA, GCAAUC, GCAAUG, GCAAUU, GCACAA, GCACAC, GCACAG, GCACCC, GCACCG, GCACCU, GCACGA, GCACGC, GCACGU, GCACUA, GCACUC, GCACUG, GCACUU, GCAGAU, GCAGCC, GCAGCG, GCAGGC, GCAGUA, GCAGUC, GCAGUG, GCAGUU, GCAUAA, GCAUAG, GCAUAU, GCAUCG, GCAUCU, GCAUGA, GCAUGC, GCAUGG, GCAUGU, GCAUUA, GCAUUC, GCAUUG, GCAUUU, GCCAAA, GCCAAC, GCCAAU, GCCACA, GCCACC, GCCACG, GCCAGA, GCCAGU, GCCAUA, GCCAUC, GCCAUG, GCCAUU, GCCCAA, GCCCAC, GCCCAG, GCCCCG, GCCCGA, GCCCGG, GCCCGU, GCCGAA, GCCGAC, GCCGAG, GCCGAU, GCCGCA, GCCGCU, GCCGGA, GCCGGC, GCCGGG, GCCGGU, GCCGUA, GCCGUC, GCCGUG, GCCGUU, GCCUAA, GCCUAU, GCCUCA, GCCUCC, GCCUCG, GCCUGA, GCCUUA, GCCUUU, GCGAAA, GCGAAC, GCGAAG, GCGAAU, GCGACC, GCGACG, GCGACU, GCGAGA, GCGAGC, GCGAGG, GCGAGU, GCGAUA, GCGAUC, GCGAUG, GCGAUU, GCGCAA, GCGCAC, GCGCAG, GCGCAU, GCGCCA, GCGCCC, GCGCCU, GCGCGA, GCGCGU, GCGCUA, GCGCUC, GCGCUG, GCGCUU, GCGGAA, GCGGAC, GCGGAU, GCGGCA, GCGGCC, GCGGCU, GCGGGA, GCGGUA, GCGGUC, GCGGUU, GCGUAA, GCGUAC, GCGUAG, GCGUAU, GCGUCA, GCGUCC, GCGUCG, GCGUCU, GCGUGA, GCGUGC, GCGUGG, GCGUGU, GCGUUA, GCGUUC, GCGUUG, GCGUUU, GCUAAA, GCUAAC, GCUAAG, GCUAAU, GCUACC, GCUACG, GCUACU, GCUAGA, GCUAGG, GCUAGU, GCUAUA, GCUAUC, GCUAUU, GCUCAA, GCUCAC, GCUCAG, GCUCAU, GCUCCA, GCUCCC, GCUCCG, GCUCGA, GCUCGC, GCUCGU, GCUCUA, GCUCUC, GCUCUU, GCUGAA, GCUGAC, GCUGAU, GCUGCA, GCUGCC, GCUGCG, GCUGCU, GCUGUG, GCUGUU, GCUUAC, GCUUAG, GCUUAU, GCUUCA, GCUUCG, GCUUGA, GCUUGG, GCUUGU, GCUUUA, GCUUUG, GGAAAG, GGAACA, GGAACC,

TABLE 1-continued

Hexamers that are not seed sequences of human miRNAs

GGAACG, GGAACU, GGAAGU, GGAAUA, GGAAUC, GGAAUU, GGACAA, GGACAC, GGACAG, GGACAU,
GGACCG, GGACGA, GGACGC, GGACGU, GGACUA, GGACUC, GGACUU, GGAGAC, GGAGCA, GGAGCG,
GGAGGG, GGAGUA, GGAUAA, GGAUAC, GGAUCA, GGAUCC, GGAUCG, GGAUCU, GGAUGC, GGAUUA,
GGAUUG, GGCAAU, GGCACA, GGCACU, GGCAGA, GGCAUA, GGCAUC, GGCCAC, GGCCAG, GGCCCC,
GGCCGA, GGCCGC, GGCCGU, GGCCUA, GGCCUG, GGCCUU, GGCGAA, GGCGAG, GGCGAU, GGCGCA,
GGCGCU, GGCGGU, GGCGUA, GGCGUC, GGCGUG, GGCGUU, GGCUAA, GGCUAC, GGCUAG, GGCUAU,
GGCUCC, GGCUCG, GGCUGA, GGCUUA, GGCUUC, GGCUUG, GGGAAU, GGGACA, GGGAGA, GGGAGU,
GGGAUA, GGGAUU, GGGCAA, GGGCAC, GGGCAG, GGGCCG, GGGCGG, GGGGCC, GGGGGG,
GGGGGU, GGGGUA, GGGUAC, GGGUAU, GGGUCA, GGGUCC, GGGUCG, GGGUGA, GGGUGC,
GGGUUA, GGGUUG, GGUAAA, GGUAAC, GGUAAG, GGUAAU, GGUACA, GGUACC, GGUACG,
GGUACU, GGUAGC, GGUAGG, GGUAGU, GGUAUA, GGUAUC, GGUAUG, GGUCAA, GGUCAC,
GGUCAG, GGUCAU, GGUCCA, GGUCCG, GGUCCU, GGUCGA, GGUCGC, GGUCGG, GGUCGU, GGUCUC,
GGUCUU, GGUGAA, GGUGAC, GGUGAU, GGUGCA, GGUGCC, GGUGGC, GGUGUA, GGUGUC,
GGUUAA, GGUUAG, GGUUAU, GGUUCA, GGUUCC, GGUUCG, GGUUGC, GGUUUC, GGUUUU,
GUAAAA, GUAAAG, GUAAAU, GUAACC, GUAACG, GUAACU, GUAAGA, GUAAGC, GUAAGG, GUAAGU,
GUAAUA, GUAAUC, GUAAUG, GUAAUU, GUACAA, GUACAC, GUACAG, GUACAU, GUACCA, GUACCC,
GUACCG, GUACCU, GUACGA, GUACGC, GUACGG, GUACGU, GUACUA, GUACUC, GUACUG, GUACUU,
GUAGAA, GUAGAC, GUAGCA, GUAGCC, GUAGCG, GUAGCU, GUAGGA, GUAGGC, GUAGGG,
GUAGGU, GUAGUA, GUAGUC, GUAUAA, GUAUAC, GUAUAG, GUAUAU, GUAUCA, GUAUCG,
GUAUCU, GUAUGA, GUAUGC, GUAUGG, GUAUUA, GUAUUG, GUAUUU, GUCAAA, GUCAAG,
GUCAAU, GUCACA, GUCACC, GUCACG, GUCAGA, GUCAGC, GUCAGG, GUCAUA, GUCAUC, GUCAUG,
GUCCAA, GUCCAC, GUCCAU, GUCCCC, GUCCCU, GUCCGA, GUCCGC, GUCCGG, GUCCGU, GUCCUA,
GUCCUG, GUCCUU, GUCGAA, GUCGAC, GUCGAG, GUCGAU, GUCGCA, GUCGCC, GUCGCG, GUCGCU,
GUCGGA, GUCGGC, GUCGGG, GUCGGU, GUCGUA, GUCGUC, GUCGUU, GUCUAA, GUCUAG, GUCUCA,
GUCUCC, GUCUCG, GUCUGA, GUCUGG, GUCUGU, GUCUUC, GUCUUU, GUGAAA, GUGAAC, GUGAAG,
GUGACC, GUGACG, GUGAGA, GUGAGC, GUGAGU, GUGAUC, GUGAUG, GUGAUU, GUGCAC,
GUGCAU, GUGCCC, GUGCCG, GUGCGA, GUGCGG, GUGCGU, GUGCUA, GUGCUC, GUGCUG,
GUGGAG, GUGGCG, GUGGCU, GUGGGU, GUGGUC, GUGGUG, GUGUAA, GUGUAG, GUGUCG,
GUGUGA, GUGUGC, GUGUGU, GUGUUG, GUGUUU, GUUAAA, GUUAAC, GUUAAG, GUUACA,
GUUACC, GUUACG, GUUACU, GUUAGA, GUUAGC, GUUAGU, GUUAUA, GUUAUC, GUUAUG,
GUUAUU, GUUCAA, GUUCAC, GUUCAG, GUUCCA, GUUCCG, GUUCGA, GUUCGC, GUUCGG, GUUCGU,
GUUCUA, GUUCUG, GUUGAA, GUUGAC, GUUGAG, GUUGAU, GUUGCG, GUUGCU, GUUGGA,
GUUGGC, GUUGGU, GUUGUC, GUUGUG, GUUGUU, GUUUAA, GUUUAC, GUUUAG, GUUUAU,
GUUUCA, GUUUCC, GUUUCU, GUUUGA, GUUUGC, GUUUGG, GUUUGU, GUUUUA, GUUUUC,
GUUUUU, UAAAAA, UAAAAC, UAAAAG, UAAAAU, UAAACA, UAAACC, UAAACG, UAAACU, UAAAGA,
UAAAGG, UAAAGU, UAAAUA, UAAAUC, UAAAUG, UAAAUU, UAACAA, UAACAC, UAACAG, UAACCA,
UAACCC, UAACCG, UAACCU, UAACGA, UAACGC, UAACGG, UAACGU, UAACUA, UAACUG, UAACUU,
UAAGAG, UAAGAU, UAAGCA, UAAGCC, UAAGCG, UAAGCU, UAAGGA, UAAGGC, UAAGGG, UAAGGU,
UAAGUA, UAAGUC, UAAGUG, UAAGUU, UAAUAA, UAAUCA, UAAUCC, UAAUCG, UAAUCU, UAAUGA,

TABLE 1-continued

Hexamers that are not seed sequences of human miRNAs

UAAUGG, UAAUGU, UAAUUA, UAAUUC, UAAUUG, UACAAC, UACAAG, UACAAU, UACACC, UACACG,

UACACU, UACAGA, UACAGC, UACAUA, UACAUC, UACAUU, UACCAA, UACCAC, UACCAG, UACCAU,

UACCCC, UACCCG, UACCCU, UACCGA, UACCGC, UACCGG, UACCGU, UACCUA, UACCUG, UACGAA,

UACGAC, UACGAG, UACGAU, UACGCA, UACGCC, UACGCG, UACGCU, UACGGC, UACGGG, UACGGU,

UACGUA, UACGUC, UACGUG, UACGUU, UACUAA, UACUAC, UACUAG, UACUAU, UACUCA, UACUCC,

UACUCG, UACUCU, UACUGA, UACUGC, UACUGG, UACUUA, UACUUG, UACUUU, UAGAAA, UAGAAG,

UAGAAU, UAGACA, UAGACG, UAGAGA, UAGAGC, UAGAGU, UAGAUA, UAGAUC, UAGAUG, UAGCAU,

UAGCCC, UAGCCG, UAGCCU, UAGCGA, UAGCGC, UAGCGU, UAGCUA, UAGCUC, UAGCUG, UAGGAA,

UAGGAU, UAGGCG, UAGGCU, UAGGGU, UAGGUC, UAGGUG, UAGGUU, UAGUAA, UAGUAC,

UAGUAG, UAGUAU, UAGUCA, UAGUCG, UAGUGU, UAGUUA, UAGUUC, UAGUUG, UAGUUU,

UAUAAC, UAUAAG, UAUACU, UAUAGA, UAUAGC, UAUAGG, UAUAGU, UAUAUA, UAUAUC, UAUAUG,

UAUAUU, UAUCAA, UAUCAC, UAUCAU, UAUCCA, UAUCCC, UAUCCG, UAUCCU, UAUCGA, UAUCGC,

UAUCGG, UAUCGU, UAUCUA, UAUCUC, UAUCUG, UAUCUU, UAUGAA, UAUGAC, UAUGAG,

UAUGAU, UAUGCA, UAUGCG, UAUGCU, UAUGGA, UAUGGC, UAUGUC, UAUGUG, UAUGUU,

UAUUAG, UAUUCA, UAUUCC, UAUUCG, UAUUCU, UAUUGA, UAUUGG, UAUUUA, UAUUUC,

UAUUUG, UAUUUU, UCAAAA, UCAAAC, UCAAAG, UCAACC, UCAACU, UCAAGA, UCAAGC, UCAAUA,

UCAAUC, UCAAUG, UCAAUU, UCACCC, UCACCG, UCACCU, UCACGA, UCACGC, UCACGG, UCACGU,

UCACUA, UCACUC, UCACUU, UCAGAA, UCAGAC, UCAGAG, UCAGCG, UCAGCU, UCAGGA, UCAGGC,

UCAGGU, UCAGUC, UCAGUU, UCAUAA, UCAUCA, UCAUCC, UCAUCG, UCAUGC, UCAUGG, UCAUGU,

UCAUUA, UCAUUG, UCCAAA, UCCAAC, UCCAAG, UCCAAU, UCCACA, UCCACC, UCCACG, UCCAGC,

UCCAGG, UCCAUA, UCCAUC, UCCAUU, UCCCAA, UCCCAG, UCCCAU, UCCCCC, UCCCCG, UCCCCU,

UCCCGA, UCCCGC, UCCCGG, UCCCGU, UCCCUA, UCCCUC, UCCGAA, UCCGAC, UCCGAG, UCCGAU,

UCCGCA, UCCGCC, UCCGGA, UCCGGC, UCCGGU, UCCGUA, UCCGUC, UCCGUG, UCCUAA, UCCUCA,

UCCUCG, UCCUCU, UCCUGC, UCCUGU, UCCUUA, UCCUUC, UCCUUU, UCGAAA, UCGAAC, UCGAAG,

UCGAAU, UCGACA, UCGACC, UCGACG, UCGACU, UCGAGA, UCGAGC, UCGAGG, UCGAUA, UCGAUC,

UCGAUG, UCGAUU, UCGCAA, UCGCAC, UCGCAG, UCGCAU, UCGCCA, UCGCCC, UCGCCG, UCGCCU,

UCGCGA, UCGCGC, UCGCGU, UCGCUA, UCGCUC, UCGGAA, UCGGAC, UCGGAG, UCGGAU, UCGGCA,

UCGGCU, UCGGGG, UCGGGU, UCGGUC, UCGGUG, UCGGUU, UCGUAA, UCGUAC, UCGUAG,

UCGUAU, UCGUCA, UCGUCC, UCGUCG, UCGUCU, UCGUGA, UCGUGU, UCGUUA, UCGUUC, UCGUUG,

UCGUUU, UCUAAC, UCUAAG, UCUAAU, UCUACA, UCUACC, UCUACG, UCUACU, UCUAGC, UCUAGG,

UCUAGU, UCUAUA, UCUAUC, UCUAUG, UCUAUU, UCUCAG, UCUCAU, UCUCCG, UCUCGC, UCUCGG,

UCUCGU, UCUCUC, UCUGAA, UCUGAU, UCUGCA, UCUGCG, UCUGCU, UCUGGC, UCUGGU, UCUGUC,

UCUGUG, UCUGUU, UCUUAA, UCUUAC, UCUUAG, UCUUAU, UCUUCA, UCUUCC, UCUUCG, UCUUCU,

UCUUGC, UCUUGG, UCUUGU, UCUUUA, UCUUUC, UCUUUG, UCUUUU, UGAAAA, UGAAAC,

UGAACA, UGAACC, UGAAGG, UGAAUC, UGAAUG, UGACAA, UGACAC, UGACAG, UGACCA, UGACCC,

UGACCG, UGACGA, UGACGC, UGACGG, UGACGU, UGACUA, UGACUC, UGACUU, UGAGAG, UGAGAU,

UGAGCA, UGAGCC, UGAGCU, UGAGGC, UGAGGU, UGAGUA, UGAGUU, UGAUAC, UGAUAG,

UGAUAU, UGAUCA, UGAUCG, UGAUCU, UGAUGA, UGAUGC, UGAUGG, UGAUGU, UGAUUA,

UGAUUC, UGAUUG, UGAUUU, UGCAAC, UGCAAG, UGCACA, UGCACG, UGCAGG, UGCAGU, UGCAUC,

TABLE 1-continued

Hexamers that are not seed sequences of human miRNAs

UGCCCA, UGCCCC, UGCCCG, UGCCGA, UGCCGC, UGCCGG, UGCCGU, UGCCUA, UGCCUC, UGCCUG,
UGCCUU, UGCGAA, UGCGAC, UGCGAU, UGCGCC, UGCGCG, UGCGCU, UGCGGC, UGCGGG, UGCGGU,
UGCGUA, UGCGUC, UGCGUG, UGCGUU, UGCUAC, UGCUAU, UGCUCC, UGCUCG, UGCUGC, UGCUGG,
UGCUGU, UGCUUA, UGCUUU, UGGAAC, UGGAAG, UGGAGC, UGGAUC, UGGAUU, UGGCAA,
UGGCAC, UGGCAG, UGGCCG, UGGCCU, UGGCGA, UGGCGC, UGGCGU, UGGCUA, UGGCUC, UGGCUU,
UGGGAA, UGGGCA, UGGGCC, UGGGGC, UGGGUC, UGGUAA, UGGUAG, UGGUAU, UGGUCC,
UGGUCG, UGGUCU, UGGUGA, UGGUGC, UGGUGG, UGGUGU, UGGUUA, UGGUUG, UGUAAA,
UGUAAC, UGUAAG, UGUACC, UGUACG, UGUACU, UGUAGA, UGUAGC, UGUAGU, UGUAUC,
UGUAUU, UGUCAA, UGUCAC, UGUCAG, UGUCAU, UGUCCA, UGUCCC, UGUCCG, UGUCGA, UGUCGC,
UGUCGG, UGUCGU, UGUCUA, UGUCUC, UGUGAC, UGUGAG, UGUGAU, UGUGCA, UGUGGU,
UGUGUA, UGUGUU, UGUUAC, UGUUAG, UGUUAU, UGUUCA, UGUUCC, UGUUCG, UGUUGG,
UGUUGU, UGUUUA, UGUUUC, UGUUUG, UGUUUU, UUAAAA, UUAAAC, UUAAAG, UUAAAU,
UUAACC, UUAACG, UUAACU, UUAAGU, UUAAUA, UUAAUC, UUAAUG, UUAAUU, UUACAA, UUACAC,
UUACAG, UUACAU, UUACCA, UUACCC, UUACCG, UUACCU, UUACGA, UUACGC, UUACGG, UUACGU,
UUACUA, UUACUC, UUACUG, UUACUU, UUAGAA, UUAGAC, UUAGCC, UUAGCG, UUAGCU, UUAGGC,
UUAGGU, UUAGUA, UUAGUC, UUAGUU, UUAUAA, UUAUAC, UUAUAG, UUAUAU, UUAUCC,
UUAUCG, UUAUCU, UUAUGA, UUAUGG, UUAUGU, UUAUUA, UUAUUC, UUAUUG, UUAUUU,
UUCAAC, UUCAAU, UUCACA, UUCACC, UUCACG, UUCACU, UUCAGC, UUCAGG, UUCAGU, UUCAUA,
UUCAUC, UUCAUG, UUCAUU, UUCCAA, UUCCCA, UUCCCG, UUCCGA, UUCCGU, UUCCUU, UUCGAA,
UUCGAC, UUCGAG, UUCGAU, UUCGCA, UUCGCC, UUCGCG, UUCGCU, UUCGGA, UUCGGC, UUCGGG,
UUCGGU, UUCGUA, UUCGUC, UUCGUG, UUCGUU, UUCUAC, UUCUAG, UUCUCA, UUCUCG,
UUCUGG, UUCUUA, UUCUUU, UUGAAA, UUGAAC, UUGAAG, UUGAAU, UUGACC, UUGACG,
UUGACU, UUGAGA, UUGAGC, UUGAGU, UUGAUA, UUGAUC, UUGAUG, UUGAUU, UUGCAA,
UUGCAC, UUGCAG, UUGCAU, UUGCCC, UUGCCG, UUGCGA, UUGCGC, UUGCGG, UUGCGU, UUGCUA,
UUGCUC, UUGCUG, UUGCUU, UUGGAA, UUGGAG, UUGGCC, UUGGCG, UUGGCU, UUGGGC,
UUGGGU, UUGGUA, UUGGUG, UUGUAA, UUGUAC, UUGUCA, UUGUCG, UUGUCU, UUGUGC,
UUGUGG, UUGUUA, UUGUUG, UUGUUU, UUUAAA, UUUAAC, UUUAAG, UUUAAU, UUUACA,
UUUACC, UUUACG, UUUACU, UUUAGA, UUUAGC, UUUAGG, UUUAGU, UUUAUA, UUUAUC,
UUUAUG, UUUAUU, UUUCAU, UUUCCA, UUUCCG, UUUCCU, UUUCGA, UUUCGC, UUUCGG,
UUUCGU, UUUCUA, UUUCUC, UUUCUG, UUUCUU, UUUGAA, UUUGAC, UUUGAG, UUUGAU,
UUUGCC, UUUGCU, UUUGGA, UUUGGC, UUUGGG, UUUGGU, UUUGUA, UUUGUC, UUUGUU,
UUUUAA, UUUUAG, UUUUAU, UUUUCC, UUUUCG, UUUUCU, UUUUGA, UUUUGC, UUUUGG,
UUUUGU, UUUUUA, UUUUUC, UUUUUU

TABLE 2

Oligonucleotide sequences made for testing.

| SeqID | Oligo Name | Avg RQ | Avg RQ SE | Expt # | Target | [oligo] | cell line | Time (hr) | Assay Type |
|---|---|---|---|---|---|---|---|---|---|
| 313770 | UTRN-01 m01 | 0.56722359 | 0.19874762 | 1092 | UTRN-69 | 10000 | HSKM | 240 | qRTPCR |

TABLE 2-continued

Oligonucleotide sequences made for testing.

| SeqID | Oligo Name | Avg RQ | Avg RQ SE | Expt # | Target | [oligo] | cell line | Time (hr) | Assay Type |
|---|---|---|---|---|---|---|---|---|---|
| 5776 | UTRN-02 m01 | 0.67184319 | 0.02092561 | 1092 | UTRN-69 | 10000 | HSKM | 240 | qRTPCR |
| 5781 | UTRN-03 m01 | 0.67120255 | 0.02923406 | 1092 | UTRN-69 | 10000 | HSKM | 240 | qRTPCR |
| 32192 | UTRN-04 m01 | 0.47381841 | 0.07845869 | 1092 | UTRN-69 | 10000 | HSKM | 240 | qRTPCR |
| 39558 | UTRN-05 m01 | 0.37910782 | 0.01099078 | 1092 | UTRN-69 | 10000 | HSKM | 240 | qRTPCR |
| 45784 | UTRN-06 m01 | 0.57173237 | 0.07542375 | 1092 | UTRN-69 | 10000 | HSKM | 240 | qRTPCR |
| 60002 | UTRN-07 m01 | 0.81935385 | 0.2957031 | 1092 | UTRN-69 | 10000 | HSKM | 240 | qRTPCR |
| 60035 | UTRN-08 m01 | 0.47643682 | 0.00956236 | 1092 | UTRN-69 | 10000 | HSKM | 240 | qRTPCR |
| 60038 | UTRN-09 m01 | 0.27641668 | 0.02978163 | 1092 | UTRN-69 | 10000 | HSKM | 240 | qRTPCR |
| 336679 | UTRN-10 m01 | 0.4548524 | 0.04438911 | 1092 | UTRN-69 | 10000 | HSKM | 240 | qRTPCR |
| 62709 | UTRN-11 m01 | 0.31515099 | 0.08650396 | 1092 | UTRN-69 | 10000 | HSKM | 240 | qRTPCR |
| 64394 | UTRN-12 m01 | 0.33957971 | 0.07934133 | 1092 | UTRN-69 | 10000 | HSKM | 240 | qRTPCR |
| 64407 | UTRN-13 m01 | 0.48259158 | 0.02130792 | 1092 | UTRN-69 | 10000 | HSKM | 240 | qRTPCR |
| 68368 | UTRN-14 m01 | 0.5186531 | 0.04635273 | 1092 | UTRN-69 | 10000 | HSKM | 240 | qRTPCR |
| 68420 | UTRN-15 m01 | 0.40961743 | 0.01198532 | 1092 | UTRN-69 | 10000 | HSKM | 240 | qRTPCR |
| 68424 | UTRN-16 m01 | 0.58260161 | 0.08279854 | 1092 | UTRN-69 | 10000 | HSKM | 240 | qRTPCR |
| 225662 | UTRN-51 m01 | 0.40878698 | 0.0396697 | 1092 | UTRN-69 | 10000 | HSKM | 240 | qRTPCR |
| 229456 | UTRN-52 m01 | 0.52805355 | 0.09271042 | 1092 | UTRN-69 | 10000 | HSKM | 240 | qRTPCR |
| 436557 | UTRN-53 m01 | 0.60486934 | 0.01210078 | 1092 | UTRN-69 | 10000 | HSKM | 240 | qRTPCR |
| 238467 | UTRN-54 m01 | 0.48843878 | 0.08898362 | 1092 | UTRN-69 | 10000 | HSKM | 240 | qRTPCR |
| 242264 | UTRN-55 m01 | 0.44606685 | 0.11570192 | 1092 | UTRN-69 | 10000 | HSKM | 240 | qRTPCR |
| 251939 | UTRN-56 m01 | 0.62479703 | 0.10459768 | 1092 | UTRN-69 | 10000 | HSKM | 240 | qRTPCR |
| 453443 | UTRN-57 m01 | 0.62712277 | 0.10181988 | 1092 | UTRN-69 | 10000 | HSKM | 240 | qRTPCR |
| 453483 | UTRN-58 m01 | 0.60355641 | 0.06283768 | 1092 | UTRN-69 | 10000 | HSKM | 240 | qRTPCR |
| 456038 | UTRN-59 m01 | 0.55331257 | 0.00333395 | 1092 | UTRN-69 | 10000 | HSKM | 240 | qRTPCR |
| 272301 | UTRN-60 m01 | 0.68004552 | 0.04014439 | 1092 | UTRN-69 | 10000 | HSKM | 240 | qRTPCR |
| 276749 | UTRN-61 m01 | 0.40554491 | 0.04428404 | 1092 | UTRN-69 | 10000 | HSKM | 240 | qRTPCR |
| 289697 | UTRN-62 m01 | 0.57547405 | 0.10918106 | 1092 | UTRN-69 | 10000 | HSKM | 240 | qRTPCR |
| 292490 | UTRN-63 m01 | 1.22451016 | 0.1400616 | 1092 | UTRN-69 | 10000 | HSKM | 240 | qRTPCR |
| 292535 | UTRN-64 m01 | 0.35813772 | 0.02632312 | 1092 | UTRN-69 | 10000 | HSKM | 240 | qRTPCR |
| 292541 | UTRN-65 m01 | 0.5783448 | 0.14263157 | 1092 | UTRN-69 | 10000 | HSKM | 240 | qRTPCR |
|  | Ctrl Un | 1 | 0.15624566 | 1092 | UTRN-69 | 10000 | HSKM | 240 | qRTPCR |
| 313770 | UTRN-01 m01 | 0.80889119 | 0.22465479 | 1092 | UTRN-02 | 10000 | HSKM | 240 | qRTPCR |
| 5776 | UTRN-02 m01 | 0.40448717 | 0.06346895 | 1092 | UTRN-02 | 10000 | HSKM | 240 | qRTPCR |
| 5781 | UTRN-03 m01 | 0.42883333 | 0.01903559 | 1092 | UTRN-02 | 10000 | HSKM | 240 | qRTPCR |
| 32192 | UTRN-04 m01 | 0.58600693 | 0.04983107 | 1092 | UTRN-02 | 10000 | HSKM | 240 | qRTPCR |
| 39558 | UTRN-05 m01 | 0.44668903 | 0.03733429 | 1092 | UTRN-02 | 10000 | HSKM | 240 | qRTPCR |
| 45784 | UTRN-06 m01 | 0.60263964 | 0.05898416 | 1092 | UTRN-02 | 10000 | HSKM | 240 | qRTPCR |

TABLE 2-continued

Oligonucleotide sequences made for testing.

| SeqID | Oligo Name | Avg RQ | Avg RQ SE | Expt # | Target | [oligo] | cell line | Time (hr) | Assay Type |
|---|---|---|---|---|---|---|---|---|---|
| 60002 | UTRN-07 m01 | 0.65881688 | 0.15865717 | 1092 | UTRN-02 | 10000 | HSKM | 240 | qRTPCR |
| 60035 | UTRN-08 m01 | 0.45969974 | 0.02226413 | 1092 | UTRN-02 | 10000 | HSKM | 240 | qRTPCR |
| 60038 | UTRN-09 m01 | 0.28578991 | 0.05386535 | 1092 | UTRN-02 | 10000 | HSKM | 240 | qRTPCR |
| 336679 | UTRN-10 m01 | 0.42517389 | 0.07119164 | 1092 | UTRN-02 | 10000 | HSKM | 240 | qRTPCR |
| 62709 | UTRN-11 m01 | 0.26632703 | 0.08404946 | 1092 | UTRN-02 | 10000 | HSKM | 240 | qRTPCR |
| 64394 | UTRN-12 m01 | 0.24238335 | 0.08508889 | 1092 | UTRN-02 | 10000 | HSKM | 240 | qRTPCR |
| 64407 | UTRN-13 m01 | 0.3867596 | 0.02251739 | 1092 | UTRN-02 | 10000 | HSKM | 240 | qRTPCR |
| 68368 | UTRN-14 m01 | 0.5047263 | 0.06510318 | 1092 | UTRN-02 | 10000 | HSKM | 240 | qRTPCR |
| 68420 | UTRN-15 m01 | 0.35145444 | 0.00360596 | 1092 | UTRN-02 | 10000 | HSKM | 240 | qRTPCR |
| 68424 | UTRN-16 m01 | 0.25078544 | 0.0448786 | 1092 | UTRN-02 | 10000 | HSKM | 240 | qRTPCR |
| 225662 | UTRN-51 m01 | 0.42594611 | 0.01741836 | 1092 | UTRN-02 | 10000 | HSKM | 240 | qRTPCR |
| 229456 | UTRN-52 m01 | 0.45785694 | 0.0993462 | 1092 | UTRN-02 | 10000 | HSKM | 240 | qRTPCR |
| 436557 | UTRN-53 m01 | 0.52935015 | 0.07073485 | 1092 | UTRN-02 | 10000 | HSKM | 240 | qRTPCR |
| 238467 | UTRN-54 m01 | 0.38557612 | 0.10392575 | 1092 | UTRN-02 | 10000 | HSKM | 240 | qRTPCR |
| 242264 | UTRN-55 m01 | 0.38539574 | 0.08982757 | 1092 | UTRN-02 | 10000 | HSKM | 240 | qRTPCR |
| 251939 | UTRN-56 m01 | 0.5275769 | 0.07069548 | 1092 | UTRN-02 | 10000 | HSKM | 240 | qRTPCR |
| 453443 | UTRN-57 m01 | 0.60576249 | 0.08631879 | 1092 | UTRN-02 | 10000 | HSKM | 240 | qRTPCR |
| 453483 | UTRN-58 m01 | 1.16594129 | 0.207295 | 1092 | UTRN-02 | 10000 | HSKM | 240 | qRTPCR |
| 456038 | UTRN-59 m01 | 0.74009641 | 0.06482759 | 1092 | UTRN-02 | 10000 | HSKM | 240 | qRTPCR |
| 272301 | UTRN-60 m01 | 0.56858603 | 0.01375065 | 1092 | UTRN-02 | 10000 | HSKM | 240 | qRTPCR |
| 276749 | UTRN-61 m01 | 0.34556947 | 0.01341551 | 1092 | UTRN-02 | 10000 | HSKM | 240 | qRTPCR |
| 289697 | UTRN-62 m01 | 0.57219193 | 0.11079267 | 1092 | UTRN-02 | 10000 | HSKM | 240 | qRTPCR |
| 292490 | UTRN-63 m01 | 1.76162269 | 0.37735928 | 1092 | UTRN-02 | 10000 | HSKM | 240 | qRTPCR |
| 292535 | UTRN-64 m01 | 0.42586244 | 0.13429 | 1092 | UTRN-02 | 10000 | HSKM | 240 | qRTPCR |
| 292541 | UTRN-65 m01 | 0.49257532 | 0.18416443 | 1092 | UTRN-02 | 10000 | HSKM | 240 | qRTPCR |
|  | Ctrl Un | 1 | 0.12734144 | 1092 | UTRN-02 | 10000 | HSKM | 240 | qRTPCR |
| 313770 | UTRN-01 m01 | 0.67362339 | 0.2232522 | 1092 | UTRN-16 | 10000 | HSKM | 240 | qRTPCR |
| 5776 | UTRN-02 m01 | 0.59489089 | 0.01623233 | 1092 | UTRN-16 | 10000 | HSKM | 240 | qRTPCR |
| 5781 | UTRN-03 m01 | 0.60756352 | 0.02120997 | 1092 | UTRN-16 | 10000 | HSKM | 240 | qRTPCR |
| 32192 | UTRN-04 m01 | 0.84579108 | 0.07082459 | 1092 | UTRN-16 | 10000 | HSKM | 240 | qRTPCR |
| 39558 | UTRN-05 m01 | 0.52590671 | 0.02640074 | 1092 | UTRN-16 | 10000 | HSKM | 240 | qRTPCR |
| 45784 | UTRN-06 m01 | 0.55979289 | 0.09669573 | 1092 | UTRN-16 | 10000 | HSKM | 240 | qRTPCR |
| 60002 | UTRN-07 m01 | 0.82437207 | 0.13621597 | 1092 | UTRN-16 | 10000 | HSKM | 240 | qRTPCR |
| 60035 | UTRN-08 m01 | 1.02069162 | 0.15643042 | 1092 | UTRN-16 | 10000 | HSKM | 240 | qRTPCR |
| 60038 | UTRN-09 m01 | 0.52400801 | 0.11892967 | 1092 | UTRN-16 | 10000 | HSKM | 240 | qRTPCR |
| 336679 | UTRN-10 m01 | 0.66653372 | 0.00578635 | 1092 | UTRN-16 | 10000 | HSKM | 240 | qRTPCR |
| 62709 | UTRN-11 m01 | 0.46489043 | 0.11377591 | 1092 | UTRN-16 | 10000 | HSKM | 240 | qRTPCR |

TABLE 2-continued

Oligonucleotide sequences made for testing.

| SeqID | Oligo Name | Avg RQ | Avg RQ SE | Expt # | Target | [oligo] | cell line | Time (hr) | Assay Type |
|---|---|---|---|---|---|---|---|---|---|
| 64394 | UTRN-12 m01 | 0.29381633 | 0.10236692 | 1092 | UTRN-16 | 10000 | HSKM | 240 | qRTPCR |
| 64407 | UTRN-13 m01 | 0.43332498 | 0.02180279 | 1092 | UTRN-16 | 10000 | HSKM | 240 | qRTPCR |
| 68368 | UTRN-14 m01 | 0.60192704 | 0.07793789 | 1092 | UTRN-16 | 10000 | HSKM | 240 | qRTPCR |
| 68420 | UTRN-15 m01 | 0.50850314 | 0.02026773 | 1092 | UTRN-16 | 10000 | HSKM | 240 | qRTPCR |
| 68424 | UTRN-16 m01 | 0.79338782 | 0.14011627 | 1092 | UTRN-16 | 10000 | HSKM | 240 | qRTPCR |
| 225662 | UTRN-51 m01 | 0.61828072 | 0.03135995 | 1092 | UTRN-16 | 10000 | HSKM | 240 | qRTPCR |
| 229456 | UTRN-52 m01 | 0.67684173 | 0.11544636 | 1092 | UTRN-16 | 10000 | HSKM | 240 | qRTPCR |
| 436557 | UTRN-53 m01 | 0.66132939 | 0.00638037 | 1092 | UTRN-16 | 10000 | HSKM | 240 | qRTPCR |
| 238467 | UTRN-54 m01 | 0.52348932 | 0.13255186 | 1092 | UTRN-16 | 10000 | HSKM | 240 | qRTPCR |
| 242264 | UTRN-55 m01 | 0.43640996 | 0.072764 | 1092 | UTRN-16 | 10000 | HSKM | 240 | qRTPCR |
| 251939 | UTRN-56 m01 | 0.63988557 | 0.11520213 | 1092 | UTRN-16 | 10000 | HSKM | 240 | qRTPCR |
| 453443 | UTRN-57 m01 | 0.93462493 | 0.18712741 | 1092 | UTRN-16 | 10000 | HSKM | 240 | qRTPCR |
| 453483 | UTRN-58 m01 | 0.75940222 | 0.0719666 | 1092 | UTRN-16 | 10000 | HSKM | 240 | qRTPCR |
| 456038 | UTRN-59 m01 | 0.83102612 | 0.09768756 | 1092 | UTRN-16 | 10000 | HSKM | 240 | qRTPCR |
| 272301 | UTRN-60 m01 | 0.90452397 | 0.03259764 | 1092 | UTRN-16 | 10000 | HSKM | 240 | qRTPCR |
| 276749 | UTRN-61 m01 | 0.43497163 | 0.04443017 | 1092 | UTRN-16 | 10000 | HSKM | 240 | qRTPCR |
| 289697 | UTRN-62 m01 | 0.52034725 | 0.08101528 | 1092 | UTRN-16 | 10000 | HSKM | 240 | qRTPCR |
| 292490 | UTRN-63 m01 | 2.09680006 | 0.29037971 | 1092 | UTRN-16 | 10000 | HSKM | 240 | qRTPCR |
| 292535 | UTRN-64 m01 | 0.47456584 | 0.04190501 | 1092 | UTRN-16 | 10000 | HSKM | 240 | qRTPCR |
| 292541 | UTRN-65 m01 | 0.67792191 | 0.14377542 | 1092 | UTRN-16 | 10000 | HSKM | 240 | qRTPCR |
|  | Ctrl Un | 1 | 0.06312076 | 1092 | UTRN-16 | 10000 | HSKM | 240 | qRTPCR |
| 313770 | UTRN-01 m01 | 0.7575775 | 0.06519882 | 1093 | UTRN-16 | 10 | SK-N-AS | 96 | qRTPCR |
| 5776 | UTRN-02 m01 | 0.85222427 | 0.10789825 | 1093 | UTRN-16 | 10 | SK-N-AS | 96 | qRTPCR |
| 5781 | UTRN-03 m01 | 1.01396082 | 0.09810241 | 1093 | UTRN-16 | 10 | SK-N-AS | 96 | qRTPCR |
| 32192 | UTRN-04 m01 | 1.03810301 | 0.03479278 | 1093 | UTRN-16 | 10 | SK-N-AS | 96 | qRTPCR |
| 39558 | UTRN-05 m01 | 0.83811001 | 0.07880378 | 1093 | UTRN-16 | 10 | SK-N-AS | 96 | qRTPCR |
| 45784 | UTRN-06 m01 | 0.83497824 | 0.07648946 | 1093 | UTRN-16 | 10 | SK-N-AS | 96 | qRTPCR |
| 60002 | UTRN-07 m01 | 0.96839775 | 0.01027857 | 1093 | UTRN-16 | 10 | SK-N-AS | 96 | qRTPCR |
| 60035 | UTRN-08 m01 | 0.75617386 | 0.07285202 | 1093 | UTRN-16 | 10 | SK-N-AS | 96 | qRTPCR |
| 60038 | UTRN-09 m01 | 0.7312052 | 0.10368988 | 1093 | UTRN-16 | 10 | SK-N-AS | 96 | qRTPCR |
| 336679 | UTRN-10 m01 | 0.79199888 | 0.02149166 | 1093 | UTRN-16 | 10 | SK-N-AS | 96 | qRTPCR |
| 62709 | UTRN-11 m01 | 0.83242213 | 0.06016044 | 1093 | UTRN-16 | 10 | SK-N-AS | 96 | qRTPCR |
| 64394 | UTRN-12 m01 | 0.64519349 | 0.01424472 | 1093 | UTRN-16 | 10 | SK-N-AS | 96 | qRTPCR |
| 64407 | UTRN-13 m01 | 1.11054003 | 0.18126866 | 1093 | UTRN-16 | 10 | SK-N-AS | 96 | qRTPCR |
| 68368 | UTRN-14 m01 | 0.88642258 | 0.02610345 | 1093 | UTRN-16 | 10 | SK-N-AS | 96 | qRTPCR |
| 68420 | UTRN-15 m01 | 0.97809677 | 0.03996164 | 1093 | UTRN-16 | 10 | SK-N-AS | 96 | qRTPCR |

TABLE 2-continued

Oligonucleotide sequences made for testing.

| SeqID | Oligo Name | Avg RQ | Avg RQ SE | Expt # | Target | [oligo] | cell line | Time (hr) | Assay Type |
|---|---|---|---|---|---|---|---|---|---|
| 68424 | UTRN-16 m01 | 1.05603303 | 0.0221464 | 1093 | UTRN-16 | 10 | SK-N-AS | 96 | qRTPCR |
| 82947 | UTRN-17 m01 | 0.86484877 | 0.03445718 | 1093 | UTRN-16 | 10 | SK-N-AS | 96 | qRTPCR |
| 85204 | UTRN-18 m01 | 0.87523415 | 0.06143543 | 1093 | UTRN-16 | 10 | SK-N-AS | 96 | qRTPCR |
| 89541 | UTRN-19 m01 | 0.81075428 | 0.06133622 | 1093 | UTRN-16 | 10 | SK-N-AS | 96 | qRTPCR |
| 355024 | UTRN-20 m01 | 0.88311212 | 0.09117433 | 1093 | UTRN-16 | 10 | SK-N-AS | 96 | qRTPCR |
| 99210 | UTRN-21 m01 | 0.74490634 | 0.07508644 | 1093 | UTRN-16 | 10 | SK-N-AS | 96 | qRTPCR |
| 101919 | UTRN-22 m01 | 1.02899798 | 0.08963731 | 1093 | UTRN-16 | 10 | SK-N-AS | 96 | qRTPCR |
| 101994 | UTRN-23 m01 | 0.68475403 | 0.07475312 | 1093 | UTRN-16 | 10 | SK-N-AS | 96 | qRTPCR |
| 103832 | UTRN-24 m01 | 1.1636468 | 0.02059317 | 1093 | UTRN-16 | 10 | SK-N-AS | 96 | qRTPCR |
| 103833 | UTRN-25 m01 | 1.0058327 | 0.07356244 | 1093 | UTRN-16 | 10 | SK-N-AS | 96 | qRTPCR |
| 103853 | UTRN-26 m01 | 0.91569873 | 0.04941268 | 1093 | UTRN-16 | 10 | SK-N-AS | 96 | qRTPCR |
| 103933 | UTRN-27 m01 | 1.02643259 | 0.09834793 | 1093 | UTRN-16 | 10 | SK-N-AS | 96 | qRTPCR |
| 117420 | UTRN-28 m01 | 0.89445462 | 0.06128667 | 1093 | UTRN-16 | 10 | SK-N-AS | 96 | qRTPCR |
| 120115 | UTRN-29 m01 | 1.48761803 | 0.15210318 | 1093 | UTRN-16 | 10 | SK-N-AS | 96 | qRTPCR |
| 120121 | UTRN-30 m01 | 0.99624217 | 0.09012073 | 1093 | UTRN-16 | 10 | SK-N-AS | 96 | qRTPCR |
|  | Ctrl Un | 1.15935157 | 0.09751773 | 1093 | UTRN-16 | 10 | SK-N-AS | 96 | qRTPCR |
|  | Ctrl Lipo | 1 | 0.15131056 | 1093 | UTRN-16 | 10 | SK-N-AS | 96 | qRTPCR |
| 362061 | UTRN-31 m01 | 0.89501129 | 0.10526106 | 1093 | UTRN-16 | 10 | SK-N-AS | 96 | qRTPCR |
| 372488 | UTRN-32 m01 | 0.91931779 | 0.04115957 | 1093 | UTRN-16 | 10 | SK-N-AS | 96 | qRTPCR |
| 372542 | UTRN-33 m01 | 0.9257933 | 0.10415883 | 1093 | UTRN-16 | 10 | SK-N-AS | 96 | qRTPCR |
| 376352 | UTRN-34 m01 | 0.91402177 | 0.11538068 | 1093 | UTRN-16 | 10 | SK-N-AS | 96 | qRTPCR |
| 139243 | UTRN-35 m01 | 0.64416032 | 0.02961176 | 1093 | UTRN-16 | 10 | SK-N-AS | 96 | qRTPCR |
| 143189 | UTRN-36 m01 | 0.79446545 | 0.08975342 | 1093 | UTRN-16 | 10 | SK-N-AS | 96 | qRTPCR |
| 151630 | UTRN-37 m01 | 1.08229119 | 0.15428042 | 1093 | UTRN-16 | 10 | SK-N-AS | 96 | qRTPCR |
| 166370 | UTRN-38 m01 | 0.73170896 | 0.11684001 | 1093 | UTRN-16 | 10 | SK-N-AS | 96 | qRTPCR |
| 166372 | UTRN-39 m01 | 0.83736463 | 0.04842828 | 1093 | UTRN-16 | 10 | SK-N-AS | 96 | qRTPCR |
| 169368 | UTRN-40 m01 | 1.00571931 | 0.09657045 | 1093 | UTRN-16 | 10 | SK-N-AS | 96 | qRTPCR |
| 399345 | UTRN-41 m01 | 0.66794056 | 0.12852317 | 1093 | UTRN-16 | 10 | SK-N-AS | 96 | qRTPCR |
| 412519 | UTRN-42 m01 | 0.80972813 | 0.03420812 | 1093 | UTRN-16 | 10 | SK-N-AS | 96 | qRTPCR |
| 412600 | UTRN-43 m01 | 0.93184181 | 0.0330165 | 1093 | UTRN-16 | 10 | SK-N-AS | 96 | qRTPCR |
| 414862 | UTRN-44 m01 | 0.7780304 | 0.0640387 | 1093 | UTRN-16 | 10 | SK-N-AS | 96 | qRTPCR |
| 195707 | UTRN-45 m01 | 0.7646356 | 0.11294998 | 1093 | UTRN-16 | 10 | SK-N-AS | 96 | qRTPCR |
| 422943 | UTRN-46 m01 | 1.03916407 | 0.18471623 | 1093 | UTRN-16 | 10 | SK-N-AS | 96 | qRTPCR |
| 422946 | UTRN-47 m01 | 0.78047667 | 0.05266601 | 1093 | UTRN-16 | 10 | SK-N-AS | 96 | qRTPCR |
| 210674 | UTRN-48 m01 | 0.69055555 | 0.00272025 | 1093 | UTRN-16 | 10 | SK-N-AS | 96 | qRTPCR |
| 426032 | UTRN-49 m01 | 0.9731503 | 0.09896712 | 1093 | UTRN-16 | 10 | SK-N-AS | 96 | qRTPCR |
| 225629 | UTRN-50 m01 | 0.65724116 | 0.02090648 | 1093 | UTRN-16 | 10 | SK-N-AS | 96 | qRTPCR |

TABLE 2-continued

Oligonucleotide sequences made for testing.

| SeqID | Oligo Name | Avg RQ | Avg RQ SE | Expt # | Target | [oligo] | cell line | Time (hr) | Assay Type |
|---|---|---|---|---|---|---|---|---|---|
| 225662 | UTRN-51 m01 | 0.87698771 | 0.12228726 | 1093 | UTRN-16 | 10 | SK-N-AS | 96 | qRTPCR |
| 229456 | UTRN-52 m01 | 1.08973844 | 0.09000559 | 1093 | UTRN-16 | 10 | SK-N-AS | 96 | qRTPCR |
| 436557 | UTRN-53 m01 | 0.81611016 | 0.03686041 | 1093 | UTRN-16 | 10 | SK-N-AS | 96 | qRTPCR |
| 238467 | UTRN-54 m01 | 0.93870312 | 0.06965803 | 1093 | UTRN-16 | 10 | SK-N-AS | 96 | qRTPCR |
| 242264 | UTRN-55 m01 | 0.82889014 | 0.17454161 | 1093 | UTRN-16 | 10 | SK-N-AS | 96 | qRTPCR |
| 251939 | UTRN-56 m01 | 1.13435171 | 0.17819815 | 1093 | UTRN-16 | 10 | SK-N-AS | 96 | qRTPCR |
| 453443 | UTRN-57 m01 | 1.3064641 | 0.26025914 | 1093 | UTRN-16 | 10 | SK-N-AS | 96 | qRTPCR |
| 453483 | UTRN-58 m01 | 0.84810601 | 0.11631749 | 1093 | UTRN-16 | 10 | SK-N-AS | 96 | qRTPCR |
| 456038 | UTRN-59 m01 | 0.74549699 | 0.03267881 | 1093 | UTRN-16 | 10 | SK-N-AS | 96 | qRTPCR |
| 272301 | UTRN-60 m01 | 1.19595592 | 0.13571268 | 1093 | UTRN-16 | 10 | SK-N-AS | 96 | qRTPCR |
|  | Ctrl Un | 1.05713903 | 0.11259158 | 1093 | UTRN-16 | 10 | SK-N-AS | 96 | qRTPCR |
|  | Ctrl Lipo | 1 | 0.08245938 | 1093 | UTRN-16 | 10 | SK-N-AS | 96 | qRTPCR |
| 276749 | UTRN-61 m01 | 1.03127416 | 0.10921988 | 1093 | UTRN-16 | 10 | SK-N-AS | 96 | qRTPCR |
| 289697 | UTRN-62 m01 | 1.044169 | 0.03233713 | 1093 | UTRN-16 | 10 | SK-N-AS | 96 | qRTPCR |
| 292490 | UTRN-63 m01 | 1.52465937 | 0.09572692 | 1093 | UTRN-16 | 10 | SK-N-AS | 96 | qRTPCR |
| 292535 | UTRN-64 m01 | 1.1321036 | 0.05236107 | 1093 | UTRN-16 | 10 | SK-N-AS | 96 | qRTPCR |
| 292541 | UTRN-65 m01 | 1.08228927 | 0.13345192 | 1093 | UTRN-16 | 10 | SK-N-AS | 96 | qRTPCR |
|  | Ctrl Lipo | 1 | 0.05709597 | 1093 | UTRN-16 | 10 | SK-N-AS | 96 | qRTPCR |
|  | Ctrl Un | 1.47130024 | 0.02213981 | 1093 | UTRN-16 | 10 | SK-N-AS | 96 | qRTPCR |
| 313770 | UTRN-01 m01 | 0.60984478 | 0.06309994 | 1093 | UTRN-16 | 30 | SK-N-AS | 96 | qRTPCR |
| 5776 | UTRN-02 m01 | 0.89147593 | 0.13375976 | 1093 | UTRN-16 | 30 | SK-N-AS | 96 | qRTPCR |
| 5781 | UTRN-03 m01 | 0.61855672 | 0.02207853 | 1093 | UTRN-16 | 30 | SK-N-AS | 96 | qRTPCR |
| 32192 | UTRN-04 m01 | 1.28418183 | 0.15451636 | 1093 | UTRN-16 | 30 | SK-N-AS | 96 | qRTPCR |
| 39558 | UTRN-05 m01 | 0.52634941 | 0.02812606 | 1093 | UTRN-16 | 30 | SK-N-AS | 96 | qRTPCR |
| 45784 | UTRN-06 m01 | 0.71111335 | 0.08563004 | 1093 | UTRN-16 | 30 | SK-N-AS | 96 | qRTPCR |
| 60002 | UTRN-07 m01 | 0.99729465 | 0.11235194 | 1093 | UTRN-16 | 30 | SK-N-AS | 96 | qRTPCR |
| 60035 | UTRN-08 m01 | 0.86387159 | 0.18316087 | 1093 | UTRN-16 | 30 | SK-N-AS | 96 | qRTPCR |
| 60038 | UTRN-09 m01 | 0.72007659 | 0.24804121 | 1093 | UTRN-16 | 30 | SK-N-AS | 96 | qRTPCR |
| 336679 | UTRN-10 m01 | 0.86416247 | 0.34064684 | 1093 | UTRN-16 | 30 | SK-N-AS | 96 | qRTPCR |
| 62709 | UTRN-11 m01 | 0.8083888 | 0.08325476 | 1093 | UTRN-16 | 30 | SK-N-AS | 96 | qRTPCR |
| 64394 | UTRN-12 m01 | 0.66395045 | 0.0899959 | 1093 | UTRN-16 | 30 | SK-N-AS | 96 | qRTPCR |
| 64407 | UTRN-13 m01 | 1.67089265 | 0.2291624 | 1093 | UTRN-16 | 30 | SK-N-AS | 96 | qRTPCR |
| 68368 | UTRN-14 m01 | 1.025824 | 0.22573532 | 1093 | UTRN-16 | 30 | SK-N-AS | 96 | qRTPCR |
| 68420 | UTRN-15 m01 | 0.73754467 | 0.09940368 | 1093 | UTRN-16 | 30 | SK-N-AS | 96 | qRTPCR |
| 68424 | UTRN-16 m01 | 0.94217145 | 0.1721728 | 1093 | UTRN-16 | 30 | SK-N-AS | 96 | qRTPCR |
| 82947 | UTRN-17 m01 | 0.58124677 | 0.04563767 | 1093 | UTRN-16 | 30 | SK-N-AS | 96 | qRTPCR |
| 85204 | UTRN-18 m01 | 0.61668486 | 0.05784673 | 1093 | UTRN-16 | 30 | SK-N-AS | 96 | qRTPCR |

TABLE 2-continued

Oligonucleotide sequences made for testing.

| SeqID | Oligo Name | Avg RQ | Avg RQ SE | Expt # | Target | [oligo] | cell line | Time (hr) | Assay Type |
|---|---|---|---|---|---|---|---|---|---|
| 89541 | UTRN-19 m01 | 0.54982484 | 0.09185093 | 1093 | UTRN-16 | 30 | SK-N-AS | 96 | qRTPCR |
| 355024 | UTRN-20 m01 | 0.67455874 | 0.19009293 | 1093 | UTRN-16 | 30 | SK-N-AS | 96 | qRTPCR |
| 99210 | UTRN-21 m01 | 0.58343685 | 0.04620854 | 1093 | UTRN-16 | 30 | SK-N-AS | 96 | qRTPCR |
| 101919 | UTRN-22 m01 | 1.48440599 | 0.26778843 | 1093 | UTRN-16 | 30 | SK-N-AS | 96 | qRTPCR |
| 101994 | UTRN-23 m01 | 0.81907189 | 0.0273814 | 1093 | UTRN-16 | 30 | SK-N-AS | 96 | qRTPCR |
| 103832 | UTRN-24 m01 | 1.25868392 | 0.17591054 | 1093 | UTRN-16 | 30 | SK-N-AS | 96 | qRTPCR |
| 103833 | UTRN-25 m01 | 1.0311567 | 0.11744487 | 1093 | UTRN-16 | 30 | SK-N-AS | 96 | qRTPCR |
| 103853 | UTRN-26 m01 | 0.72249989 | 0.11346444 | 1093 | UTRN-16 | 30 | SK-N-AS | 96 | qRTPCR |
| 103933 | UTRN-27 m01 | 1.18559662 | 0.06292947 | 1093 | UTRN-16 | 30 | SK-N-AS | 96 | qRTPCR |
| 117420 | UTRN-28 m01 | 1.61312748 | 0.02476836 | 1093 | UTRN-16 | 30 | SK-N-AS | 96 | qRTPCR |
| 120115 | UTRN-29 m01 | 1.0051088 | 0.15356527 | 1093 | UTRN-16 | 30 | SK-N-AS | 96 | qRTPCR |
| 120121 | UTRN-30 m01 | 0.92694391 | 0.13136339 | 1093 | UTRN-16 | 30 | SK-N-AS | 96 | qRTPCR |
|  | Ctrl Un | 1.05582073 | 0.16466874 | 1093 | UTRN-16 | 30 | SK-N-AS | 96 | qRTPCR |
|  | Ctrl Lipo | 1 | 0.101077 | 1093 | UTRN-16 | 30 | SK-N-AS | 96 | qRTPCR |
| 362061 | UTRN-31 m01 | 0.50511184 | 0.01784854 | 1093 | UTRN-16 | 30 | SK-N-AS | 96 | qRTPCR |
| 372488 | UTRN-32 m01 | 0.80809669 | 0.00211969 | 1093 | UTRN-16 | 30 | SK-N-AS | 96 | qRTPCR |
| 372542 | UTRN-33 m01 | 0.65771104 | 0.06565461 | 1093 | UTRN-16 | 30 | SK-N-AS | 96 | qRTPCR |
| 376352 | UTRN-34 m01 | 0.5431115 | 0.02628406 | 1093 | UTRN-16 | 30 | SK-N-AS | 96 | qRTPCR |
| 139243 | UTRN-35 m01 | 0.56264098 | 0.05675936 | 1093 | UTRN-16 | 30 | SK-N-AS | 96 | qRTPCR |
| 143189 | UTRN-36 m01 | 0.57779435 | 0.02631325 | 1093 | UTRN-16 | 30 | SK-N-AS | 96 | qRTPCR |
| 151630 | UTRN-37 m01 | 0.50337944 | 0.05884767 | 1093 | UTRN-16 | 30 | SK-N-AS | 96 | qRTPCR |
| 166370 | UTRN-38 m01 | 0.32025952 | 0.01286791 | 1093 | UTRN-16 | 30 | SK-N-AS | 96 | qRTPCR |
| 166372 | UTRN-39 m01 | 0.60714523 | 0.02373014 | 1093 | UTRN-16 | 30 | SK-N-AS | 96 | qRTPCR |
| 169368 | UTRN-40 m01 | 1.12335489 | 0.19727474 | 1093 | UTRN-16 | 30 | SK-N-AS | 96 | qRTPCR |
| 399345 | UTRN-41 m01 | 0.49256976 | 0.04675795 | 1093 | UTRN-16 | 30 | SK-N-AS | 96 | qRTPCR |
| 412519 | UTRN-42 m01 | 0.68909557 | 0.03904239 | 1093 | UTRN-16 | 30 | SK-N-AS | 96 | qRTPCR |
| 412600 | UTRN-43 m01 | 0.96488878 | 0.20588734 | 1093 | UTRN-16 | 30 | SK-N-AS | 96 | qRTPCR |
| 414862 | UTRN-44 m01 | 0.52495952 | 0.08382155 | 1093 | UTRN-16 | 30 | SK-N-AS | 96 | qRTPCR |
| 195707 | UTRN-45 m01 | 0.73795336 | 0.05541599 | 1093 | UTRN-16 | 30 | SK-N-AS | 96 | qRTPCR |
| 422943 | UTRN-46 m01 | 0.74085667 | 0.06637287 | 1093 | UTRN-16 | 30 | SK-N-AS | 96 | qRTPCR |
| 422946 | UTRN-47 m01 | 0.42761568 | 0.01772915 | 1093 | UTRN-16 | 30 | SK-N-AS | 96 | qRTPCR |
| 210674 | UTRN-48 m01 | 0.58780787 | 0.02910385 | 1093 | UTRN-16 | 30 | SK-N-AS | 96 | qRTPCR |
| 426032 | UTRN-49 m01 | 0.7296564 | 0.02867856 | 1093 | UTRN-16 | 30 | SK-N-AS | 96 | qRTPCR |
| 225629 | UTRN-50 m01 | 0.40395121 | 0.03201391 | 1093 | UTRN-16 | 30 | SK-N-AS | 96 | qRTPCR |
| 225662 | UTRN-51 m01 | 0.83099737 | 0.12029916 | 1093 | UTRN-16 | 30 | SK-N-AS | 96 | qRTPCR |
| 229456 | UTRN-52 m01 | 0.77073083 | 0.16512396 | 1093 | UTRN-16 | 30 | SK-N-AS | 96 | qRTPCR |
| 436557 | UTRN-53 m01 | 0.48278404 | 0.01573001 | 1093 | UTRN-16 | 30 | SK-N-AS | 96 | qRTPCR |

TABLE 2-continued

Oligonucleotide sequences made for testing.

| SeqID | Oligo Name | Avg RQ | Avg RQ SE | Expt # | Target | [oligo] | cell line | Time (hr) | Assay Type |
|---|---|---|---|---|---|---|---|---|---|
| 238467 | UTRN-54 m01 | 0.49363203 | 0.08427735 | 1093 | UTRN-16 | 30 | SK-N-AS | 96 | qRTPCR |
| 242264 | UTRN-55 m01 | 0.69749568 | 0.03277514 | 1093 | UTRN-16 | 30 | SK-N-AS | 96 | qRTPCR |
| 251939 | UTRN-56 m01 | 0.59481116 | 0.07476238 | 1093 | UTRN-16 | 30 | SK-N-AS | 96 | qRTPCR |
| 453443 | UTRN-57 m01 | 1.08275204 | 0.0676891 | 1093 | UTRN-16 | 30 | SK-N-AS | 96 | qRTPCR |
| 453483 | UTRN-58 m01 | 0.37405908 | 0.03151226 | 1093 | UTRN-16 | 30 | SK-N-AS | 96 | qRTPCR |
| 456038 | UTRN-59 m01 | 0.34267879 | 0.04428324 | 1093 | UTRN-16 | 30 | SK-N-AS | 96 | qRTPCR |
| 272301 | UTRN-60 m01 | 0.77142847 | 0.04819709 | 1093 | UTRN-16 | 30 | SK-N-AS | 96 | qRTPCR |
|  | Ctrl Un | 0.77092848 | 0.16407024 | 1093 | UTRN-16 | 30 | SK-N-AS | 96 | qRTPCR |
|  | Ctrl Lipo | 1 | 0.1342955 | 1093 | UTRN-16 | 30 | SK-N-AS | 96 | qRTPCR |
| 276749 | UTRN-61 m01 | 0.65483288 | 0.07342203 | 1093 | UTRN-16 | 30 | SK-N-AS | 96 | qRTPCR |
| 289697 | UTRN-62 m01 | 0.98337602 | 0.13676097 | 1093 | UTRN-16 | 30 | SK-N-AS | 96 | qRTPCR |
| 292490 | UTRN-63 m01 | 2.58061127 | 0.15400488 | 1093 | UTRN-16 | 30 | SK-N-AS | 96 | qRTPCR |
| 292535 | UTRN-64 m01 | 0.88372096 | 0.03014721 | 1093 | UTRN-16 | 30 | SK-N-AS | 96 | qRTPCR |
| 292541 | UTRN-65 m01 | 0.9736869 | 0.04890107 | 1093 | UTRN-16 | 30 | SK-N-AS | 96 | qRTPCR |
|  | Ctrl Lipo | 1 | 0.08104028 | 1093 | UTRN-16 | 30 | SK-N-AS | 96 | qRTPCR |
|  | Ctrl Un | 1.20258604 | 0.15138558 | 1093 | UTRN-16 | 30 | SK-N-AS | 96 | qRTPCR |
| 313770 | UTRN-01 m01 | 0.32616792 | 0.02185726 | 1094 | UTRN-16 | 50 | am002fDMD | 96 | qRTPCR |
| 5776 | UTRN-02 m01 | 1.01669863 | 0.0462533 | 1094 | UTRN-16 | 50 | am002fDMD | 96 | qRTPCR |
| 5781 | UTRN-03 m01 | 0.70233657 | 0.0250169 | 1094 | UTRN-16 | 50 | am002fDMD | 96 | qRTPCR |
| 32192 | UTRN-04 m01 | 1.59956172 | 0.13696613 | 1094 | UTRN-16 | 50 | am002fDMD | 96 | qRTPCR |
| 39558 | UTRN-05 m01 | 0.58957401 | 0.02802524 | 1094 | UTRN-16 | 50 | am002fDMD | 96 | qRTPCR |
| 45784 | UTRN-06 m01 | 1.0334611 | 0.00777542 | 1094 | UTRN-16 | 50 | am002fDMD | 96 | qRTPCR |
| 60002 | UTRN-07 m01 | 0.76143058 | 0.02768371 | 1094 | UTRN-16 | 50 | am002fDMD | 96 | qRTPCR |
| 60035 | UTRN-08 m01 | 0.39512861 | 0.00936128 | 1094 | UTRN-16 | 50 | am002fDMD | 96 | qRTPCR |
| 60038 | UTRN-09 m01 | 0.34012174 | 0.01623502 | 1094 | UTRN-16 | 50 | am002fDMD | 96 | qRTPCR |
| 336679 | UTRN-10 m01 | 0.38868099 | 0.01886348 | 1094 | UTRN-16 | 50 | am002fDMD | 96 | qRTPCR |
| 62709 | UTRN-11 m01 | 0.50986245 | 0.03047854 | 1094 | UTRN-16 | 50 | am002fDMD | 96 | qRTPCR |
| 64394 | UTRN-12 m01 | 0.60028491 | 0.00721445 | 1094 | UTRN-16 | 50 | am002fDMD | 96 | qRTPCR |
| 64407 | UTRN-13 m01 | 0.72114801 | 0.0075241 | 1094 | UTRN-16 | 50 | am002fDMD | 96 | qRTPCR |
| 68368 | UTRN-14 m01 | 1.12622763 | 0.03367478 | 1094 | UTRN-16 | 50 | am002fDMD | 96 | qRTPCR |
| 68420 | UTRN-15 m01 | 0.53891452 | 0.01936459 | 1094 | UTRN-16 | 50 | am002fDMD | 96 | qRTPCR |
| 68424 | UTRN-16 m01 | 1.11183444 | 0.04790854 | 1094 | UTRN-16 | 50 | am002fDMD | 96 | qRTPCR |
| 82947 | UTRN-17 m01 | 0.82497461 | 0.03386966 | 1094 | UTRN-16 | 50 | am002fDMD | 96 | qRTPCR |
| 85204 | UTRN-18 m01 | 0.79359523 | 0.03608986 | 1094 | UTRN-16 | 50 | am002fDMD | 96 | qRTPCR |
| 89541 | UTRN-19 m01 | 0.28545383 | 0.01787595 | 1094 | UTRN-16 | 50 | am002fDMD | 96 | qRTPCR |
| 355024 | UTRN-20 m01 | 0.92181838 | 0.08353234 | 1094 | UTRN-16 | 50 | am002fDMD | 96 | qRTPCR |
| 99210 | UTRN-21 m01 | 0.64207739 | 0.02593464 | 1094 | UTRN-16 | 50 | am002fDMD | 96 | qRTPCR |

TABLE 2-continued

Oligonucleotide sequences made for testing.

| SeqID | Oligo Name | Avg RQ | Avg RQ SE | Expt # | Target | [oligo] | cell line | Time (hr) | Assay Type |
|---|---|---|---|---|---|---|---|---|---|
| 101919 | UTRN-22 m01 | 1.37266809 | 0.03108759 | 1094 | UTRN-16 | 50 | am002fDMD | 96 | qRTPCR |
| 101994 | UTRN-23 m01 | 0.58216388 | 0.02158436 | 1094 | UTRN-16 | 50 | am002fDMD | 96 | qRTPCR |
| 103832 | UTRN-24 m01 | 1.45704637 | 0.04091926 | 1094 | UTRN-16 | 50 | am002fDMD | 96 | qRTPCR |
| 276749 | UTRN-61 m01 | 0.62942509 | 0.01705386 | 1094 | UTRN-16 | 50 | am002fDMD | 96 | qRTPCR |
| 289697 | UTRN-62 m01 | 1.01437442 | 0.08211814 | 1094 | UTRN-16 | 50 | am002fDMD | 96 | qRTPCR |
| 292490 | UTRN-63 m01 | 1.4085666 | 0.13479916 | 1094 | UTRN-16 | 50 | am002fDMD | 96 | qRTPCR |
| 292535 | UTRN-64 m01 | 0.58443353 | 0.02574256 | 1094 | UTRN-16 | 50 | am002fDMD | 96 | qRTPCR |
| 292541 | UTRN-65 m01 | 0.44749637 | 0.019656 | 1094 | UTRN-16 | 50 | am002fDMD | 96 | qRTPCR |
|  | Ctrl Un | 1.29398342 | 0.010621 | 1094 | UTRN-16 | 50 | am002fDMD | 96 | qRTPCR |
|  | Ctrl Lipo | 1 | 0.0266363 | 1094 | UTRN-16 | 50 | am002fDMD | 96 | qRTPCR |
| 313770 | UTRN-01 m01 | 0.20006344 | 0.04798471 | 1094 | UTRN-69 | 50 | am002fDMD | 96 | qRTPCR |
| 5776 | UTRN-02 m01 | 0.37542754 | 0.06857096 | 1094 | UTRN-69 | 50 | am002fDMD | 96 | qRTPCR |
| 5781 | UTRN-03 m01 | 0.31832193 | 0.05945466 | 1094 | UTRN-69 | 50 | am002fDMD | 96 | qRTPCR |
| 32192 | UTRN-04 m01 | 1.03183123 | 0.08239389 | 1094 | UTRN-69 | 50 | am002fDMD | 96 | qRTPCR |
| 39558 | UTRN-05 m01 | 0.9687712 | 0.03993136 | 1094 | UTRN-69 | 50 | am002fDMD | 96 | qRTPCR |
| 45784 | UTRN-06 m01 | 0.8351518 | 0.0399697 | 1094 | UTRN-69 | 50 | am002fDMD | 96 | qRTPCR |
| 60002 | UTRN-07 m01 | 0.4479661 | 0.02933481 | 1094 | UTRN-69 | 50 | am002fDMD | 96 | qRTPCR |
| 60035 | UTRN-08 m01 | 0.52003364 | 0.01872176 | 1094 | UTRN-69 | 50 | am002fDMD | 96 | qRTPCR |
| 60038 | UTRN-09 m01 | 0.32456103 | 0.01192516 | 1094 | UTRN-69 | 50 | am002fDMD | 96 | qRTPCR |
| 336679 | UTRN-10 m01 | 0.58129219 | 0.02357231 | 1094 | UTRN-69 | 50 | am002fDMD | 96 | qRTPCR |
| 62709 | UTRN-11 m01 | 0.49243556 | 0.02066544 | 1094 | UTRN-69 | 50 | am002fDMD | 96 | qRTPCR |
| 64394 | UTRN-12 m01 | 0.63143665 | 0.03874973 | 1094 | UTRN-69 | 50 | am002fDMD | 96 | qRTPCR |
| 64407 | UTRN-13 m01 | 1.14355459 | 0.05682408 | 1094 | UTRN-69 | 50 | am002fDMD | 96 | qRTPCR |
| 68368 | UTRN-14 m01 | 0.42045044 | 0.05763665 | 1094 | UTRN-69 | 50 | am002fDMD | 96 | qRTPCR |
| 68420 | UTRN-15 m01 | 0.68441644 | 0.05478663 | 1094 | UTRN-69 | 50 | am002fDMD | 96 | qRTPCR |
| 68424 | UTRN-16 m01 | 0.58821005 | 0.04014146 | 1094 | UTRN-69 | 50 | am002fDMD | 96 | qRTPCR |
| 82947 | UTRN-17 m01 | 0.36863122 | 0.03598423 | 1094 | UTRN-69 | 50 | am002fDMD | 96 | qRTPCR |
| 85204 | UTRN-18 m01 | 0.66171976 | 0.0178607 | 1094 | UTRN-69 | 50 | am002fDMD | 96 | qRTPCR |
| 89541 | UTRN-19 m01 | 0.11822583 | 0.01493743 | 1094 | UTRN-69 | 50 | am002fDMD | 96 | qRTPCR |
| 355024 | UTRN-20 m01 | 0.70082483 | 0.07992993 | 1094 | UTRN-69 | 50 | am002fDMD | 96 | qRTPCR |
| 99210 | UTRN-21 m01 | 0.71340219 | 0.05198843 | 1094 | UTRN-69 | 50 | am002fDMD | 96 | qRTPCR |
| 101919 | UTRN-22 m01 | 0.45449951 | 0.04236762 | 1094 | UTRN-69 | 50 | am002fDMD | 96 | qRTPCR |
| 101994 | UTRN-23 m01 | 0.63994873 | 0.02817303 | 1094 | UTRN-69 | 50 | am002fDMD | 96 | qRTPCR |
| 103832 | UTRN-24 m01 | 0.88092337 | 0.05871034 | 1094 | UTRN-69 | 50 | am002fDMD | 96 | qRTPCR |
| 276749 | UTRN-61 m01 | 0.23006675 | 0.03780199 | 1094 | UTRN-69 | 50 | am002fDMD | 96 | qRTPCR |
| 289697 | UTRN-62 m01 | 1.12844673 | 0.17967005 | 1094 | UTRN-69 | 50 | am002fDMD | 96 | qRTPCR |
| 292490 | UTRN-63 m01 | 0.18433323 | 0.03485563 | 1094 | UTRN-69 | 50 | am002fDMD | 96 | qRTPCR |

TABLE 2-continued

Oligonucleotide sequences made for testing.

| SeqID | Oligo Name | Avg RQ | Avg RQ SE | Expt # | Target | [oligo] | cell line | Time (hr) | Assay Type |
|---|---|---|---|---|---|---|---|---|---|
| 292535 | UTRN-64 m01 | 0.17433798 | 0.01365184 | 1094 | UTRN-69 | 50 | am002fDMD | 96 | qRTPCR |
| 292541 | UTRN-65 m01 | 0.50196292 | 0.0491373 | 1094 | UTRN-69 | 50 | am002fDMD | 96 | qRTPCR |
| | Ctrl Un | 2.13645092 | 0.09730565 | 1094 | UTRN-69 | 50 | am002fDMD | 96 | qRTPCR |
| | Ctrl Lipo | 1 | 0.10157931 | 1094 | UTRN-69 | 50 | am002fDMD | 96 | qRTPCR |
| 313770 | UTRN-01 m01 | 0.27016057 | 0.0537116 | 1094 | UTRN-02 | 50 | am002fDMD | 96 | qRTPCR |
| 5776 | UTRN-02 m01 | 0.43755894 | 0.05761395 | 1094 | UTRN-02 | 50 | am002fDMD | 96 | qRTPCR |
| 5781 | UTRN-03 m01 | 0.41249459 | 0.02943631 | 1094 | UTRN-02 | 50 | am002fDMD | 96 | qRTPCR |
| 32192 | UTRN-04 m01 | 1.11519083 | 0.07430174 | 1094 | UTRN-02 | 50 | am002fDMD | 96 | qRTPCR |
| 39558 | UTRN-05 m01 | 1.01159292 | 0.0262187 | 1094 | UTRN-02 | 50 | am002fDMD | 96 | qRTPCR |
| 45784 | UTRN-06 m01 | 0.89969233 | 0.01062374 | 1094 | UTRN-02 | 50 | am002fDMD | 96 | qRTPCR |
| 60002 | UTRN-07 m01 | 0.55175558 | 0.04881093 | 1094 | UTRN-02 | 50 | am002fDMD | 96 | qRTPCR |
| 60035 | UTRN-08 m01 | 0.5822559 | 0.03667059 | 1094 | UTRN-02 | 50 | am002fDMD | 96 | qRTPCR |
| 60038 | UTRN-09 m01 | 0.35245532 | 0.04133 | 1094 | UTRN-02 | 50 | am002fDMD | 96 | qRTPCR |
| 336679 | UTRN-10 m01 | 0.55047495 | 0.02207268 | 1094 | UTRN-02 | 50 | am002fDMD | 96 | qRTPCR |
| 62709 | UTRN-11 m01 | 0.41783956 | 0.0209482 | 1094 | UTRN-02 | 50 | am002fDMD | 96 | qRTPCR |
| 64394 | UTRN-12 m01 | 0.53338875 | 0.0270747 | 1094 | UTRN-02 | 50 | am002fDMD | 96 | qRTPCR |
| 64407 | UTRN-13 m01 | 1.17230576 | 0.08108839 | 1094 | UTRN-02 | 50 | am002fDMD | 96 | qRTPCR |
| 68368 | UTRN-14 m01 | 0.54787389 | 0.09693453 | 1094 | UTRN-02 | 50 | am002fDMD | 96 | qRTPCR |
| 68420 | UTRN-15 m01 | 0.71271868 | 0.06754801 | 1094 | UTRN-02 | 50 | am002fDMD | 96 | qRTPCR |
| 68424 | UTRN-16 m01 | 0.29579555 | 0.02408746 | 1094 | UTRN-02 | 50 | am002fDMD | 96 | qRTPCR |
| 82947 | UTRN-17 m01 | 0.36760298 | 0.03225722 | 1094 | UTRN-02 | 50 | am002fDMD | 96 | qRTPCR |
| 85204 | UTRN-18 m01 | 0.71687906 | 0.02515345 | 1094 | UTRN-02 | 50 | am002fDMD | 96 | qRTPCR |
| 89541 | UTRN-19 m01 | 0.1380875 | 0.01926532 | 1094 | UTRN-02 | 50 | am002fDMD | 96 | qRTPCR |
| 355024 | UTRN-20 m01 | 0.7078851 | 0.04532949 | 1094 | UTRN-02 | 50 | am002fDMD | 96 | qRTPCR |
| 99210 | UTRN-21 m01 | 0.68991983 | 0.03857872 | 1094 | UTRN-02 | 50 | am002fDMD | 96 | qRTPCR |
| 101919 | UTRN-22 m01 | 0.49654219 | 0.05756049 | 1094 | UTRN-02 | 50 | am002fDMD | 96 | qRTPCR |
| 101994 | UTRN-23 m01 | 0.64166664 | 0.03200979 | 1094 | UTRN-02 | 50 | am002fDMD | 96 | qRTPCR |
| 103832 | UTRN-24 m01 | 0.86083828 | 0.08223742 | 1094 | UTRN-02 | 50 | am002fDMD | 96 | qRTPCR |
| 276749 | UTRN-61 m01 | 0.36924754 | 0.03271067 | 1094 | UTRN-02 | 50 | am002fDMD | 96 | qRTPCR |
| 289697 | UTRN-62 m01 | 1.30122081 | 0.21051853 | 1094 | UTRN-02 | 50 | am002fDMD | 96 | qRTPCR |
| 292490 | UTRN-63 m01 | 0.24329494 | 0.01817197 | 1094 | UTRN-02 | 50 | am002fDMD | 96 | qRTPCR |
| 292535 | UTRN-64 m01 | 0.17744299 | 0.01532655 | 1094 | UTRN-02 | 50 | am002fDMD | 96 | qRTPCR |
| 292541 | UTRN-65 m01 | 0.55237323 | 0.01848998 | 1094 | UTRN-02 | 50 | am002fDMD | 96 | qRTPCR |
| | Ctrl Un | 2.36606122 | 0.10116289 | 1094 | UTRN-02 | 50 | am002fDMD | 96 | qRTPCR |
| | Ctrl Lipo | 1 | 0.07587432 | 1094 | UTRN-02 | 50 | am002fDMD | 96 | qRTPCR |
| 313770 | UTRN-01 m01 | 0.23166392 | 0.03986326 | 1095 | UTRN-16 | 50 | am002fDMD | 168 | qRTPCR |
| 5776 | UTRN-02 m01 | 0.7562623 | 0.03218152 | 1095 | UTRN-16 | 50 | am002fDMD | 168 | qRTPCR |

TABLE 2-continued

Oligonucleotide sequences made for testing.

| SeqID | Oligo Name | Avg RQ | Avg RQ SE | Expt # | Target | [oligo] | cell line | Time (hr) | Assay Type |
|---|---|---|---|---|---|---|---|---|---|
| 5781 | UTRN-03 m01 | 0.68206196 | 0.07354295 | 1095 | UTRN-16 | 50 | am002fDMD | 168 | qRTPCR |
| 32192 | UTRN-04 m01 | 1.38957133 | 0.07032511 | 1095 | UTRN-16 | 50 | am002fDMD | 168 | qRTPCR |
| 39558 | UTRN-05 m01 | 0.77569544 | 0.02262853 | 1095 | UTRN-16 | 50 | am002fDMD | 168 | qRTPCR |
| 45784 | UTRN-06 m01 | 1.43617331 | 0.02530774 | 1095 | UTRN-16 | 50 | am002fDMD | 168 | qRTPCR |
| 60002 | UTRN-07 m01 | 0.99220334 | 0.07921071 | 1095 | UTRN-16 | 50 | am002fDMD | 168 | qRTPCR |
| 60035 | UTRN-08 m01 | 0.46517717 | 0.03573208 | 1095 | UTRN-16 | 50 | am002fDMD | 168 | qRTPCR |
| 60038 | UTRN-09 m01 | 0.46125504 | 0.00935883 | 1095 | UTRN-16 | 50 | am002fDMD | 168 | qRTPCR |
| 336679 | UTRN-10 m01 | 0.68754121 | 0.02920918 | 1095 | UTRN-16 | 50 | am002fDMD | 168 | qRTPCR |
| 62709 | UTRN-11 m01 | 0.60949652 | 0.06010728 | 1095 | UTRN-16 | 50 | am002fDMD | 168 | qRTPCR |
| 64394 | UTRN-12 m01 | 0.44118491 | 0.01910906 | 1095 | UTRN-16 | 50 | am002fDMD | 168 | qRTPCR |
| 64407 | UTRN-13 m01 | 1.03529403 | 0.07129539 | 1095 | UTRN-16 | 50 | am002fDMD | 168 | qRTPCR |
| 68368 | UTRN-14 m01 | 0.99785237 | 0.00277169 | 1095 | UTRN-16 | 50 | am002fDMD | 168 | qRTPCR |
| 68420 | UTRN-15 m01 | 0.58229001 | 0.03433043 | 1095 | UTRN-16 | 50 | am002fDMD | 168 | qRTPCR |
| 68424 | UTRN-16 m01 | 1.07785244 | 0.05088514 | 1095 | UTRN-16 | 50 | am002fDMD | 168 | qRTPCR |
| 82947 | UTRN-17 m01 | 1.13308849 | 0.08727186 | 1095 | UTRN-16 | 50 | am002fDMD | 168 | qRTPCR |
| 85204 | UTRN-18 m01 | 0.88827948 | 0.02553011 | 1095 | UTRN-16 | 50 | am002fDMD | 168 | qRTPCR |
| 89541 | UTRN-19 m01 | 0.43785575 | 0.03625092 | 1095 | UTRN-16 | 50 | am002fDMD | 168 | qRTPCR |
| 355024 | UTRN-20 m01 | 1.03615197 | 0.10728058 | 1095 | UTRN-16 | 50 | am002fDMD | 168 | qRTPCR |
| 99210 | UTRN-21 m01 | 0.8493589 | 0.02109217 | 1095 | UTRN-16 | 50 | am002fDMD | 168 | qRTPCR |
| 101919 | UTRN-22 m01 | 1.13406358 | 0.07848721 | 1095 | UTRN-16 | 50 | am002fDMD | 168 | qRTPCR |
| 101994 | UTRN-23 m01 | 0.78537651 | 0.03787308 | 1095 | UTRN-16 | 50 | am002fDMD | 168 | qRTPCR |
| 103832 | UTRN-24 m01 | 1.57959387 | 0.02118097 | 1095 | UTRN-16 | 50 | am002fDMD | 168 | qRTPCR |
| 276749 | UTRN-61 m01 | 0.27696413 | 0.0278247 | 1095 | UTRN-16 | 50 | am002fDMD | 168 | qRTPCR |
| 289697 | UTRN-62 m01 | 1.02583443 | 0.09132877 | 1095 | UTRN-16 | 50 | am002fDMD | 168 | qRTPCR |
| 292490 | UTRN-63 m01 | 1.36321054 | 0.02279074 | 1095 | UTRN-16 | 50 | am002fDMD | 168 | qRTPCR |
| 292535 | UTRN-64 m01 | 0.80272169 | 0.03558919 | 1095 | UTRN-16 | 50 | am002fDMD | 168 | qRTPCR |
| 292541 | UTRN-65 m01 | 0.45138121 | 0.03952107 | 1095 | UTRN-16 | 50 | am002fDMD | 168 | qRTPCR |
|  | Ctrl Un | 1.05925262 | 0.05760247 | 1095 | UTRN-16 | 50 | am002fDMD | 168 | qRTPCR |
|  | Ctrl Lipo | 1 | 0.03057386 | 1095 | UTRN-16 | 50 | am002fDMD | 168 | qRTPCR |
| 313770 | UTRN-01 m01 | 0.75055397 | 0.05191791 | 1096 | UTRN-16 | 30 | am002fDMD | 240 | qRTPCR |
| 5776 | UTRN-02 m01 | 0.93267894 | 0.08361127 | 1096 | UTRN-16 | 30 | am002fDMD | 240 | qRTPCR |
| 5781 | UTRN-03 m01 | 0.8459375 | 0.06898479 | 1096 | UTRN-16 | 30 | am002fDMD | 240 | qRTPCR |
| 32192 | UTRN-04 m01 | 0.94806881 | 0.00727076 | 1096 | UTRN-16 | 30 | am002fDMD | 240 | qRTPCR |
| 39558 | UTRN-05 m01 | 0.85548543 | 0.02685995 | 1096 | UTRN-16 | 30 | am002fDMD | 240 | qRTPCR |
| 45784 | UTRN-06 m01 | 0.87672297 | 0.08588369 | 1096 | UTRN-16 | 30 | am002fDMD | 240 | qRTPCR |
| 60002 | UTRN-07 m01 | 0.91923287 | 0.03761358 | 1096 | UTRN-16 | 30 | am002fDMD | 240 | qRTPCR |
| 60035 | UTRN-08 m01 | 0.85268562 | 0.01765621 | 1096 | UTRN-16 | 30 | am002fDMD | 240 | qRTPCR |

TABLE 2-continued

Oligonucleotide sequences made for testing.

| SeqID | Oligo Name | Avg RQ | Avg RQ SE | Expt # | Target | [oligo] | cell line | Time (hr) | Assay Type |
|---|---|---|---|---|---|---|---|---|---|
| 60038 | UTRN-09 m01 | 0.75596914 | 0.03631143 | 1096 | UTRN-16 | 30 | am002fDMD | 240 | qRTPCR |
| 336679 | UTRN-10 m01 | 0.84641568 | 0.10152635 | 1096 | UTRN-16 | 30 | am002fDMD | 240 | qRTPCR |
| 62709 | UTRN-11 m01 | 0.69695309 | 0.030787 | 1096 | UTRN-16 | 30 | am002fDMD | 240 | qRTPCR |
| 64394 | UTRN-12 m01 | 0.76327696 | 0.0411056 | 1096 | UTRN-16 | 30 | am002fDMD | 240 | qRTPCR |
| 64407 | UTRN-13 m01 | 0.82172428 | 0.0442925 | 1096 | UTRN-16 | 30 | am002fDMD | 240 | qRTPCR |
| 68368 | UTRN-14 m01 | 0.76537362 | 0.01850598 | 1096 | UTRN-16 | 30 | am002fDMD | 240 | qRTPCR |
| 68420 | UTRN-15 m01 | 0.78252229 | 0.02222461 | 1096 | UTRN-16 | 30 | am002fDMD | 240 | qRTPCR |
| 68424 | UTRN-16 m01 | 0.90037016 | 0.04575544 | 1096 | UTRN-16 | 30 | am002fDMD | 240 | qRTPCR |
| 82947 | UTRN-17 m01 | 0.95908459 | 0.07317095 | 1096 | UTRN-16 | 30 | am002fDMD | 240 | qRTPCR |
| 85204 | UTRN-18 m01 | 0.80600073 | 0.05689405 | 1096 | UTRN-16 | 30 | am002fDMD | 240 | qRTPCR |
| 89541 | UTRN-19 m01 | 0.69083738 | 0.03483852 | 1096 | UTRN-16 | 30 | am002fDMD | 240 | qRTPCR |
| 355024 | UTRN-20 m01 | 0.82797369 | 0.07320327 | 1096 | UTRN-16 | 30 | am002fDMD | 240 | qRTPCR |
| 99210 | UTRN-21 m01 | 0.92794361 | 0.02909557 | 1096 | UTRN-16 | 30 | am002fDMD | 240 | qRTPCR |
| 101919 | UTRN-22 m01 | 0.79995775 | 0.06472403 | 1096 | UTRN-16 | 30 | am002fDMD | 240 | qRTPCR |
| 101994 | UTRN-23 m01 | 0.8039519 | 0.07619583 | 1096 | UTRN-16 | 30 | am002fDMD | 240 | qRTPCR |
| 103832 | UTRN-24 m01 | 0.83508016 | 0.02626351 | 1096 | UTRN-16 | 30 | am002fDMD | 240 | qRTPCR |
| 103833 | UTRN-25 m01 | 0.94466345 | 0.07750392 | 1096 | UTRN-16 | 30 | am002fDMD | 240 | qRTPCR |
| 103853 | UTRN-26 m01 | 0.80798364 | 0.03361172 | 1096 | UTRN-16 | 30 | am002fDMD | 240 | qRTPCR |
| 103933 | UTRN-27 m01 | 0.87984023 | 0.02147001 | 1096 | UTRN-16 | 30 | am002fDMD | 240 | qRTPCR |
| 117420 | UTRN-28 m01 | 0.7320572 | 0.07556 | 1096 | UTRN-16 | 30 | am002fDMD | 240 | qRTPCR |
| 120115 | UTRN-29 m01 | 1.13134523 | 0.02265497 | 1096 | UTRN-16 | 30 | am002fDMD | 240 | qRTPCR |
| 120121 | UTRN-30 m01 | 0.79490416 | 0.06953964 | 1096 | UTRN-16 | 30 | am002fDMD | 240 | qRTPCR |
|  | Ctrl Un | 0.84394069 | 0.04916997 | 1096 | UTRN-16 | 30 | am002fDMD | 240 | qRTPCR |
|  | Ctrl Lipo | 1 | 0.06926976 | 1096 | UTRN-16 | 30 | am002fDMD | 240 | qRTPCR |
| 362061 | UTRN-31 m01 | 0.9709284 | 0.01153552 | 1096 | UTRN-16 | 30 | am002fDMD | 240 | qRTPCR |
| 372488 | UTRN-32 m01 | 1.06867182 | 0.02106709 | 1096 | UTRN-16 | 30 | am002fDMD | 240 | qRTPCR |
| 372542 | UTRN-33 m01 | 1.082223 | 0.02532558 | 1096 | UTRN-16 | 30 | am002fDMD | 240 | qRTPCR |
| 376352 | UTRN-34 m01 | 1.00992377 | 0.06565572 | 1096 | UTRN-16 | 30 | am002fDMD | 240 | qRTPCR |
| 139243 | UTRN-35 m01 | 1.00400191 | 0.13229164 | 1096 | UTRN-16 | 30 | am002fDMD | 240 | qRTPCR |
| 143189 | UTRN-36 m01 | 1.15434692 | 0.08027218 | 1096 | UTRN-16 | 30 | am002fDMD | 240 | qRTPCR |
| 151630 | UTRN-37 m01 | 0.97730844 | 0.05076649 | 1096 | UTRN-16 | 30 | am002fDMD | 240 | qRTPCR |
| 166370 | UTRN-38 m01 | 1.12892012 | 0.07118998 | 1096 | UTRN-16 | 30 | am002fDMD | 240 | qRTPCR |
| 166372 | UTRN-39 m01 | 1.10114938 | 0.07594277 | 1096 | UTRN-16 | 30 | am002fDMD | 240 | qRTPCR |
| 169368 | UTRN-40 m01 | 1.21178408 | 0.08044384 | 1096 | UTRN-16 | 30 | am002fDMD | 240 | qRTPCR |
| 399345 | UTRN-41 m01 | 1.0417129 | 0.03344421 | 1096 | UTRN-16 | 30 | am002fDMD | 240 | qRTPCR |
| 412519 | UTRN-42 m01 | 1.07744408 | 0.06857424 | 1096 | UTRN-16 | 30 | am002fDMD | 240 | qRTPCR |
| 412600 | UTRN-43 m01 | 0.92457866 | 0.03195885 | 1096 | UTRN-16 | 30 | am002fDMD | 240 | qRTPCR |

TABLE 2-continued

Oligonucleotide sequences made for testing.

| SeqID | Oligo Name | Avg RQ | Avg RQ SE | Expt # | Target | [oligo] | cell line | Time (hr) | Assay Type |
|---|---|---|---|---|---|---|---|---|---|
| 414862 | UTRN-44 m01 | 1.05544115 | 0.03008245 | 1096 | UTRN-16 | 30 | am002fDMD | 240 | qRTPCR |
| 195707 | UTRN-45 m01 | 0.98052664 | 0.09092849 | 1096 | UTRN-16 | 30 | am002fDMD | 240 | qRTPCR |
| 422943 | UTRN-46 m01 | 1.09892513 | 0.01984604 | 1096 | UTRN-16 | 30 | am002fDMD | 240 | qRTPCR |
| 422946 | UTRN-47 m01 | 0.79497043 | 0.02489728 | 1096 | UTRN-16 | 30 | am002fDMD | 240 | qRTPCR |
| 210674 | UTRN-48 m01 | 0.88919709 | 0.0168988 | 1096 | UTRN-16 | 30 | am002fDMD | 240 | qRTPCR |
| 426032 | UTRN-49 m01 | 0.93048326 | 0.03028883 | 1096 | UTRN-16 | 30 | am002fDMD | 240 | qRTPCR |
| 225629 | UTRN-50 m01 | 0.99740207 | 0.0540456 | 1096 | UTRN-16 | 30 | am002fDMD | 240 | qRTPCR |
| 225662 | UTRN-51 m01 | 1.01445304 | 0.06092202 | 1096 | UTRN-16 | 30 | am002fDMD | 240 | qRTPCR |
| 229456 | UTRN-52 m01 | 1.07829975 | 0.09602393 | 1096 | UTRN-16 | 30 | am002fDMD | 240 | qRTPCR |
| 436557 | UTRN-53 m01 | 0.92243319 | 0.04950107 | 1096 | UTRN-16 | 30 | am002fDMD | 240 | qRTPCR |
| 238467 | UTRN-54 m01 | 1.04494704 | 0.08420687 | 1096 | UTRN-16 | 30 | am002fDMD | 240 | qRTPCR |
| 242264 | UTRN-55 m01 | 0.96138208 | 0.0238776 | 1096 | UTRN-16 | 30 | am002fDMD | 240 | qRTPCR |
| 251939 | UTRN-56 m01 | 0.91868951 | 0.02782373 | 1096 | UTRN-16 | 30 | am002fDMD | 240 | qRTPCR |
| 453443 | UTRN-57 m01 | 0.87955284 | 0.04179347 | 1096 | UTRN-16 | 30 | am002fDMD | 240 | qRTPCR |
| 453483 | UTRN-58 m01 | 0.9414369 | 0.05421194 | 1096 | UTRN-16 | 30 | am002fDMD | 240 | qRTPCR |
| 456038 | UTRN-59 m01 | 0.97625584 | 0.05408032 | 1096 | UTRN-16 | 30 | am002fDMD | 240 | qRTPCR |
| 272301 | UTRN-60 m01 | 1.23338031 | 0.11033036 | 1096 | UTRN-16 | 30 | am002fDMD | 240 | qRTPCR |
|  | Ctrl Un | 0.96551729 | 0.04747653 | 1096 | UTRN-16 | 30 | am002fDMD | 240 | qRTPCR |
|  | Ctrl Lipo | 1 | 0.0303013 | 1096 | UTRN-16 | 30 | am002fDMD | 240 | qRTPCR |
| 276749 | UTRN-61 m01 | 0.96970978 | 0.01935113 | 1096 | UTRN-16 | 30 | am002fDMD | 240 | qRTPCR |
| 289697 | UTRN-62 m01 | 1.10260017 | 0.06256634 | 1096 | UTRN-16 | 30 | am002fDMD | 240 | qRTPCR |
| 292490 | UTRN-63 m01 | 1.22965464 | 0.08170049 | 1096 | UTRN-16 | 30 | am002fDMD | 240 | qRTPCR |
| 292535 | UTRN-64 m01 | 1.14528961 | 0.02605831 | 1096 | UTRN-16 | 30 | am002fDMD | 240 | qRTPCR |
| 292541 | UTRN-65 m01 | 1.12304054 | 0.0494786 | 1096 | UTRN-16 | 30 | am002fDMD | 240 | qRTPCR |
|  | Ctrl Lipo | 1 | 0.0328001 | 1096 | UTRN-16 | 30 | am002fDMD | 240 | qRTPCR |
|  | Ctrl Un | 1.06036423 | 0.07916255 | 1096 | UTRN-16 | 30 | am002fDMD | 240 | qRTPCR |
| 313770 | UTRN-01 m01 | 0.67462825 | 0.08165038 | 1097 | UTRN-16 | 30 | am002fDMD | 144 | qRTPCR |
| 5776 | UTRN-02 m01 | 1.0040793 | 0.03792203 | 1097 | UTRN-16 | 30 | am002fDMD | 144 | qRTPCR |
| 5781 | UTRN-03 m01 | 1.05073108 | 0.06995556 | 1097 | UTRN-16 | 30 | am002fDMD | 144 | qRTPCR |
| 32192 | UTRN-04 m01 | 1.21889789 | 0.04939547 | 1097 | UTRN-16 | 30 | am002fDMD | 144 | qRTPCR |
| 39558 | UTRN-05 m01 | 0.97204726 | 0.02800328 | 1097 | UTRN-16 | 30 | am002fDMD | 144 | qRTPCR |
| 45784 | UTRN-06 m01 | 1.19749167 | 0.11502609 | 1097 | UTRN-16 | 30 | am002fDMD | 144 | qRTPCR |
| 60002 | UTRN-07 m01 | 1.05892638 | 0.03195538 | 1097 | UTRN-16 | 30 | am002fDMD | 144 | qRTPCR |
| 60035 | UTRN-08 m01 | 0.96059417 | 0.13090996 | 1097 | UTRN-16 | 30 | am002fDMD | 144 | qRTPCR |
| 60038 | UTRN-09 m01 | 0.79396118 | 0.02398773 | 1097 | UTRN-16 | 30 | am002fDMD | 144 | qRTPCR |
| 336679 | UTRN-10 m01 | 1.1137313 | 0.08926529 | 1097 | UTRN-16 | 30 | am002fDMD | 144 | qRTPCR |
| 62709 | UTRN-11 m01 | 1.03710375 | 0.02946032 | 1097 | UTRN-16 | 30 | am002fDMD | 144 | qRTPCR |

TABLE 2-continued

Oligonucleotide sequences made for testing.

| SeqID | Oligo Name | Avg RQ | Avg RQ SE | Expt # | Target | [oligo] | cell line | Time (hr) | Assay Type |
|---|---|---|---|---|---|---|---|---|---|
| 64394 | UTRN-12 m01 | 1.07733712 | 0.03880175 | 1097 | UTRN-16 | 30 | am002fDMD | 144 | qRTPCR |
| 64407 | UTRN-13 m01 | 1.11772016 | 0.04658961 | 1097 | UTRN-16 | 30 | am002fDMD | 144 | qRTPCR |
| 68368 | UTRN-14 m01 | 1.07447243 | 0.06712376 | 1097 | UTRN-16 | 30 | am002fDMD | 144 | qRTPCR |
| 68420 | UTRN-15 m01 | 1.10416183 | 0.01446185 | 1097 | UTRN-16 | 30 | am002fDMD | 144 | qRTPCR |
| 68424 | UTRN-16 m01 | 1.22784073 | 0.01283689 | 1097 | UTRN-16 | 30 | am002fDMD | 144 | qRTPCR |
| 82947 | UTRN-17 m01 | 1.13231879 | 0.02632991 | 1097 | UTRN-16 | 30 | am002fDMD | 144 | qRTPCR |
| 85204 | UTRN-18 m01 | 1.18971985 | 0.07744601 | 1097 | UTRN-16 | 30 | am002fDMD | 144 | qRTPCR |
| 89541 | UTRN-19 m01 | 1.06468745 | 0.04841277 | 1097 | UTRN-16 | 30 | am002fDMD | 144 | qRTPCR |
| 355024 | UTRN-20 m01 | 1.28469255 | 0.08438321 | 1097 | UTRN-16 | 30 | am002fDMD | 144 | qRTPCR |
| 99210 | UTRN-21 m01 | 1.2761479 | 0.02407821 | 1097 | UTRN-16 | 30 | am002fDMD | 144 | qRTPCR |
| 101919 | UTRN-22 m01 | 1.34357124 | 0.03731536 | 1097 | UTRN-16 | 30 | am002fDMD | 144 | qRTPCR |
| 101994 | UTRN-23 m01 | 0.95200968 | 0.03605078 | 1097 | UTRN-16 | 30 | am002fDMD | 144 | qRTPCR |
| 103832 | UTRN-24 m01 | 1.22036161 | 0.01059834 | 1097 | UTRN-16 | 30 | am002fDMD | 144 | qRTPCR |
| 103833 | UTRN-25 m01 | 1.26356309 | 0.09774877 | 1097 | UTRN-16 | 30 | am002fDMD | 144 | qRTPCR |
| 103853 | UTRN-26 m01 | 1.08808616 | 0.04569736 | 1097 | UTRN-16 | 30 | am002fDMD | 144 | qRTPCR |
| 103933 | UTRN-27 m01 | 1.03276149 | 0.04356174 | 1097 | UTRN-16 | 30 | am002fDMD | 144 | qRTPCR |
| 117420 | UTRN-28 m01 | 1.24524138 | 0.01823423 | 1097 | UTRN-16 | 30 | am002fDMD | 144 | qRTPCR |
| 120115 | UTRN-29 m01 | 1.39018159 | 0.02601533 | 1097 | UTRN-16 | 30 | am002fDMD | 144 | qRTPCR |
| 120121 | UTRN-30 m01 | 1.08224781 | 0.03837067 | 1097 | UTRN-16 | 30 | am002fDMD | 144 | qRTPCR |
|  | Ctrl Un | 1.03242662 | 0.04553206 | 1097 | UTRN-16 | 30 | am002fDMD | 144 | qRTPCR |
|  | Ctrl Lipo | 1 | 0.04378138 | 1097 | UTRN-16 | 30 | am002fDMD | 144 | qRTPCR |
| 362061 | UTRN-31 m01 | 0.76844471 | 0.02706795 | 1097 | UTRN-16 | 30 | am002fDMD | 144 | qRTPCR |
| 372488 | UTRN-32 m01 | 1.08294629 | 0.02698451 | 1097 | UTRN-16 | 30 | am002fDMD | 144 | qRTPCR |
| 372542 | UTRN-33 m01 | 1.41025624 | 0.02528352 | 1097 | UTRN-16 | 30 | am002fDMD | 144 | qRTPCR |
| 376352 | UTRN-34 m01 | 1.16630314 | 0.0576001 | 1097 | UTRN-16 | 30 | am002fDMD | 144 | qRTPCR |
| 139243 | UTRN-35 m01 | 0.91507564 | 0.03123946 | 1097 | UTRN-16 | 30 | am002fDMD | 144 | qRTPCR |
| 143189 | UTRN-36 m01 | 0.97742097 | 0.00384429 | 1097 | UTRN-16 | 30 | am002fDMD | 144 | qRTPCR |
| 151630 | UTRN-37 m01 | 1.13551038 | 0.02995458 | 1097 | UTRN-16 | 30 | am002fDMD | 144 | qRTPCR |
| 166370 | UTRN-38 m01 | 0.95864002 | 0.07166238 | 1097 | UTRN-16 | 30 | am002fDMD | 144 | qRTPCR |
| 166372 | UTRN-39 m01 | 1.0509856 | 0.01855711 | 1097 | UTRN-16 | 30 | am002fDMD | 144 | qRTPCR |
| 169368 | UTRN-40 m01 | 1.12206678 | 0.02649287 | 1097 | UTRN-16 | 30 | am002fDMD | 144 | qRTPCR |
| 399345 | UTRN-41 m01 | 1.11991272 | 0.04296588 | 1097 | UTRN-16 | 30 | am002fDMD | 144 | qRTPCR |
| 412519 | UTRN-42 m01 | 1.0642452 | 0.06414741 | 1097 | UTRN-16 | 30 | am002fDMD | 144 | qRTPCR |
| 412600 | UTRN-43 m01 | 1.09166311 | 0.03507153 | 1097 | UTRN-16 | 30 | am002fDMD | 144 | qRTPCR |
| 414862 | UTRN-44 m01 | 1.22016214 | 0.02217895 | 1097 | UTRN-16 | 30 | am002fDMD | 144 | qRTPCR |
| 195707 | UTRN-45 m01 | 1.17726461 | 0.01617406 | 1097 | UTRN-16 | 30 | am002fDMD | 144 | qRTPCR |
| 422943 | UTRN-46 m01 | 1.21931609 | 0.05796389 | 1097 | UTRN-16 | 30 | am002fDMD | 144 | qRTPCR |

TABLE 2-continued

Oligonucleotide sequences made for testing.

| SeqID | Oligo Name | Avg RQ | Avg RQ SE | Expt # | Target | [oligo] | cell line | Time (hr) | Assay Type |
|---|---|---|---|---|---|---|---|---|---|
| 422946 | UTRN-47 m01 | 1.09650056 | 0.07741785 | 1097 | UTRN-16 | 30 | am002fDMD | 144 | qRTPCR |
| 210674 | UTRN-48 m01 | 1.19915402 | 0.0338564 | 1097 | UTRN-16 | 30 | am002fDMD | 144 | qRTPCR |
| 426032 | UTRN-49 m01 | 1.1321997 | 0.03432322 | 1097 | UTRN-16 | 30 | am002fDMD | 144 | qRTPCR |
| 225629 | UTRN-50 m01 | 1.17482362 | 0.07479833 | 1097 | UTRN-16 | 30 | am002fDMD | 144 | qRTPCR |
| 225662 | UTRN-51 m01 | 0.86280779 | 0.0230224 | 1097 | UTRN-16 | 30 | am002fDMD | 144 | qRTPCR |
| 229456 | UTRN-52 m01 | 1.10025011 | 0.0429719 | 1097 | UTRN-16 | 30 | am002fDMD | 144 | qRTPCR |
| 436557 | UTRN-53 m01 | 1.01849372 | 0.02944671 | 1097 | UTRN-16 | 30 | am002fDMD | 144 | qRTPCR |
| 238467 | UTRN-54 m01 | 0.93011546 | 0.050621216 | 1097 | UTRN-16 | 30 | am002fDMD | 144 | qRTPCR |
| 242264 | UTRN-55 m01 | 0.9285505 | 0.02965249 | 1097 | UTRN-16 | 30 | am002fDMD | 144 | qRTPCR |
| 251939 | UTRN-56 m01 | 1.02614832 | 0.05760928 | 1097 | UTRN-16 | 30 | am002fDMD | 144 | qRTPCR |
| 453443 | UTRN-57 m01 | 0.99500772 | 0.00717961 | 1097 | UTRN-16 | 30 | am002fDMD | 144 | qRTPCR |
| 453483 | UTRN-58 m01 | 1.03468366 | 0.03962052 | 1097 | UTRN-16 | 30 | am002fDMD | 144 | qRTPCR |
| 456038 | UTRN-59 m01 | 1.00688925 | 0.04965703 | 1097 | UTRN-16 | 30 | am002fDMD | 144 | qRTPCR |
| 272301 | UTRN-60 m01 | 0.9921631 | 0.01799872 | 1097 | UTRN-16 | 30 | am002fDMD | 144 | qRTPCR |
|  | Ctrl Un | 1.08692556 | 0.04802467 | 1097 | UTRN-16 | 30 | am002fDMD | 144 | qRTPCR |
|  | Ctrl Lipo | 1 | 0.04148875 | 1097 | UTRN-16 | 30 | am002fDMD | 144 | qRTPCR |
| 276749 | UTRN-61 m01 | 0.95657363 | 0.07952758 | 1097 | UTRN-16 | 30 | am002fDMD | 144 | qRTPCR |
| 289697 | UTRN-62 m01 | 1.27556793 | 0.08315062 | 1097 | UTRN-16 | 30 | am002fDMD | 144 | qRTPCR |
| 292490 | UTRN-63 m01 | 1.16339533 | 0.08677085 | 1097 | UTRN-16 | 30 | am002fDMD | 144 | qRTPCR |
| 292535 | UTRN-64 m01 | 1.36654512 | 0.04898731 | 1097 | UTRN-16 | 30 | am002fDMD | 144 | qRTPCR |
| 292541 | UTRN-65 m01 | 0.86254085 | 0.06740933 | 1097 | UTRN-16 | 30 | am002fDMD | 144 | qRTPCR |
|  | Ctrl Lipo | 1 | 0.07402642 | 1097 | UTRN-16 | 30 | am002fDMD | 144 | qRTPCR |
|  | Ctrl Un | 1.69636888 | 0.10587351 | 1097 | UTRN-16 | 30 | am002fDMD | 144 | qRTPCR |
| 313770 | UTRN-01 m01 | 0.58076529 | 0.03039882 | 1098 | UTRN-16 | 30 | am002fDMD | 96 | qRTPCR |
| 5776 | UTRN-02 m01 | 0.96881503 | 0.08147278 | 1098 | UTRN-16 | 30 | am002fDMD | 96 | qRTPCR |
| 5781 | UTRN-03 m01 | 0.8233217 | 0.04011316 | 1098 | UTRN-16 | 30 | am002fDMD | 96 | qRTPCR |
| 32192 | UTRN-04 m01 | 1.16671325 | 0.06652984 | 1098 | UTRN-16 | 30 | am002fDMD | 96 | qRTPCR |
| 39558 | UTRN-05 m01 | 0.80244274 | 0.03208655 | 1098 | UTRN-16 | 30 | am002fDMD | 96 | qRTPCR |
| 45784 | UTRN-06 m01 | 1.1712878 | 0.03151455 | 1098 | UTRN-16 | 30 | am002fDMD | 96 | qRTPCR |
| 60002 | UTRN-07 m01 | 0.89575232 | 0.02762414 | 1098 | UTRN-16 | 30 | am002fDMD | 96 | qRTPCR |
| 60035 | UTRN-08 m01 | 0.5689325 | 0.01841599 | 1098 | UTRN-16 | 30 | am002fDMD | 96 | qRTPCR |
| 60038 | UTRN-09 m01 | 0.46116762 | 0.02018062 | 1098 | UTRN-16 | 30 | am002fDMD | 96 | qRTPCR |
| 336679 | UTRN-10 m01 | 0.59071506 | 0.02036091 | 1098 | UTRN-16 | 30 | am002fDMD | 96 | qRTPCR |
| 62709 | UTRN-11 m01 | 0.45292364 | 0.05621024 | 1098 | UTRN-16 | 30 | am002fDMD | 96 | qRTPCR |
| 64394 | UTRN-12 m01 | 0.59036933 | 0.02970165 | 1098 | UTRN-16 | 30 | am002fDMD | 96 | qRTPCR |
| 64407 | UTRN-13 m01 | 0.47978013 | 0.04345336 | 1098 | UTRN-16 | 30 | am002fDMD | 96 | qRTPCR |
| 68368 | UTRN-14 m01 | 1.09580674 | 0.02423345 | 1098 | UTRN-16 | 30 | am002fDMD | 96 | qRTPCR |

TABLE 2-continued

Oligonucleotide sequences made for testing.

| SeqID | Oligo Name | Avg RQ | Avg RQ SE | Expt # | Target | [oligo] | cell line | Time (hr) | Assay Type |
|---|---|---|---|---|---|---|---|---|---|
| 68420 | UTRN-15 m01 | 0.74264079 | 0.03365387 | 1098 | UTRN-16 | 30 | am002fDMD | 96 | qRTPCR |
| 68424 | UTRN-16 m01 | 0.87712391 | 0.05397445 | 1098 | UTRN-16 | 30 | am002fDMD | 96 | qRTPCR |
| 82947 | UTRN-17 m01 | 1.08253115 | 0.02494187 | 1098 | UTRN-16 | 30 | am002fDMD | 96 | qRTPCR |
| 85204 | UTRN-18 m01 | 0.76472603 | 0.03441017 | 1098 | UTRN-16 | 30 | am002fDMD | 96 | qRTPCR |
| 89541 | UTRN-19 m01 | 0.4453413 | 0.02299761 | 1098 | UTRN-16 | 30 | am002fDMD | 96 | qRTPCR |
| 355024 | UTRN-20 m01 | 0.79603848 | 0.06100838 | 1098 | UTRN-16 | 30 | am002fDMD | 96 | qRTPCR |
| 99210 | UTRN-21 m01 | 0.55112051 | 0.01090463 | 1098 | UTRN-16 | 30 | am002fDMD | 96 | qRTPCR |
| 101919 | UTRN-22 m01 | 1.10907773 | 0.01134182 | 1098 | UTRN-16 | 30 | am002fDMD | 96 | qRTPCR |
| 101994 | UTRN-23 m01 | 0.7410306 | 0.04264853 | 1098 | UTRN-16 | 30 | am002fDMD | 96 | qRTPCR |
| 103832 | UTRN-24 m01 | 1.19776254 | 0.04344756 | 1098 | UTRN-16 | 30 | am002fDMD | 96 | qRTPCR |
| 103833 | UTRN-25 m01 | 1.40237149 | 0.04131397 | 1098 | UTRN-16 | 30 | am002fDMD | 96 | qRTPCR |
| 103853 | UTRN-26 m01 | 0.88496235 | 0.02236041 | 1098 | UTRN-16 | 30 | am002fDMD | 96 | qRTPCR |
| 103933 | UTRN-27 m01 | 0.51259821 | 0.02670704 | 1098 | UTRN-16 | 30 | am002fDMD | 96 | qRTPCR |
| 117420 | UTRN-28 m01 | 0.85318924 | 0.01188527 | 1098 | UTRN-16 | 30 | am002fDMD | 96 | qRTPCR |
| 120115 | UTRN-29 m01 | 1.4078235 | 0.0069635 | 1098 | UTRN-16 | 30 | am002fDMD | 96 | qRTPCR |
| 120121 | UTRN-30 m01 | 0.97599956 | 0.03751087 | 1098 | UTRN-16 | 30 | am002fDMD | 96 | qRTPCR |
|  | Ctrl Un | 1.05179276 | 0.06427556 | 1098 | UTRN-16 | 30 | am002fDMD | 96 | qRTPCR |
|  | Ctrl Lipo | 1 | 0.07413322 | 1098 | UTRN-16 | 30 | am002fDMD | 96 | qRTPCR |
| 362061 | UTRN-31 m01 | 0.87482409 | 0.03160046 | 1098 | UTRN-16 | 30 | am002fDMD | 96 | qRTPCR |
| 372488 | UTRN-32 m01 | 0.90578907 | 0.04281746 | 1098 | UTRN-16 | 30 | am002fDMD | 96 | qRTPCR |
| 372542 | UTRN-33 m01 | 0.79508229 | 0.04767849 | 1098 | UTRN-16 | 30 | am002fDMD | 96 | qRTPCR |
| 376352 | UTRN-34 m01 | 1.12394667 | 0.10893678 | 1098 | UTRN-16 | 30 | am002fDMD | 96 | qRTPCR |
| 139243 | UTRN-35 m01 | 0.63887247 | 0.02591518 | 1098 | UTRN-16 | 30 | am002fDMD | 96 | qRTPCR |
| 143189 | UTRN-36 m01 | 1.02155885 | 0.07088794 | 1098 | UTRN-16 | 30 | am002fDMD | 96 | qRTPCR |
| 151630 | UTRN-37 m01 | 0.70881548 | 0.06529816 | 1098 | UTRN-16 | 30 | am002fDMD | 96 | qRTPCR |
| 166370 | UTRN-38 m01 | 0.50209162 | 0.03139329 | 1098 | UTRN-16 | 30 | am002fDMD | 96 | qRTPCR |
| 166372 | UTRN-39 m01 | 0.82631739 | 0.00543354 | 1098 | UTRN-16 | 30 | am002fDMD | 96 | qRTPCR |
| 169368 | UTRN-40 m01 | 0.87845259 | 0.02260314 | 1098 | UTRN-16 | 30 | am002fDMD | 96 | qRTPCR |
| 399345 | UTRN-41 m01 | 0.70623726 | 0.01080899 | 1098 | UTRN-16 | 30 | am002fDMD | 96 | qRTPCR |
| 412519 | UTRN-42 m01 | 1.01312974 | 0.03339384 | 1098 | UTRN-16 | 30 | am002fDMD | 96 | qRTPCR |
| 412600 | UTRN-43 m01 | 0.92072992 | 0.04505221 | 1098 | UTRN-16 | 30 | am002fDMD | 96 | qRTPCR |
| 414862 | UTRN-44 m01 | 0.57355729 | 0.03685588 | 1098 | UTRN-16 | 30 | am002fDMD | 96 | qRTPCR |
| 195707 | UTRN-45 m01 | 0.79911892 | 0.01900042 | 1098 | UTRN-16 | 30 | am002fDMD | 96 | qRTPCR |
| 422943 | UTRN-46 m01 | 0.93613873 | 0.01779705 | 1098 | UTRN-16 | 30 | am002fDMD | 96 | qRTPCR |
| 422946 | UTRN-47 m01 | 0.4587612 | 0.02411369 | 1098 | UTRN-16 | 30 | am002fDMD | 96 | qRTPCR |
| 210674 | UTRN-48 m01 | 0.74859068 | 0.02362965 | 1098 | UTRN-16 | 30 | am002fDMD | 96 | qRTPCR |
| 426032 | UTRN-49 m01 | 0.66580214 | 0.02139001 | 1098 | UTRN-16 | 30 | am002fDMD | 96 | qRTPCR |

TABLE 2-continued

Oligonucleotide sequences made for testing.

| SeqID | Oligo Name | Avg RQ | Avg RQ SE | Expt # | Target | [oligo] | cell line | Time (hr) | Assay Type |
|---|---|---|---|---|---|---|---|---|---|
| 225629 | UTRN-50 m01 | 0.83019627 | 0.02025208 | 1098 | UTRN-16 | 30 | am002fDMD | 96 | qRTPCR |
| 225662 | UTRN-51 m01 | 0.46833508 | 0.01039709 | 1098 | UTRN-16 | 30 | am002fDMD | 96 | qRTPCR |
| 229456 | UTRN-52 m01 | 0.70892642 | 0.00242912 | 1098 | UTRN-16 | 30 | am002fDMD | 96 | qRTPCR |
| 436557 | UTRN-53 m01 | 0.64888575 | 0.03688872 | 1098 | UTRN-16 | 30 | am002fDMD | 96 | qRTPCR |
| 238467 | UTRN-54 m01 | 0.8529075 | 0.03343083 | 1098 | UTRN-16 | 30 | am002fDMD | 96 | qRTPCR |
| 242264 | UTRN-55 m01 | 0.52305543 | 0.04356075 | 1098 | UTRN-16 | 30 | am002fDMD | 96 | qRTPCR |
| 251939 | UTRN-56 m01 | 0.66743863 | 0.05307766 | 1098 | UTRN-16 | 30 | am002fDMD | 96 | qRTPCR |
| 453443 | UTRN-57 m01 | 0.91013296 | 0.06546661 | 1098 | UTRN-16 | 30 | am002fDMD | 96 | qRTPCR |
| 453483 | UTRN-58 m01 | 0.6125509 | 0.02627138 | 1098 | UTRN-16 | 30 | am002fDMD | 96 | qRTPCR |
| 456038 | UTRN-59 m01 | 0.99789605 | 0.06465815 | 1098 | UTRN-16 | 30 | am002fDMD | 96 | qRTPCR |
| 272301 | UTRN-60 m01 | 0.91755307 | 0.06594373 | 1098 | UTRN-16 | 30 | am002fDMD | 96 | qRTPCR |
|  | Ctrl Un | 0.89152675 | 0.0402528 | 1098 | UTRN-16 | 30 | am002fDMD | 96 | qRTPCR |
|  | Ctrl Lipo | 1 | 0.06455142 | 1098 | UTRN-16 | 30 | am002fDMD | 96 | qRTPCR |
| 276749 | UTRN-61 m01 | 0.67867922 | 0.02399703 | 1098 | UTRN-16 | 30 | am002fDMD | 96 | qRTPCR |
| 289697 | UTRN-62 m01 | 1.04840944 | 0.02365808 | 1098 | UTRN-16 | 30 | am002fDMD | 96 | qRTPCR |
| 292490 | UTRN-63 m01 | 1.00338618 | 0.0808448 | 1098 | UTRN-16 | 30 | am002fDMD | 96 | qRTPCR |
| 292535 | UTRN-64 m01 | 0.77127007 | 0.03101058 | 1098 | UTRN-16 | 30 | am002fDMD | 96 | qRTPCR |
| 292541 | UTRN-65 m01 | 0.59484854 | 0.0342936 | 1098 | UTRN-16 | 30 | am002fDMD | 96 | qRTPCR |
|  | Ctrl Lipo | 1 | 0.09383278 | 1098 | UTRN-16 | 30 | am002fDMD | 96 | qRTPCR |
|  | Ctrl Un | 0.95433212 | 0.05764991 | 1098 | UTRN-16 | 30 | am002fDMD | 96 | qRTPCR |
| 313770 | UTRN-01 m01 | 1.09999355 | 0.0522105 | 1099 | UTRN-16 | 50 | am002fDMD | 16 | qRTPCR |
| 5776 | UTRN-02 m01 | 0.98048522 | 0.05829249 | 1099 | UTRN-16 | 50 | am002fDMD | 16 | qRTPCR |
| 5781 | UTRN-03 m01 | 1.11018609 | 0.09057436 | 1099 | UTRN-16 | 50 | am002fDMD | 16 | qRTPCR |
| 32192 | UTRN-04 m01 | 1.04324326 | 0.05874548 | 1099 | UTRN-16 | 50 | am002fDMD | 16 | qRTPCR |
| 39558 | UTRN-05 m01 | 0.90267337 | 0.02384534 | 1099 | UTRN-16 | 50 | am002fDMD | 16 | qRTPCR |
| 45784 | UTRN-06 m01 | 0.95957965 | 0.02440134 | 1099 | UTRN-16 | 50 | am002fDMD | 16 | qRTPCR |
| 60002 | UTRN-07 m01 | 1.06633244 | 0.06683347 | 1099 | UTRN-16 | 50 | am002fDMD | 16 | qRTPCR |
| 60035 | UTRN-08 m01 | 1.03379791 | 0.07644067 | 1099 | UTRN-16 | 50 | am002fDMD | 16 | qRTPCR |
| 60038 | UTRN-09 m01 | 1.19128452 | 0.06345743 | 1099 | UTRN-16 | 50 | am002fDMD | 16 | qRTPCR |
| 336679 | UTRN-10 m01 | 1.04590735 | 0.02568251 | 1099 | UTRN-16 | 50 | am002fDMD | 16 | qRTPCR |
| 62709 | UTRN-11 m01 | 1.3006283 | 0.09566221 | 1099 | UTRN-16 | 50 | am002fDMD | 16 | qRTPCR |
| 64394 | UTRN-12 m01 | 1.32164316 | 0.07336719 | 1099 | UTRN-16 | 50 | am002fDMD | 16 | qRTPCR |
| 64407 | UTRN-13 m01 | 1.02457735 | 0.0099744 | 1099 | UTRN-16 | 50 | am002fDMD | 16 | qRTPCR |
| 68368 | UTRN-14 m01 | 0.89786302 | 0.02932433 | 1099 | UTRN-16 | 50 | am002fDMD | 16 | qRTPCR |
| 68420 | UTRN-15 m01 | 1.04929606 | 0.02858814 | 1099 | UTRN-16 | 50 | am002fDMD | 16 | qRTPCR |
| 68424 | UTRN-16 m01 | 1.0167624 | 0.04978825 | 1099 | UTRN-16 | 50 | am002fDMD | 16 | qRTPCR |
| 82947 | UTRN-17 m01 | 1.33820211 | 0.16165828 | 1099 | UTRN-16 | 50 | am002fDMD | 16 | qRTPCR |

TABLE 2-continued

Oligonucleotide sequences made for testing.

| SeqID | Oligo Name | Avg RQ | Avg RQ SE | Expt # | Target | [oligo] | cell line | Time (hr) | Assay Type |
|---|---|---|---|---|---|---|---|---|---|
| 85204 | UTRN-18 m01 | 1.08174251 | 0.03029958 | 1099 | UTRN-16 | 50 | am002fDMD | 16 | qRTPCR |
| 89541 | UTRN-19 m01 | 1.2124862 | 0.03538288 | 1099 | UTRN-16 | 50 | am002fDMD | 16 | qRTPCR |
| 355024 | UTRN-20 m01 | 1.18707808 | 0.08658924 | 1099 | UTRN-16 | 50 | am002fDMD | 16 | qRTPCR |
| 99210 | UTRN-21 m01 | 1.06985407 | 0.00459959 | 1099 | UTRN-16 | 50 | am002fDMD | 16 | qRTPCR |
| 101919 | UTRN-22 m01 | 1.02001321 | 0.00982358 | 1099 | UTRN-16 | 50 | am002fDMD | 16 | qRTPCR |
| 101994 | UTRN-23 m01 | 1.07309486 | 0.03530298 | 1099 | UTRN-16 | 50 | am002fDMD | 16 | qRTPCR |
| 103832 | UTRN-24 m01 | 1.15223004 | 0.02317344 | 1099 | UTRN-16 | 50 | am002fDMD | 16 | qRTPCR |
| 103833 | UTRN-25 m01 | 1.07729047 | 0.08903163 | 1099 | UTRN-16 | 50 | am002fDMD | 16 | qRTPCR |
| 103853 | UTRN-26 m01 | 1.05670588 | 0.03993355 | 1099 | UTRN-16 | 50 | am002fDMD | 16 | qRTPCR |
| 103933 | UTRN-27 m01 | 0.92230239 | 0.13830922 | 1099 | UTRN-16 | 50 | am002fDMD | 16 | qRTPCR |
| 117420 | UTRN-28 m01 | 1.0269754 | 0.18269877 | 1099 | UTRN-16 | 50 | am002fDMD | 16 | qRTPCR |
| 120115 | UTRN-29 m01 | 0.95740501 | 0.13717197 | 1099 | UTRN-16 | 50 | am002fDMD | 16 | qRTPCR |
| 120121 | UTRN-30 m01 | 0.91015254 | 0.01477685 | 1099 | UTRN-16 | 50 | am002fDMD | 16 | qRTPCR |
|  | Ctrl Un | 1.17147479 | 0.06069851 | 1099 | UTRN-16 | 50 | am002fDMD | 16 | qRTPCR |
|  | Ctrl Lipo | 1 | 0.01155989 | 1099 | UTRN-16 | 50 | am002fDMD | 16 | qRTPCR |
| 362061 | UTRN-31 m01 | 0.84129209 | 0.0551895 | 1099 | UTRN-16 | 50 | am002fDMD | 16 | qRTPCR |
| 372488 | UTRN-32 m01 | 0.87401238 | 0.05711907 | 1099 | UTRN-16 | 50 | am002fDMD | 16 | qRTPCR |
| 372542 | UTRN-33 m01 | 1.00773219 | 0.136912 | 1099 | UTRN-16 | 50 | am002fDMD | 16 | qRTPCR |
| 376352 | UTRN-34 m01 | 0.88581399 | 0.08839522 | 1099 | UTRN-16 | 50 | am002fDMD | 16 | qRTPCR |
| 139243 | UTRN-35 m01 | 0.81977584 | 0.0747876 | 1099 | UTRN-16 | 50 | am002fDMD | 16 | qRTPCR |
| 143189 | UTRN-36 m01 | 0.90303543 | 0.0639527 | 1099 | UTRN-16 | 50 | am002fDMD | 16 | qRTPCR |
| 151630 | UTRN-37 m01 | 0.85852205 | 0.06571187 | 1099 | UTRN-16 | 50 | am002fDMD | 16 | qRTPCR |
| 166370 | UTRN-38 m01 | 0.79791465 | 0.04599394 | 1099 | UTRN-16 | 50 | am002fDMD | 16 | qRTPCR |
| 166372 | UTRN-39 m01 | 0.70577426 | 0.02258757 | 1099 | UTRN-16 | 50 | am002fDMD | 16 | qRTPCR |
| 169368 | UTRN-40 m01 | 0.86132342 | 0.07520493 | 1099 | UTRN-16 | 50 | am002fDMD | 16 | qRTPCR |
| 399345 | UTRN-41 m01 | 0.95686499 | 0.04826801 | 1099 | UTRN-16 | 50 | am002fDMD | 16 | qRTPCR |
| 412519 | UTRN-42 m01 | 0.91846716 | 0.06735625 | 1099 | UTRN-16 | 50 | am002fDMD | 16 | qRTPCR |
| 412600 | UTRN-43 m01 | 0.90545962 | 0.0764699 | 1099 | UTRN-16 | 50 | am002fDMD | 16 | qRTPCR |
| 414862 | UTRN-44 m01 | 0.87250314 | 0.04934873 | 1099 | UTRN-16 | 50 | am002fDMD | 16 | qRTPCR |
| 195707 | UTRN-45 m01 | 0.90958 | 0.0321877 | 1099 | UTRN-16 | 50 | am002fDMD | 16 | qRTPCR |
| 422943 | UTRN-46 m01 | 0.77236631 | 0.02358972 | 1099 | UTRN-16 | 50 | am002fDMD | 16 | qRTPCR |
| 422946 | UTRN-47 m01 | 0.79566678 | 0.0195359 | 1099 | UTRN-16 | 50 | am002fDMD | 16 | qRTPCR |
| 210674 | UTRN-48 m01 | 0.92591552 | 0.0686307 | 1099 | UTRN-16 | 50 | am002fDMD | 16 | qRTPCR |
| 426032 | UTRN-49 m01 | 0.91753186 | 0.11107633 | 1099 | UTRN-16 | 50 | am002fDMD | 16 | qRTPCR |
| 225629 | UTRN-50 m01 | 0.90366093 | 0.05020314 | 1099 | UTRN-16 | 50 | am002fDMD | 16 | qRTPCR |
| 225662 | UTRN-51 m01 | 0.84773763 | 0.01225047 | 1099 | UTRN-16 | 50 | am002fDMD | 16 | qRTPCR |
| 229456 | UTRN-52 m01 | 0.93886586 | 0.03206633 | 1099 | UTRN-16 | 50 | am002fDMD | 16 | qRTPCR |

TABLE 2-continued

Oligonucleotide sequences made for testing.

| SeqID | Oligo Name | Avg RQ | Avg RQ SE | Expt # | Target | [oligo] | cell line | Time (hr) | Assay Type |
|---|---|---|---|---|---|---|---|---|---|
| 436557 | UTRN-53 m01 | 0.99264254 | 0.07123769 | 1099 | UTRN-16 | 50 | am002fDMD | 16 | qRTPCR |
| 238467 | UTRN-54 m01 | 0.78797951 | 0.05217497 | 1099 | UTRN-16 | 50 | am002fDMD | 16 | qRTPCR |
| 242264 | UTRN-55 m01 | 0.77050873 | 0.04398832 | 1099 | UTRN-16 | 50 | am002fDMD | 16 | qRTPCR |
| 251939 | UTRN-56 m01 | 0.89266966 | 0.05871496 | 1099 | UTRN-16 | 50 | am002fDMD | 16 | qRTPCR |
| 453443 | UTRN-57 m01 | 0.92906018 | 0.07248755 | 1099 | UTRN-16 | 50 | am002fDMD | 16 | qRTPCR |
| 453483 | UTRN-58 m01 | 0.94497021 | 0.04599071 | 1099 | UTRN-16 | 50 | am002fDMD | 16 | qRTPCR |
| 456038 | UTRN-59 m01 | 0.94970793 | 0.0624258 | 1099 | UTRN-16 | 50 | am002fDMD | 16 | qRTPCR |
| 272301 | UTRN-60 m01 | 0.8175283 | 0.00629294 | 1099 | UTRN-16 | 50 | am002fDMD | 16 | qRTPCR |
|  | Ctrl Un | 0.8823963 | 0.05212196 | 1099 | UTRN-16 | 50 | am002fDMD | 16 | qRTPCR |
|  | Ctrl Lipo | 1 | 0.11512636 | 1099 | UTRN-16 | 50 | am002fDMD | 16 | qRTPCR |
| 276749 | UTRN-61 m01 | 0.84129209 | 0.0551895 | 1099 | UTRN-16 | 50 | am002fDMD | 16 | qRTPCR |
| 289697 | UTRN-62 m01 | 0.87401238 | 0.05711907 | 1099 | UTRN-16 | 50 | am002fDMD | 16 | qRTPCR |
| 292490 | UTRN-63 m01 | 1.00773219 | 0.136912 | 1099 | UTRN-16 | 50 | am002fDMD | 16 | qRTPCR |
| 292535 | UTRN-64 m01 | 0.88581399 | 0.08839522 | 1099 | UTRN-16 | 50 | am002fDMD | 16 | qRTPCR |
| 292541 | UTRN-65 m01 | 0.81977584 | 0.0747876 | 1099 | UTRN-16 | 50 | am002fDMD | 16 | qRTPCR |
| 497808 | unc-232 m12 | 0.90303543 | 0.0639527 | 1099 | UTRN-16 | 50 | am002fDMD | 16 | qRTPCR |
| 497809 | unc-293 m12 | 0.85852205 | 0.06571187 | 1099 | UTRN-16 | 50 | am002fDMD | 16 | qRTPCR |
| 497808 | unc-232 m01 | 0.79791465 | 0.04599394 | 1099 | UTRN-16 | 50 | am002fDMD | 16 | qRTPCR |
| 497809 | unc-293 m01 | 0.70577426 | 0.02258757 | 1099 | UTRN-16 | 50 | am002fDMD | 16 | qRTPCR |
|  | Ctrl Un | 0.8823963 | 0.05212196 | 1099 | UTRN-16 | 50 | am002fDMD | 16 | qRTPCR |
|  | Ctrl Lipo | 1 | 0.11512636 | 1099 | UTRN-16 | 50 | am002fDMD | 16 | qRTPCR |

TABLE 4

Formatted sequences

| OligoID | Base Sequence | Formatted Sequence | SeqID |
|---|---|---|---|
| UTRN-01 m01 | CATCGTAGGAAGTTG | InaCs; omeAs; InaTs; omeCs; InaGs; omeUs; InaAs; omeGs; InaGs; omeAs; InaAs; omeGs; InaTs; omeUs; InaG-Sup | 313770 |
| UTRN-02 m01 | CCGGTATCATGGAGG | InaCs; omeCs; InaGs; InaTs; omeAs; InaTs; omeCs; InaAs; omeUs; omeGs; InaAs; omeGs; InaG-Sup | 5776 |
| UTRN-03 m01 | CAACACCGGTATCAT | InaCs; omeAs; InaAs; omeCs; omeAs; omeCs; InaCs; omeGs; InaGs; omeUs; InaAs; omeUs; InaCs; omeAs; InaT-Sup | 5781 |
| UTRN-04 m01 | CCGAACATCACCCAC | InaCs; omeCs; InaGs; omeAs; InaAs; omeCs; InaAs; omeUs; InaCs; omeAs; InaCs; omeCs; InaCs; omeAs; InaC-Sup | 32192 |
| UTRN-05 m01 | GGACTTCTGGACGAC | InaGs; omeGs; InaAs; omeCs; InaTs; omeUs; InaCs; omeUs; InaGs; omeGs; InaAs; omeCs; InaGs; omeAs; InaC-Sup | 39558 |
| UTRN-06 m01 | CCAAAACCTAGCGTT | InaCs; omeCs; InaAs; omeAs; InaAs; omeAs; InaCs; omeCs; InaTs; omeAs; InaGs; omeCs; InaGs; omeUs; InaT-Sup | 45784 |

TABLE 4-continued

Formatted sequences

| OligoID | Base Sequence | Formatted Sequence | SeqID |
|---|---|---|---|
| UTRN-07 m01 | CTTTTGTGACGTC CC | InaCs; omeUs; InaTs; omeUs; InaTs; omeGs; InaTs; omeGs; InaAs; omeCs; InaGs; omeUs; InaCs; omeCs; InaC-Sup | 60002 |
| UTRN-08 m01 | CCCGATATGATG CAC | InaCs; omeCs; InaCs; omeGs; InaAs; omeUs; InaAs; omeUs; InaGs; omeAs; InaTs; omeGs; InaCs; omeAs; InaC-Sup | 60035 |
| UTRN-09 m01 | ATCCCCGATATGA TG | InaAs; omeUs; InaCs; omeCs; InaCs; omeGs; omeAs; InaTs; omeAs; InaTs; omeGs; InaAs; omeUs; InaG-Sup | 60038 |
| UTRN-10 m01 | CCACCGACATAA GTG | InaCs; omeCs; InaAs; omeCs; InaCs; omeGs; InaAs; omeCs; InaAs; omeUs; InaAs; omeAs; InaGs; omeUs; InaG-Sup | 336679 |
| UTRN-11 m01 | CTCTCCGATGCCA AG | InaCs; omeUs; InaCs; omeUs; InaCs; omeCs; InaGs; omeAs; InaTs; omeGs; InaCs; omeCs; InaAs; omeAs; InaG-Sup | 62709 |
| UTRN-12 m01 | GGCGTCTATGGT GAC | InaGs; omeGs; InaCs; omeGs; InaTs; omeCs; InaTs; omeAs; InaTs; omeGs; InaGs; omeUs; InaGs; omeAs; InaC-Sup | 64394 |
| UTRN-13 m01 | CTACCTCACGGAT GG | InaCs; omeUs; InaAs; omeCs; InaCs; omeUs; InaCs; omeAs; InaCs; omeGs; InaGs; omeAs; InaTs; omeGs; InaG-Sup | 64407 |
| UTRN-14 m01 | GAGTTTCAGCTC GGG | InaGs; omeAs; InaGs; omeUs; InaTs; omeUs; InaCs; omeAs; InaGs; omeCs; InaTs; omeCs; InaGs; omeGs; InaG-Sup | 68368 |
| UTRN-15 m01 | AACGCAATCTGA TAG | InaAs; omeAs; InaCs; omeGs; InaCs; omeAs; InaAs; omeUs; InaCs; omeUs; InaGs; omeAs; InaTs; omeAs; InaG-Sup | 68420 |
| UTRN-16 m01 | CTCCAACGCAATC TG | InaCs; omeUs; InaCs; omeCs; InaAs; omeAs; InaCs; omeGs; InaCs; omeAs; InaAs; omeUs; InaCs; omeUs; InaG-Sup | 68424 |
| UTRN-17 m01 | CATTTCGGAAGT GTC | InaCs; omeAs; InaTs; omeUs; InaTs; omeCs; InaGs; omeGs; InaAs; omeAs; InaGs; omeUs; InaGs; omeUs; InaC-Sup | 82947 |
| UTRN-18 m01 | TTATTCGATGCCA CC | InaTs; omeUs; InaAs; omeUs; InaTs; omeCs; InaGs; omeAs; InaTs; omeGs; InaCs; omeCs; InaAs; omeCs; InaC-Sup | 85204 |
| UTRN-19 m01 | CAATTCCCGCTAA GG | InaCs; omeAs; InaAs; omeUs; InaTs; omeCs; InaCs; omeCs; InaGs; omeCs; InaTs; omeAs; InaAs; omeGs; InaG-Sup | 89541 |
| UTRN-20 m01 | CTAATCTTCGAAG TG | InaCs; omeUs; InaAs; omeAs; InaTs; omeCs; InaTs; omeUs; InaCs; omeGs; InaAs; omeAs; InaGs; omeUs; InaG-Sup | 355024 |
| UTRN-21 m01 | CTCGAATTCTATT AC | InaCs; omeUs; InaCs; omeGs; InaAs; omeAs; InaTs; omeUs; InaCs; omeUs; InaAs; omeUs; InaTs; omeAs; InaC-Sup | 99210 |
| UTRN-22 m01 | GGAGATCACGGG TTC | InaGs; omeGs; InaAs; omeGs; InaAs; omeUs; InaCs; omeAs; InaCs; omeGs; InaGs; omeGs; InaTs; omeUs; InaC-Sup | 101919 |
| UTRN-23 m01 | CATTTGCCTGCGT AA | InaCs; omeAs; InaTs; omeUs; InaTs; omeGs; InaCs; omeCs; InaTs; omeGs; InaCs; omeGs; InaTs; omeAs; InaA-Sup | 101994 |
| UTRN-24 m01 | CGATTATCTGCCG GG | InaCs; omeGs; InaAs; omeUs; InaTs; omeAs; InaTs; omeCs; InaTs; omeGs; InaCs; omeCs; InaGs; omeGs; InaG-Sup | 103832 |
| UTRN-25 m01 | GCGATTATCTGCC GG | InaGs; omeCs; InaGs; omeAs; InaTs; omeUs; InaAs; omeUs; InaCs; omeUs; InaGs; omeCs; InaCs; omeGs; InaG-Sup | 103833 |
| UTRN-26 m01 | CCAAGCTCTCGA ATC | InaCs; omeCs; InaAs; omeAs; InaGs; omeCs; InaTs; omeCs; InaTs; omeCs; InaGs; omeAs; InaAs; omeUs; InaC-Sup | 103853 |
| UTRN-27 m01 | GATCTTCATATCG GC | InaGs; omeAs; InaTs; omeCs; InaTs; omeUs; InaCs; omeAs; InaTs; omeAs; InaTs; omeCs; InaGs; omeGs; InaC-Sup | 103933 |
| UTRN-28 m01 | CAGGTACGAACT CGG | InaCs; omeAs; InaGs; omeGs; InaTs; omeAs; InaCs; omeGs; InaAs; omeAs; InaCs; omeUs; InaCs; omeGs; InaG-Sup | 117420 |
| UTRN-29 m01 | GCGTTACTGATGT CT | InaGs; omeCs; InaGs; omeUs; InaTs; omeAs; InaCs; omeUs; InaGs; omeAs; InaTs; omeGs; InaTs; omeCs; InaT-Sup | 120115 |
| UTRN-30 m01 | CCAAAAGCGTTA CTG | InaCs; omeCs; InaAs; omeAs; InaAs; omeAs; InaGs; omeCs; InaGs; omeUs; InaTs; omeAs; InaCs; omeUs; InaG-Sup | 120121 |
| UTRN-31 m01 | TTTAAACCAACGC TG | InaTs; omeUs; InaTs; omeAs; InaAs; omeAs; InaCs; omeCs; InaAs; omeAs; InaCs; omeGs; InaCs; omeUs; InaG-Sup | 362061 |

TABLE 4-continued

Formatted sequences

| OligoID | Base Sequence | Formatted Sequence | SeqID |
|---|---|---|---|
| UTRN-32 m01 | CACCGATCTGCATTC | InaCs; omeAs; InaCs; omeCs; InaGs; omeAs; InaTs; omeCs; InaTs; omeGs; InaCs; omeAs; InaTs; omeUs; InaC-Sup | 372488 |
| UTRN-33 m01 | GGAGTCATACGATGC | InaGs; omeGs; InaAs; omeGs; InaTs; omeCs; InaAs; omeUs; InaAs; omeCs; InaAs; omeAs; InaTs; omeGs; InaC-Sup | 372542 |
| UTRN-34 m01 | CTCATGATAACCGTG | InaCs; omeUs; InaCs; omeAs; InaTs; omeGs; InaAs; omeUs; InaAs; omeAs; InaCs; omeCs; InaGs; omeUs; InaG-Sup | 376352 |
| UTRN-35 m01 | GAATATAGAGTCGAG | InaGs; omeAs; InaAs; omeUs; InaAs; omeUs; InaAs; omeGs; InaAs; omeGs; InaTs; omeCs; InaGs; omeAs; InaG-Sup | 139243 |
| UTRN-36 m01 | CCAATTCGGTGAATG | InaCs; omeCs; InaAs; omeAs; InaTs; omeUs; InaCs; omeGs; InaGs; omeUs; InaGs; omeAs; InaAs; omeUs; InaG-Sup | 143189 |
| UTRN-37 m01 | CCCATCTACATACGC | InaCs; omeCs; InaCs; omeAs; InaTs; omeCs; InaTs; omeAs; InaCs; omeAs; InaTs; omeAs; InaCs; omeGs; InaC-Sup | 151630 |
| UTRN-38 m01 | CCGATTAATTTACCC | InaCs; omeCs; InaGs; omeAs; InaTs; omeUs; InaAs; omeAs; InaTs; omeUs; InaTs; omeAs; InaCs; omeCs; InaC-Sup | 166370 |
| UTRN-39 m01 | CCCCGATTAATTTAC | InaCs; omeCs; InaCs; omeCs; InaGs; omeAs; InaTs; omeUs; InaAs; omeAs; InaTs; omeUs; InaTs; omeAs; InaC-Sup | 166372 |
| UTRN-40 m01 | AATGAAACAGCGTAG | InaAs; omeAs; InaTs; omeGs; InaAs; omeAs; InaAs; omeCs; InaAs; omeGs; InaCs; omeGs; InaTs; omeAs; InaG-Sup | 169368 |
| UTRN-41 m01 | CTGAGTTATCGTAAA | InaCs; omeUs; InaGs; omeAs; InaGs; omeUs; InaTs; omeAs; InaTs; omeCs; InaGs; omeUs; InaAs; omeAs; InaA-Sup | 399345 |
| UTRN-42 m01 | AGAAGTTAAACGCTG | InaAs; omeGs; InaAs; omeAs; InaGs; omeUs; InaTs; omeAs; InaAs; omeAs; InaCs; omeGs; InaCs; omeUs; InaG-Sup | 412519 |
| UTRN-43 m01 | CTTCAACTTACGGGA | InaCs; omeUs; InaTs; omeCs; InaAs; omeAs; InaCs; omeUs; InaTs; omeAs; InaCs; omeGs; InaGs; omeGs; InaA-Sup | 412600 |
| UTRN-44 m01 | GCCTTAACGATTTAC | InaGs; omeCs; InaCs; omeUs; InaTs; omeAs; InaAs; omeCs; InaGs; omeAs; InaTs; omeUs; InaTs; omeAs; InaC-Sup | 414862 |
| UTRN-45 m01 | CTGTTTCCGTCAATG | InaCs; omeUs; InaGs; omeUs; InaTs; omeUs; InaCs; omeCs; InaGs; omeUs; InaCs; omeAs; InaAs; omeUs; InaG-Sup | 195707 |
| UTRN-46 m01 | TGAGTCGCTTAATTC | InaTs; omeGs; InaAs; omeGs; InaTs; omeCs; InaGs; omeCs; InaTs; omeUs; InaAs; omeAs; InaTs; omeUs; InaC-Sup | 422943 |
| UTRN-47 m01 | GTCGCTTAATTCAAA | InaGs; omeUs; InaCs; omeGs; InaCs; omeUs; InaTs; omeAs; InaAs; omeUs; InaTs; omeCs; InaAs; omeAs; InaA-Sup | 422946 |
| UTRN-48 m01 | CTAAGGCGAAATCTC | InaCs; omeUs; InaAs; omeAs; InaGs; omeGs; InaCs; omeGs; InaAs; omeAs; InaAs; omeUs; InaCs; omeUs; InaC-Sup | 210674 |
| UTRN-49 m01 | CTCGGACTCTACTTG | InaCs; omeUs; InaCs; omeGs; InaGs; omeAs; InaCs; omeUs; InaCs; omeUs; InaAs; omeCs; InaUs; omeUs; InaG-Sup | 426032 |
| UTRN-50 m01 | CTTTAACTCCCGTCT | InaCs; omeUs; InaTs; omeUs; InaTs; omeAs; InaAs; omeCs; InaUs; omeCs; InaCs; omeCs; InaGs; omeUs; InaCs; omeUs; InaT-Sup | 225629 |
| UTRN-51 m01 | GTCGACAGCATTCAG | InaGs; omeUs; InaCs; omeGs; InaAs; omeCs; InaAs; omeGs; InaCs; omeAs; InaTs; omeUs; InaCs; omeAs; InaG-Sup | 225662 |
| UTRN-52 m01 | TTTACCCAATCGATG | InaTs; omeUs; InaTs; omeAs; InaCs; omeCs; InaCs; omeAs; InaAs; omeUs; InaCs; omeGs; InaAs; omeUs; InaG-Sup | 229456 |
| UTRN-53 m01 | GTAGCTCGATCAATC | InaGs; omeUs; InaAs; omeGs; InaCs; omeUs; InaCs; omeGs; InaAs; omeUs; InaCs; omeAs; InaAs; omeUs; InaC-Sup | 436557 |
| UTRN-54 m01 | CATCTAGCTGGCGAG | InaCs; omeAs; InaTs; omeCs; InaTs; omeAs; InaGs; omeCs; InaTs; omeGs; InaGs; omeCs; InaGs; omeAs; InaG-Sup | 238467 |
| UTRN-55 m01 | GGATCTTTGCCACGG | InaGs; omeGs; InaAs; omeAs; InaTs; omeCs; InaTs; omeUs; InaTs; omeGs; InaCs; omeCs; InaAs; omeCs; InaG-Sup | 242264 |
| UTRN-56 m01 | ACGACAACAGTACTG | InaAs; omeCs; InaGs; omeAs; InaCs; omeAs; InaAs; omeCs; InaAs; omeGs; InaTs; omeAs; InaCs; omeUs; InaG-Sup | 251939 |

TABLE 4-continued

Formatted sequences

| OligoID | Base Sequence | Formatted Sequence | SeqID |
|---|---|---|---|
| UTRN-57 m01 | CTGAATAATGTACGT | InaCs; omeUs; InaGs; omeAs; InaAs; omeUs; InaAs; omeAs; InaTs; omeGs; InaTs; omeAs; InaCs; omeGs; InaT-Sup | 453443 |
| UTRN-58 m01 | AAATCCGAAGACTAC | InaAs; omeAs; InaAs; omeUs; InaCs; omeCs; InaGs; omeAs; InaAs; omeGs; InaAs; omeCs; InaTs; omeAs; InaC-Sup | 453483 |
| UTRN-59 m01 | GTTGTCGATCACCTC | InaGs; omeUs; InaGs; omeUs; InaCs; omeGs; InaAs; InaTs; omeCs; InaAs; omeCs; InaCs; omeUs; InaC-Sup | 456038 |
| UTRN-60 m01 | CTATTAAGTAGCCGT | InaCs; omeUs; InaAs; omeUs; InaTs; omeAs; InaAs; omeGs; InaTs; omeAs; InaGs; omeCs; InaCs; omeGs; InaT-Sup | 272301 |
| UTRN-61 m01 | GTAACCAAGTCGAGG | InaGs; omeUs; InaAs; omeAs; InaCs; omeCs; InaAs; omeAs; InaGs; omeUs; InaCs; omeGs; InaAs; omeGs; InaG-Sup | 276749 |
| UTRN-62 m01 | CAGACGTGTGATGGG | InaCs; omeAs; InaGs; omeAs; InaCs; omeGs; InaTs; omeGs; InaTs; omeGs; InaAs; omeUs; InaGs; omeGs; InaG-Sup | 289697 |
| UTRN-63 m01 | CACCATTGATTCGGG | InaCs; omeAs; InaCs; omeCs; InaAs; omeUs; InaTs; omeGs; InaAs; omeUs; InaTs; omeCs; InaGs; omeGs; InaG-Sup | 292490 |
| UTRN-64 m01 | GCGAGTAGCTCAGTG | InaGs; omeCs; InaGs; omeAs; InaGs; omeUs; InaAs; omeGs; InaCs; omeUs; InaCs; omeAs; InaGs; omeUs; InaG-Sup | 292535 |
| UTRN-65 m01 | GATCAAGCGAGTAGC | InaGs; omeAs; InaTs; omeCs; InaAs; omeAs; InaGs; omeCs; InaGs; omeAs; InaGs; omeUs; InaAs; omeGs; InaC-Sup | 292541 |
| UTRN-112 m08 | CCCCGATCTATTCTC | InaCs; InaCs; InaCs; dCs; dGs; dAs; dTs; dCs; dTs; dAs; dTs; dTs; InaCs; InaTs; InaC-Sup | 497729 |
| UTRN-113 m08 | CCCGATCTATTCTCC | InaCs; InaCs; InaCs; dGs; dAs; dTs; dCs; dTs; dAs; dTs; dTs; dCs; InaTs; InaCs; InaC-Sup | 497730 |
| UTRN-114 m08 | CCGATCTATTCTCCA | InaCs; InaCs; InaGs; dAs; dTs; dCs; dTs; dAs; dTs; dTs; dCs; dTs; InaCs; InaCs; InaA-Sup | 497731 |
| UTRN-115 m08 | GCGCGATGCTGAACT | InaGs; InaCs; InaGs; dCs; dGs; dAs; dTs; dGs; dCs; dTs; dGs; dAs; InaAs; InaCs; InaT-Sup | 497732 |
| UTRN-116 m08 | CTGCGAACAGCAATG | InaCs; InaTs; InaGs; dCs; dGs; dAs; dAs; dCs; dAs; dGs; dCs; dAs; InaAs; InaTs; InaG-Sup | 497733 |
| UTRN-117 m08 | TGCGAACAGCAATGG | InaTs; InaGs; InaCs; dGs; dAs; dAs; dCs; dAs; dGs; dCs; dAs; dAs; InaTs; InaGs; InaG-Sup | 497734 |
| UTRN-118 m08 | GCGAACAGCAATGGC | InaGs; InaCs; InaGs; dAs; dAs; dCs; dAs; dGs; dCs; dAs; dAs; dTs; InaGs; InaGs; InaC-Sup | 497735 |
| UTRN-119 m08 | AGTTCTGGCCAGTGA | InaAs; InaGs; InaTs; dTs; dCs; dTs; dGs; dGs; dCs; dCs; dAs; dGs; InaTs; InaGs; InaA-Sup | 497736 |
| UTRN-120 m08 | AGAAGTGTTATTGGA | InaAs; InaGs; InaAs; dAs; dGs; dTs; dGs; dTs; dTs; dAs; dTs; dTs; InaGs; InaGs; InaA-Sup | 497737 |
| UTRN-121 m08 | GAAGTGTTATTGGAC | InaGs; InaAs; InaAs; dGs; dTs; dGs; dTs; dTs; dAs; dTs; dTs; dGs; InaGs; InaAs; InaC-Sup | 497738 |
| UTRN-122 m08 | GGTAGACTTGCGCTA | InaGs; InaGs; InaTs; dAs; dGs; dAs; dCs; dTs; dTs; dGs; dCs; dGs; InaCs; InaTs; InaA-Sup | 497739 |
| UTRN-123 m08 | TAGACTTGCGCTACA | InaTs; InaAs; InaGs; dAs; dCs; dTs; dTs; dGs; dCs; dGs; dCs; dTs; InaAs; InaCs; InaA-Sup | 497740 |
| UTRN-124 m08 | AGACTTGCGCTACAT | InaAs; InaGs; InaAs; dCs; dTs; dTs; dGs; dCs; dGs; dCs; dTs; dAs; InaCs; InaAs; InaT-Sup | 497741 |
| UTRN-125 m08 | GACTTGCGCTACATT | InaGs; InaAs; InaCs; dTs; dTs; dGs; dCs; dGs; dCs; dTs; dAs; dCs; InaAs; InaTs; InaT-Sup | 497742 |
| UTRN-126 m08 | ACTTGCGCTACATTA | InaAs; InaCs; InaTs; dTs; dGs; dCs; dGs; dCs; dTs; dAs; dCs; dAs; InaTs; InaTs; InaA-Sup | 497743 |
| UTRN-127 m08 | CTTGCGCTACATTAA | InaCs; InaTs; InaTs; dGs; dCs; dGs; dCs; dTs; dAs; dCs; dAs; dTs; InaTs; InaAs; InaA-Sup | 497744 |

TABLE 4-continued

Formatted sequences

| OligoID | Base Sequence | Formatted Sequence | SeqID |
|---|---|---|---|
| UTRN-128 m08 | TTGCGCTACATTAAT | InaTs; InaTs; InaGs; dCs; dGs; dCs; dTs; dAs; dCs; dAs; dTs; dTs; InaAs; InaAs; InaT-Sup | 497745 |
| UTRN-129 m08 | TGCGCTACATTAATA | InaTs; InaGs; InaCs; dGs; dCs; dTs; dAs; dCs; dAs; dTs; dTs; dAs; InaAs; InaTs; InaA-Sup | 497746 |
| UTRN-130 m08 | GCGCTACATTAATAT | InaGs; InaCs; InaGs; dCs; dTs; dAs; dCs; dAs; dTs; dTs; dAs; dAs; InaTs; InaAs; InaT-Sup | 497747 |
| UTRN-131 m08 | GAAAGAACAGAGTGA | InaGs; InaAs; InaAs; dAs; dGs; dAs; dAs; dCs; dAs; dGs; dAs; dGs; InaTs; InaGs; InaA-Sup | 497748 |
| UTRN-132 m08 | AAAGAACAGAGTGAC | InaAs; InaAs; InaAs; dGs; dAs; dAs; dCs; dAs; dGs; dAs; dGs; dTs; InaGs; InaAs; InaC-Sup | 497749 |
| UTRN-133 m08 | TCCATTCTGGTTCGG | InaTs; InaCs; InaCs; dAs; dTs; dTs; dCs; dTs; dGs; dGs; dTs; dTs; InaCs; InaGs; InaG-Sup | 497750 |
| UTRN-134 m08 | CCATTCTGGTTCGGT | InaCs; InaCs; InaAs; dTs; dTs; dCs; dTs; dGs; dGs; dTs; dTs; dCs; InaGs; InaGs; InaT-Sup | 497751 |
| UTRN-135 m08 | ATTCTGGTTCGGTCT | InaAs; InaTs; InaTs; dCs; dTs; dGs; dGs; dTs; dTs; dCs; dGs; dGs; InaTs; InaCs; InaT-Sup | 497752 |
| UTRN-136 m08 | TTCTGGTTCGGTCTC | InaTs; InaTs; InaCs; dTs; dGs; dGs; dTs; dTs; dCs; dGs; dGs; dTs; InaCs; InaTs; InaC-Sup | 497753 |
| UTRN-112 m01 | CCCCGATCTATTCTC | InaCs; omeCs; InaCs; omeCs; InaGs; omeAs; InaTs; omeCs; InaTs; omeAs; InaTs; omeUs; InaCs; omeUs; InaC-Sup | 497729 |
| UTRN-113 m01 | CCCGATCTATTCTCC | InaCs; omeCs; InaCs; omeGs; InaAs; omeUs; InaCs; omeUs; InaAs; omeUs; InaTs; omeTs; omeCs; InaC-Sup | 497730 |
| UTRN-114 m01 | CCGATCTATTCTCCA | InaCs; omeCs; InaGs; omeAs; InaTs; omeCs; InaTs; omeAs; InaTs; omeUs; InaCs; omeUs; InaCs; omeCs; InaA-Sup | 497731 |
| UTRN-115 m01 | GCGCGATGCTGAACT | InaGs; omeCs; InaGs; omeCs; InaGs; omeAs; InaTs; omeGs; InaCs; omeUs; InaGs; omeAs; InaAs; omeCs; InaT-Sup | 497732 |
| UTRN-116 m01 | CTGCGAACAGCAATG | InaCs; omeUs; InaGs; omeCs; InaGs; omeAs; InaAs; omeCs; InaAs; omeGs; InaCs; omeAs; InaAs; omeUs; InaG-Sup | 497733 |
| UTRN-117 m01 | TGCGAACAGCAATGG | InaTs; omeGs; InaCs; omeGs; InaAs; omeAs; InaCs; omeAs; InaGs; omeCs; InaAs; omeAs; InaTs; omeGs; InaG-Sup | 497734 |
| UTRN-118 m01 | GCGAACAGCAATGGC | InaGs; omeCs; InaGs; omeAs; InaAs; omeCs; InaAs; omeGs; InaCs; omeAs; InaAs; omeUs; InaGs; omeGs; InaC-Sup | 497735 |
| UTRN-119 m01 | AGTTCTGGCCAGTGA | InaAs; omeGs; InaTs; omeUs; InaCs; omeUs; InaGs; omeGs; InaCs; omeCs; InaAs; omeGs; InaTs; omeGs; InaA-Sup | 497736 |
| UTRN-120 m01 | AGAAGTGTTATTGGA | InaAs; omeGs; InaAs; omeAs; InaGs; omeUs; InaGs; omeUs; InaTs; omeAs; InaTs; omeUs; InaGs; omeGs; InaA-Sup | 497737 |
| UTRN-121 m01 | GAAGTGTTATTGGAC | InaGs; omeAs; InaAs; omeGs; InaTs; omeGs; InaTs; omeUs; InaAs; omeUs; InaTs; omeGs; InaGs; omeAs; InaC-Sup | 497738 |
| UTRN-122 m01 | GGTAGACTTGCGCTA | InaGs; omeGs; InaTs; omeAs; InaGs; omeAs; InaCs; omeUs; InaTs; omeGs; InaCs; omeGs; InaCs; omeUs; InaA-Sup | 497739 |
| UTRN-123 m01 | TAGACTTGCGCTACA | InaTs; omeAs; InaGs; omeAs; InaCs; omeUs; InaTs; omeGs; InaCs; omeGs; InaCs; omeUs; InaAs; omeCs; InaA-Sup | 497740 |
| UTRN-124 m01 | AGACTTGCGCTACAT | InaAs; omeGs; InaAs; omeCs; InaTs; omeUs; InaGs; omeCs; InaGs; omeCs; InaTs; omeAs; InaCs; omeAs; InaT-Sup | 497741 |
| UTRN-125 m01 | GACTTGCGCTACATT | InaGs; omeAs; InaCs; omeUs; InaTs; omeGs; InaCs; omeGs; InaCs; omeUs; InaAs; omeCs; InaAs; omeUs; InaT-Sup | 497742 |
| UTRN-126 m01 | ACTTGCGCTACATTA | InaAs; omeCs; InaTs; omeUs; InaGs; omeCs; InaGs; omeCs; InaTs; omeAs; InaCs; omeAs; InaTs; omeUs; InaA-Sup | 497743 |
| UTRN-127 m01 | CTTGCGCTACATTAA | InaCs; omeUs; InaTs; omeGs; InaCs; omeGs; InaCs; omeUs; InaAs; omeCs; InaAs; omeUs; InaTs; omeAs; InaA-Sup | 497744 |

TABLE 4-continued

Formatted sequences

| OligoID | Base Sequence | Formatted Sequence | SeqID |
|---|---|---|---|
| UTRN-128 m01 | TTGCGCTACATTAAT | InaTs; omeUs; InaGs; omeCs; InaGs; omeCs; InaTs; omeAs; InaCs; omeAs; InaTs; omeUs; InaAs; omeAs; InaT-Sup | 497745 |
| UTRN-129 m01 | TGCGCTACATTAATA | InaTs; omeGs; InaCs; omeGs; InaCs; omeUs; InaAs; omeCs; InaAs; omeUs; InaTs; omeAs; InaAs; omeUs; InaA-Sup | 497746 |
| UTRN-130 m01 | GCGCTACATTAATAT | InaGs; omeCs; InaGs; omeCs; InaTs; omeAs; InaCs; omeAs; InaTs; omeUs; InaAs; omeAs; InaTs; omeAs; InaT-Sup | 497747 |
| UTRN-131 m01 | GAAAGAACAGAGTGA | InaGs; omeAs; InaAs; omeAs; InaAs; omeAs; InaAs; omeCs; InaAs; omeGs; InaAs; omeGs; InaTs; omeGs; InaA-Sup | 497748 |
| UTRN-132 m01 | AAAGAACAGAGTGAC | InaAs; omeAs; InaAs; omeGs; InaAs; omeAs; InaCs; omeAs; InaGs; omeAs; InaGs; omeUs; InaGs; omeAs; InaC-Sup | 497749 |
| UTRN-133 m01 | TCCATTCTGGTTCGG | InaTs; omeCs; InaCs; omeAs; InaTs; omeUs; InaCs; omeUs; InaGs; omeGs; InaTs; omeUs; InaCs; omeGs; InaG-Sup | 497750 |
| UTRN-134 m01 | CCATTCTGGTTCGGT | InaCs; omeCs; InaAs; omeUs; InaTs; omeCs; InaTs; omeGs; InaGs; omeUs; InaTs; omeCs; InaGs; omeGs; InaT-Sup | 497751 |
| UTRN-135 m01 | ATTCTGGTTCGGTCT | InaAs; omeUs; InaTs; omeCs; InaTs; omeGs; InaGs; omeUs; InaTs; omeCs; InaGs; omeGs; InaTs; omeCs; InaT-Sup | 497752 |
| UTRN-136 m01 | TTCTGGTTCGGTCTC | InaTs; omeUs; InaCs; omeUs; InaGs; omeGs; InaTs; omeUs; InaCs; omeGs; InaGs; omeUs; InaCs; omeUs; InaC-Sup | 497753 |
| UTRN-157 m08 | CAGTATTATCTACAC | InaCs; InaAs; InaGs; dTs; dAs; dTs; dTs; dAs; dTs; dCs; dTs; dAs; InaCs; InaAs; InaC-Sup | 320709 |
| UTRN-158 m08 | AGTATTATCTACACT | InaAs; InaGs; InaTs; dAs; dTs; dTs; dAs; dTs; dCs; dTs; dAs; dCs; InaAs; InaCs; InaT-Sup | 320710 |
| UTRN-159 m08 | TATCTACACTGATCT | InaTs; InaAs; InaTs; dCs; dTs; dAs; dCs; dAs; dCs; dTs; dGs; dAs; InaTs; InaCs; InaT-Sup | 320715 |
| UTRN-160 m08 | ATCTACACTGATCTT | InaAs; InaTs; InaCs; dTs; dAs; dCs; dAs; dCs; dTs; dGs; dAs; dTs; InaCs; InaTs; InaT-Sup | 320716 |
| UTRN-161 m08 | TGCACACTTGGATTC | InaTs; InaGs; InaCs; dAs; dCs; dAs; dCs; dTs; dTs; dGs; dGs; dAs; InaTs; InaTs; InaC-Sup | 320742 |
| UTRN-162 m08 | GCACACTTGGATTCT | InaGs; InaCs; InaAs; dCs; dAs; dCs; dTs; dTs; dGs; dGs; dAs; dTs; InaTs; InaCs; InaT-Sup | 320743 |
| UTRN-163 m08 | GGATTCTAACCTGCA | InaGs; InaGs; InaAs; dTs; dTs; dCs; dTs; dAs; dAs; dCs; dCs; dTs; InaGs; InaCs; InaA-Sup | 320751 |
| UTRN-164 m08 | GATTCTAACCTGCAA | InaGs; InaAs; InaTs; dTs; dCs; dTs; dAs; dAs; dCs; dCs; dTs; dGs; InaCs; InaAs; InaA-Sup | 320752 |
| UTRN-165 m08 | TTCTAACCTGCAATA | InaTs; InaTs; InaCs; dTs; dAs; dAs; dCs; dCs; dTs; dGs; dCs; dAs; InaAs; InaTs; InaA-Sup | 320754 |
| UTRN-166 m08 | TCTAACCTGCAATAT | InaTs; InaCs; InaTs; dAs; dAs; dCs; dCs; dTs; dGs; dCs; dAs; dAs; InaTs; InaAs; InaT-Sup | 320755 |
| UTRN-167 m08 | ATTTTTATCTCTAAA | InaAs; InaTs; InaTs; dTs; dTs; dTs; dAs; dTs; dCs; dTs; dCs; dTs; InaAs; InaAs; InaA-Sup | 320821 |
| UTRN-168 m08 | GAGTTAGATATCAAG | InaGs; InaAs; InaGs; dTs; dTs; dAs; dGs; dAs; dTs; dAs; dTs; dCs; InaAs; InaAs; InaG-Sup | 320838 |
| UTRN-169 m08 | AGTTAGATATCAAGG | InaAs; InaGs; InaTs; dTs; dAs; dGs; dAs; dTs; dAs; dTs; dCs; dAs; InaAs; InaGs; InaG-Sup | 320839 |
| UTRN-170 m08 | CATGGTATTAGATTA | InaCs; InaAs; InaTs; dGs; dGs; dTs; dAs; dTs; dTs; dAs; dGs; dAs; InaTs; InaTs; InaA-Sup | 320858 |
| UTRN-171 m08 | GGTATTAGATTACAC | InaGs; InaGs; InaTs; dAs; dTs; dTs; dAs; dGs; dAs; dTs; dTs; dAs; InaCs; InaAs; InaC-Sup | 320861 |
| UTRN-172 m08 | GTATTAGATTACACA | InaGs; InaTs; InaAs; dTs; dTs; dAs; dGs; dAs; dTs; dTs; dAs; dCs; InaAs; InaCs; InaA-Sup | 320862 |

TABLE 4-continued

Formatted sequences

| OligoID | Base Sequence | Formatted Sequence | SeqID |
|---|---|---|---|
| UTRN-173 m08 | TATTAGATTACACAA | InaTs; InaAs; InaTs; dTs; dAs; dGs; dAs; dTs; dTs; dAs; dCs; dAs; InaCs; InaAs; InaA-Sup | 320863 |
| UTRN-174 m08 | TAGATTACACAATAT | InaTs; InaAs; InaGs; dAs; dTs; dTs; dAs; dCs; dAs; dCs; dAs; dAs; InaTs; InaAs; InaT-Sup | 320866 |
| UTRN-175 m08 | ATCTTATTAGTACTC | InaAs; InaTs; InaCs; dTs; dTs; dAs; dTs; dTs; dAs; dGs; dTs; dAs; InaCs; InaTs; InaC-Sup | 320918 |
| UTRN-176 m08 | ATTAGTACTCTTCTG | InaAs; InaTs; InaTs; dAs; dGs; dTs; dAs; dCs; dTs; dCs; dTs; dTs; InaCs; InaTs; InaG-Sup | 320923 |
| UTRN-177 m08 | TTAGTACTCTTCTGT | InaTs; InaTs; InaAs; dGs; dTs; dAs; dCs; dTs; dCs; dTs; dTs; dCs; InaTs; InaGs; InaT-Sup | 320924 |
| UTRN-178 m08 | AGTACTCTTCTGTAG | InaAs; InaGs; InaTs; dAs; dCs; dTs; dCs; dTs; dTs; dCs; dTs; dGs; InaTs; InaAs; InaG-Sup | 320926 |
| UTRN-179 m08 | GGAATGGTTCAGACA | InaGs; InaGs; InaAs; dAs; dTs; dGs; dGs; dTs; dTs; dCs; dAs; dGs; InaAs; InaCs; InaA-Sup | 320952 |
| UTRN-180 m08 | GAATGGTTCAGACAG | InaGs; InaAs; InaAs; dTs; dGs; dGs; dTs; dTs; dCs; dAs; dGs; dAs; InaCs; InaAs; InaG-Sup | 320953 |
| UTRN-181 m08 | AATGGTTCAGACAGT | InaAs; InaAs; InaTs; dGs; dGs; dTs; dTs; dCs; dAs; dGs; dAs; dCs; InaAs; InaGs; InaT-Sup | 320954 |
| UTRN-182 m08 | GGTTCAGACAGTATC | InaGs; InaGs; InaTs; dTs; dCs; dAs; dGs; dAs; dCs; dAs; dGs; dTs; InaAs; InaTs; InaC-Sup | 320957 |
| UTRN-183 m08 | TGTGGGTGTAAGCAT | InaTs; InaGs; InaTs; dGs; dGs; dGs; dTs; dGs; dTs; dAs; dAs; dGs; InaCs; InaAs; InaT-Sup | 320978 |
| UTRN-184 m08 | GTGGGTGTAAGCATG | InaGs; InaTs; InaGs; dGs; dGs; dTs; dGs; dTs; dAs; dAs; dGs; dCs; InaAs; InaTs; InaG-Sup | 320979 |
| UTRN-185 m08 | GTAAGCATGGCCACC | InaGs; InaTs; InaAs; dAs; dGs; dCs; dAs; dTs; dGs; dGs; dCs; dCs; InaAs; InaCs; InaC-Sup | 320985 |
| UTRN-186 m08 | CTGCTCTGTGCCTGA | InaCs; InaTs; InaGs; dCs; dTs; dCs; dTs; dGs; dTs; dGs; dCs; dCs; InaTs; InaGs; InaA-Sup | 321033 |
| UTRN-187 m08 | TGCTCTGTGCCTGAG | InaTs; InaGs; InaCs; dTs; dCs; dTs; dGs; dTs; dGs; dCs; dCs; dTs; InaGs; InaAs; InaG-Sup | 321034 |
| UTRN-188 m08 | CTGAGTAAAGTAGAG | InaCs; InaTs; InaGs; dAs; dGs; dTs; dAs; dAs; dAs; dGs; dTs; dAs; InaGs; InaAs; InaG-Sup | 321044 |
| UTRN-189 m08 | GTCTTCCCATAACAG | InaGs; InaTs; InaCs; dTs; dTs; dCs; dCs; dCs; dAs; dTs; dAs; dAs; InaCs; InaAs; InaG-Sup | 497754 |
| UTRN-190 m08 | CCCATAACAGACCTT | InaCs; InaCs; InaCs; dAs; dTs; dAs; dAs; dCs; dAs; dGs; dAs; dCs; InaCs; InaTs; InaT-Sup | 497755 |
| UTRN-191 m08 | CCATAACAGACCTTC | InaCs; InaCs; InaAs; dTs; dAs; dAs; dCs; dAs; dGs; dAs; dCs; dCs; InaTs; InaTs; InaC-Sup | 497756 |
| UTRN-240 m08 | CCGCCACTGTCTCGG | InaCs; InaCs; InaGs; dCs; dCs; dAs; dCs; dTs; dGs; dTs; dCs; dTs; InaCs; InaGs; InaG-Sup | 497757 |
| UTRN-241 m08 | TTTTCGCCGCCACTG | InaTs; InaTs; InaTs; dTs; dCs; dGs; dCs; dCs; dGs; dCs; dAs; dCs; InaTs; InaGs; InaG-Sup | 497758 |
| UTRN-242 m08 | GTTTTCGCCGCCACT | InaGs; InaTs; InaTs; dTs; dTs; dCs; dGs; dCs; dCs; dGs; dCs; dCs; InaAs; InaCs; InaT-Sup | 497759 |
| UTRN-243 m08 | AGTTTTCGCCGCCAC | InaAs; InaGs; InaTs; dTs; dTs; dTs; dCs; dGs; dCs; dCs; dGs; dCs; InaCs; InaAs; InaC-Sup | 497760 |
| UTRN-244 m08 | GAGTTTTCGCCGCCA | InaGs; InaAs; InaGs; dTs; dTs; dTs; dTs; dCs; dGs; dCs; dCs; dGs; InaCs; InaCs; InaA-Sup | 497761 |
| UTRN-245 m08 | AGAGTTTTCGCCGCC | InaAs; InaGs; InaAs; dGs; dTs; dTs; dTs; dTs; dCs; dGs; dCs; dCs; InaGs; InaCs; InaC-Sup | 497762 |

TABLE 4-continued

Formatted sequences

| OligoID | Base Sequence | Formatted Sequence | SeqID |
|---|---|---|---|
| UTRN-246 m08 | GAGAGTTTTCGC CGC | InaGs; InaAs; InaGs; dAs; dGs; dTs; dTs; dTs; dTs; dCs; dGs; dCs; InaCs; InaGs; InaC-Sup | 497763 |
| UTRN-247 m08 | CAGAGAGTTTTC GCC | InaCs; InaAs; InaGs; dAs; dGs; dAs; dGs; dTs; dTs; dTs; dTs; dCs; InaGs; InaCs; InaC-Sup | 497764 |
| UTRN-248 m08 | CCGCTTACAAGG CAT | InaCs; InaCs; InaGs; dCs; dTs; dTs; dAs; dCs; dAs; dAs; dGs; dGs; InaCs; InaAs; InaT-Sup | 497765 |
| UTRN-249 m08 | GCTCCGCTTACAA GG | InaGs; InaCs; InaTs; dCs; dCs; dGs; dCs; dTs; dTs; dAs; dCs; dAs; InaAs; InaGs; InaG-Sup | 497766 |
| UTRN-250 m08 | TGCTCCGCTTACA AG | InaTs; InaGs; InaCs; dTs; dCs; dCs; dGs; dCs; dTs; dTs; dAs; dCs; InaAs; InaAs; InaG-Sup | 497767 |
| UTRN-251 m08 | TTTTGCTCCGCTT AC | InaTs; InaTs; InaTs; dTs; dGs; dCs; dTs; dCs; dCs; dGs; dCs; dTs; InaTs; InaAs; InaC-Sup | 497768 |
| UTRN-252 m08 | ACGTTGAACCTTG TT | InaAs; InaCs; InaGs; dTs; dTs; dGs; dAs; dAs; dCs; dCs; dTs; dTs; InaGs; InaTs; InaT-Sup | 497769 |
| UTRN-253 m08 | GACGTTGAACCTT GT | InaGs; InaAs; InaCs; dGs; dTs; dTs; dGs; dAs; dAs; dCs; dCs; dTs; InaTs; InaGs; InaT-Sup | 497770 |
| UTRN-254 m08 | AGACGTTGAACC TTG | InaAs; InaGs; InaAs; dCs; dGs; dTs; dTs; dGs; dAs; dAs; dCs; dCs; InaTs; InaTs; InaG-Sup | 497771 |
| UTRN-255 m08 | CAGACGTTGAAC CTT | InaCs; InaAs; InaGs; dAs; dCs; dGs; dTs; dTs; dGs; dAs; dAs; dCs; InaCs; InaTs; InaT-Sup | 497772 |
| UTRN-256 m08 | GCAGACGTTGAA CCT | InaGs; InaCs; InaAs; dGs; dAs; dCs; dGs; dTs; dTs; dGs; dAs; dAs; InaCs; InaCs; InaT-Sup | 497773 |
| UTRN-257 m08 | AATGTCCAAGGC GTG | InaAs; InaAs; InaTs; dGs; dTs; dCs; dCs; dAs; dAs; dGs; dGs; dCs; InaGs; InaTs; InaG-Sup | 497774 |
| UTRN-258 m08 | GTCGGAATTCTA ATG | InaGs; InaTs; InaCs; dGs; dGs; dAs; dAs; dTs; dTs; dCs; dTs; dAs; InaAs; InaTs; InaG-Sup | 497775 |
| UTRN-259 m08 | AGTCGGAATTCT AAT | InaAs; InaGs; InaTs; dCs; dGs; dGs; dAs; dAs; dTs; dTs; dCs; dTs; InaAs; InaAs; InaT-Sup | 497776 |
| UTRN-260 m08 | AAGTCGGAATTC TAA | InaAs; InaAs; InaGs; dTs; dCs; dGs; dGs; dAs; dAs; dTs; dTs; dCs; InaTs; InaAs; InaA-Sup | 497777 |
| UTRN-261 m08 | GAAGTCGGAATT CTA | InaGs; InaAs; InaAs; dGs; dTs; dCs; dGs; dGs; dAs; dAs; dTs; dTs; InaCs; InaTs; InaA-Sup | 497778 |
| UTRN-262 m08 | AGAAGTCGGAAT TCT | InaAs; InaGs; InaAs; dAs; dGs; dTs; dCs; dGs; dGs; dAs; dAs; dTs; InaTs; InaCs; InaT-Sup | 497779 |
| UTRN-263 m08 | CGTTGCGCTTCTC CC | InaCs; InaGs; InaTs; dTs; dGs; dCs; dGs; dCs; dTs; dTs; dCs; dTs; InaCs; InaCs; InaC-Sup | 497780 |
| UTRN-264 m08 | GCGTTGCGCTTCT CC | InaGs; InaCs; InaGs; dTs; dTs; dGs; dCs; dGs; dCs; dTs; dTs; dCs; InaTs; InaCs; InaC-Sup | 497781 |
| UTRN-265 m08 | AGCGTTGCGCTTC TC | InaAs; InaGs; InaCs; dGs; dTs; dTs; dGs; dCs; dGs; dCs; dTs; dTs; InaCs; InaTs; InaC-Sup | 497782 |
| UTRN-266 m08 | GAGCGTTGCGCT TCT | InaGs; InaAs; InaGs; dCs; dGs; dTs; dTs; dGs; dCs; dGs; dCs; dTs; InaTs; InaCs; InaT-Sup | 497783 |
| UTRN-267 m08 | TGAGCGTTGCGC TTC | InaTs; InaGs; InaAs; dGs; dCs; dGs; dTs; dTs; dGs; dCs; dGs; dCs; InaTs; InaTs; InaC-Sup | 497784 |
| UTRN-268 m08 | GCGTGTGAGCGT TGC | InaGs; InaCs; InaGs; dTs; dGs; dTs; dGs; dAs; dGs; dCs; dGs; dTs; InaTs; InaGs; InaC-Sup | 497785 |
| UTRN-269 m08 | TGCGTGTGAGCG TTG | InaTs; InaGs; InaCs; dGs; dTs; dGs; dTs; dGs; dAs; dGs; dCs; dGs; InaTs; InaTs; InaG-Sup | 497786 |
| UTRN-270 m08 | GCGGTCTCTTGGT GG | InaGs; InaCs; InaGs; dGs; dTs; dCs; dTs; dCs; dTs; dTs; dGs; dGs; InaTs; InaGs; InaG-Sup | 497787 |

TABLE 4-continued

Formatted sequences

| OligoID | Base Sequence | Formatted Sequence | SeqID |
|---|---|---|---|
| UTRN-271 m08 | CGCGGTCTCTTGGTG | InaCs; InaGs; InaCs; dGs; dGs; dTs; dCs; dTs; dCs; dTs; dTs; dGs; InaGs; InaTs; InaG-Sup | 497788 |
| UTRN-272 m08 | CTGCGCGGTCTCTTG | InaCs; InaTs; InaGs; dCs; dGs; dCs; dGs; dGs; dTs; dCs; dTs; dCs; InaTs; InaTs; InaG-Sup | 497789 |
| UTRN-273 m08 | ATATTCGCTATGTTT | InaAs; InaTs; InaAs; dTs; dTs; dCs; dGs; dCs; dTs; dAs; dTs; dGs; InaTs; InaTs; InaT-Sup | 497790 |
| UTRN-274 m08 | TTCAATATATTCGCT | InaTs; InaTs; InaCs; dAs; dAs; dTs; dAs; dTs; dAs; dTs; dTs; dCs; InaGs; InaCs; InaT-Sup | 497791 |
| UTRN-275 m08 | TTAACGATTCAAATT | InaTs; InaTs; InaAs; dAs; dCs; dGs; dAs; dTs; dTs; dCs; dAs; dAs; InaAs; InaTs; InaT-Sup | 497792 |
| UTRN-276 m08 | AGTTAACGATTCAAA | InaAs; InaGs; InaTs; dTs; dAs; dAs; dCs; dGs; dAs; dTs; dTs; dCs; InaAs; InaAs; InaA-Sup | 497793 |
| UTRN-277 m08 | AAGTTAACGATTCAA | InaAs; InaAs; InaGs; dTs; dTs; dAs; dAs; dCs; dGs; dAs; dTs; dTs; InaCs; InaAs; InaA-Sup | 497794 |
| UTRN-278 m08 | ACTAAGTTAACGATT | InaAs; InaCs; InaTs; dAs; dAs; dGs; dTs; dTs; dAs; dAs; dCs; dGs; InaAs; InaTs; InaT-Sup | 497795 |
| UTRN-279 m08 | AACTAAGTTAACGAT | InaAs; InaAs; InaCs; dTs; dAs; dAs; dGs; dTs; dTs; dAs; dAs; dCs; InaGs; InaAs; InaT-Sup | 497796 |
| UTRN-280 m08 | CACTGCGTAAATACA | InaCs; InaAs; InaCs; dTs; dGs; dCs; dGs; dTs; dAs; dAs; dAs; dTs; InaAs; InaCs; InaA-Sup | 497797 |
| UTRN-281 m08 | GTGTCACTGCGTAAA | InaGs; InaTs; InaGs; dTs; dCs; dAs; dCs; dTs; dGs; dCs; dGs; dTs; InaAs; InaAs; InaA-Sup | 497798 |
| UTRN-282 m08 | GTCTCGTGCAAGTTG | InaGs; InaTs; InaCs; dTs; dCs; dGs; dTs; dGs; dCs; dAs; dAs; dGs; InaTs; InaTs; InaG-Sup | 497799 |
| UTRN-283 m08 | ATAATGTCTCGTGCA | InaAs; InaTs; InaAs; dAs; dTs; dGs; dTs; dCs; dTs; dCs; dGs; dTs; InaGs; InaCs; InaA-Sup | 497800 |
| UTRN-284 m08 | ACGCTACTTGTTCAG | InaAs; InaCs; InaGs; dCs; dTs; dAs; dCs; dTs; dTs; dGs; dTs; dTs; InaCs; InaAs; InaG-Sup | 497801 |
| UTRN-285 m08 | AACGCTACTTGTTCA | InaAs; InaAs; InaCs; dGs; dCs; dTs; dAs; dCs; dTs; dTs; dGs; dTs; InaTs; InaCs; InaA-Sup | 497802 |
| UTRN-286 m08 | GAACGCTACTTGTTC | InaGs; InaAs; InaAs; dCs; dGs; dCs; dTs; dAs; dCs; dTs; dTs; dGs; InaTs; InaTs; InaC-Sup | 497803 |
| UTRN-287 m08 | AGAACGCTACTTGTT | InaAs; InaGs; InaAs; dAs; dCs; dGs; dCs; dTs; dAs; dCs; dTs; dTs; InaGs; InaTs; InaT-Sup | 497804 |
| UTRN-288 m08 | AAGAACGCTACTTGT | InaAs; InaAs; InaGs; dAs; dAs; dCs; dGs; dCs; dTs; dAs; dCs; dTs; InaTs; InaGs; InaT-Sup | 497805 |
| UTRN-289 m08 | CCAAGAACGCTACTT | InaCs; InaCs; InaAs; dAs; dGs; dAs; dAs; dCs; dGs; dCs; dTs; dAs; InaCs; InaTs; InaT-Sup | 497806 |
| unc-232 m12 | CTACGCGTCGACGGT | InaCs; dTs; InaAs; dCs; InaGs; dCs; InaGs; dTs; InaCs; dGs; InaAs; dCs; InaGs; dGs; InaT-Sup | 497808 |
| unc-232 m01 | CTACGCGTCGACGGT | InaCs; omeUs; InaAs; omeCs; InaGs; omeCs; InaGs; omeUs; InaCs; omeGs; InaAs; omeCs; InaGs; omeGs; InaT-Sup | 497808 |
| unc-293 m12 | CCGATTCGCGCGTAA | InaCs; dCs; InaGs; dAs; InaTs; dTs; InaCs; dGs; InaCs; dGs; InaCs; dGs; InaTs; dAs; InaA-Sup | 497809 |
| unc-293 m01 | CCGATTCGCGCGTAA | InaCs; omeCs; InaGs; omeAs; InaTs; omeUs; InaCs; omeGs; InaCs; omeGs; InaCs; omeGs; InaTs; omeAs; InaA-Sup | 497809 |

BRIEF DESCRIPTION OF SEQUENCE LISTING

| SEQ ID | Chrom | Gene | Chr. Start | Chr. End | Strand |
|---|---|---|---|---|---|
| 1 | chr6 | UTRN | 144600872 | 145186170 | + |
| 2 | chr6 | UTRN | 144600872 | 145186170 | − |
| 3 | chr10 | Utrn | 12089985 | 12593533 | − |
| 4 | chr10 | Utrn | 12089985 | 12593533 | + |
| 5 | chr6 | UTRN | 144610489 | 144610535 | + |
| 6 | chr6 | UTRN | 144612994 | 144613040 | + |
| 7 | chr6 | UTRN | 144614120 | 144614162 | + |
| 8 | chr6 | UTRN | 144614968 | 144615021 | + |
| 9 | chr6 | UTRN | 144618862 | 144618901 | + |
| 10 | chr6 | UTRN | 144621690 | 144621714 | + |
| 11 | chr6 | UTRN | 144625028 | 144625096 | + |
| 12 | chr6 | UTRN | 144625129 | 144625174 | + |
| 13 | chr6 | UTRN | 144625319 | 144625379 | + |
| 14 | chr6 | UTRN | 144628965 | 144629011 | + |
| 15 | chr6 | UTRN | 144633818 | 144633869 | + |
| 16 | chr6 | UTRN | 144633933 | 144633968 | + |
| 17 | chr6 | UTRN | 144658267 | 144658302 | + |
| 18 | chr6 | UTRN | 144685087 | 144685140 | + |
| 19 | chr6 | UTRN | 144695039 | 144695063 | + |
| 20 | chr6 | UTRN | 144699670 | 144699699 | + |
| 21 | chr6 | UTRN | 144704043 | 144704398 | + |
| 22 | chr6 | UTRN | 144706312 | 144706345 | + |
| 23 | chr6 | UTRN | 144706654 | 144706704 | + |
| 24 | chr6 | UTRN | 144721683 | 144721738 | + |
| 25 | chr6 | UTRN | 144722580 | 144722627 | + |
| 26 | chr6 | UTRN | 144724848 | 144724889 | + |
| 27 | chr6 | UTRN | 144727897 | 144727947 | + |
| 28 | chr6 | UTRN | 144746408 | 144746448 | + |
| 29 | chr6 | UTRN | 144749102 | 144749152 | + |
| 30 | chr6 | UTRN | 144749948 | 144750026 | + |
| 31 | chr6 | UTRN | 144750728 | 144750789 | + |
| 32 | chr6 | UTRN | 144750789 | 144750853 | + |
| 33 | chr6 | UTRN | 144757162 | 144757214 | + |
| 34 | chr6 | UTRN | 144757214 | 144757274 | + |
| 35 | chr6 | UTRN | 144758752 | 144758807 | + |
| 36 | chr6 | UTRN | 144758807 | 144758864 | + |
| 37 | chr6 | UTRN | 144761513 | 144761579 | + |
| 38 | chr6 | UTRN | 144765456 | 144765506 | + |
| 39 | chr6 | UTRN | 144768420 | 144768461 | + |
| 40 | chr6 | UTRN | 144768737 | 144768764 | + |
| 41 | chr6 | UTRN | 144772549 | 144772627 | + |
| 42 | chr6 | UTRN | 144774960 | 144775001 | + |
| 43 | chr6 | UTRN | 144779914 | 144779960 | + |
| 44 | chr6 | UTRN | 144780026 | 144780070 | + |
| 45 | chr6 | UTRN | 144780278 | 144780324 | + |
| 46 | chr6 | UTRN | 144783879 | 144783933 | + |
| 47 | chr6 | UTRN | 144783933 | 144783995 | + |
| 48 | chr6 | UTRN | 144800953 | 144800999 | + |
| 49 | chr6 | UTRN | 144802780 | 144802822 | + |
| 50 | chr6 | UTRN | 144803427 | 144803473 | + |
| 51 | chr6 | UTRN | 144803714 | 144803742 | + |
| 52 | chr6 | UTRN | 144803774 | 144803849 | + |
| 53 | chr6 | UTRN | 144806673 | 144806714 | + |
| 54 | chr6 | UTRN | 144808684 | 144808739 | + |
| 55 | chr6 | UTRN | 144808739 | 144808803 | + |
| 56 | chr6 | UTRN | 144809834 | 144809881 | + |
| 57 | chr6 | UTRN | 144811266 | 144811310 | + |
| 58 | chr6 | UTRN | 144814476 | 144814522 | + |
| 59 | chr6 | UTRN | 144815156 | 144815199 | + |
| 60 | chr6 | UTRN | 144820469 | 144820529 | + |
| 61 | chr6 | UTRN | 144832193 | 144832243 | + |
| 62 | chr6 | UTRN | 144835120 | 144835166 | + |
| 63 | chr6 | UTRN | 144835862 | 144835907 | + |
| 64 | chr6 | UTRN | 144837423 | 144837465 | + |
| 65 | chr6 | UTRN | 144837943 | 144837989 | + |
| 66 | chr6 | UTRN | 144844263 | 144844304 | + |
| 67 | chr6 | UTRN | 144858722 | 144858798 | + |
| 68 | chr6 | UTRN | 144870778 | 144870817 | + |
| 69 | chr6 | UTRN | 144871113 | 144871154 | + |
| 70 | chr6 | UTRN | 144872123 | 144872165 | + |
| 71 | chr6 | UTRN | 144872599 | 144872669 | + |
| 72 | chr6 | UTRN | 144873625 | 144873662 | + |
| 73 | chr6 | UTRN | 144875136 | 144875182 | + |
| 74 | chr6 | UTRN | 144875895 | 144875938 | + |
| 75 | chr6 | UTRN | 144886315 | 144886378 | + |
| 76 | chr6 | UTRN | 144904604 | 144904645 | + |
| 77 | chr6 | UTRN | 144905276 | 144905300 | + |
| 78 | chr6 | UTRN | 144906334 | 144906358 | + |
| 79 | chr6 | UTRN | 144907025 | 144907055 | + |
| 80 | chr6 | UTRN | 144908864 | 144908908 | + |
| 81 | chr6 | UTRN | 144909055 | 144909078 | + |
| 82 | chr6 | UTRN | 144910040 | 144910085 | + |
| 83 | chr6 | UTRN | 144918990 | 144919013 | + |
| 84 | chr6 | UTRN | 144935390 | 144935427 | + |
| 85 | chr6 | UTRN | 144938199 | 144938248 | + |
| 86 | chr6 | UTRN | 144941446 | 144941489 | + |
| 87 | chr6 | UTRN | 144941551 | 144941596 | + |
| 88 | chr6 | UTRN | 144941700 | 144941748 | + |
| 89 | chr6 | UTRN | 144941856 | 144941912 | + |
| 90 | chr6 | UTRN | 144941912 | 144941988 | + |
| 91 | chr6 | UTRN | 144942080 | 144942136 | + |
| 92 | chr6 | UTRN | 144944667 | 144944712 | + |
| 93 | chr6 | UTRN | 144945160 | 144945207 | + |
| 94 | chr6 | UTRN | 144950918 | 144950987 | + |
| 95 | chr6 | UTRN | 144952595 | 144952650 | + |
| 96 | chr6 | UTRN | 144954758 | 144954804 | + |
| 97 | chr6 | UTRN | 144960952 | 144960996 | + |
| 98 | chr6 | UTRN | 144968386 | 144968438 | + |
| 99 | chr6 | UTRN | 144981668 | 144981709 | + |
| 100 | chr6 | UTRN | 144985026 | 144985072 | + |
| 101 | chr6 | UTRN | 144999637 | 144999686 | + |
| 102 | chr6 | UTRN | 144999750 | 144999785 | + |
| 103 | chr6 | UTRN | 144999904 | 144999956 | + |
| 104 | chr6 | UTRN | 145012224 | 145012561 | + |
| 105 | chr6 | UTRN | 145017897 | 145017969 | + |
| 106 | chr6 | UTRN | 145017978 | 145018021 | + |
| 107 | chr6 | UTRN | 145019229 | 145019261 | + |
| 108 | chr6 | UTRN | 145021232 | 145021278 | + |
| 109 | chr6 | UTRN | 145021336 | 145021382 | + |
| 110 | chr6 | UTRN | 145031285 | 145031331 | + |
| 111 | chr6 | UTRN | 145038424 | 145038467 | + |
| 112 | chr6 | UTRN | 145042706 | 145042751 | + |
| 113 | chr6 | UTRN | 145047775 | 145047820 | + |
| 114 | chr6 | UTRN | 145051549 | 145051592 | + |
| 115 | chr6 | UTRN | 145061899 | 145061941 | + |
| 116 | chr6 | UTRN | 145063569 | 145063615 | + |
| 117 | chr6 | UTRN | 145069445 | 145069497 | + |
| 118 | chr6 | UTRN | 145072959 | 145073005 | + |
| 119 | chr6 | UTRN | 145079115 | 145079162 | + |
| 120 | chr6 | UTRN | 145079204 | 145079271 | + |
| 121 | chr6 | UTRN | 145080780 | 145080816 | + |
| 122 | chr6 | UTRN | 145080843 | 145080885 | + |
| 123 | chr6 | UTRN | 145081884 | 145081930 | + |
| 124 | chr6 | UTRN | 145087734 | 145087827 | + |
| 125 | chr6 | UTRN | 145087827 | 145087911 | + |
| 126 | chr6 | UTRN | 145088046 | 145088124 | + |
| 127 | chr6 | UTRN | 145088210 | 145088245 | + |
| 128 | chr6 | UTRN | 145088678 | 145088723 | + |
| 129 | chr6 | UTRN | 145090281 | 145090327 | + |
| 130 | chr6 | UTRN | 145090884 | 145090934 | + |
| 131 | chr6 | UTRN | 145093542 | 145093591 | + |
| 132 | chr6 | UTRN | 145094155 | 145094199 | + |
| 133 | chr6 | UTRN | 145096714 | 145096756 | + |
| 134 | chr6 | UTRN | 145101237 | 145101284 | + |
| 135 | chr6 | UTRN | 145101598 | 145101642 | + |
| 136 | chr6 | UTRN | 145127145 | 145127194 | + |
| 137 | chr6 | UTRN | 145127467 | 145127507 | + |
| 138 | chr6 | UTRN | 145127866 | 145127929 | + |
| 139 | chr6 | UTRN | 145128105 | 145128160 | + |
| 140 | chr6 | UTRN | 145128415 | 145128460 | + |
| 141 | chr6 | UTRN | 145132350 | 145132397 | + |
| 142 | chr6 | UTRN | 145132917 | 145132974 | + |
| 143 | chr6 | UTRN | 145133779 | 145133802 | + |
| 144 | chr6 | UTRN | 145134097 | 145134169 | + |
| 145 | chr6 | UTRN | 145134835 | 145134881 | + |
| 146 | chr6 | UTRN | 145142034 | 145142135 | + |
| 147 | chr6 | UTRN | 145142629 | 145142676 | + |
| 148 | chr6 | UTRN | 145148750 | 145148806 | + |
| 149 | chr6 | UTRN | 145149936 | 145149984 | + |
| 150 | chr6 | UTRN | 145153900 | 145154300 | + |
| 151 | chr6 | UTRN | 145154735 | 145154782 | + |
| 152 | chr6 | UTRN | 145155438 | 145155468 | + |

| SEQ ID | Chrom | Gene | Chr. Start | Chr. End | Strand | SEQ ID | Chrom | Gene | Chr. Start | Chr. End | Strand |
|---|---|---|---|---|---|---|---|---|---|---|---|
| 153 | chr6 | UTRN | 145156972 | 145157019 | + | 230 | chr6 | UTRN | 144868778 | 144872817 | + |
| 154 | chr6 | UTRN | 145157440 | 145157555 | + | 231 | chr6 | UTRN | 144869113 | 144873154 | + |
| 155 | chr6 | UTRN | 145157566 | 145157621 | + | 232 | chr6 | UTRN | 144870123 | 144874165 | + |
| 156 | chr6 | UTRN | 145158149 | 145158194 | + | 233 | chr6 | UTRN | 144870599 | 144874669 | + |
| 157 | chr6 | UTRN | 145160356 | 145160409 | + | 234 | chr6 | UTRN | 144871625 | 144875662 | + |
| 158 | chr6 | UTRN | 145161881 | 145161927 | + | 235 | chr6 | UTRN | 144873136 | 144877182 | + |
| 159 | chr6 | UTRN | 145167107 | 145167151 | + | 236 | chr6 | UTRN | 144873895 | 144877938 | + |
| 160 | chr6 | UTRN | 145167205 | 145167243 | + | 237 | chr6 | UTRN | 144884315 | 144888378 | + |
| 161 | chr6 | UTRN | 145168292 | 145168344 | + | 238 | chr6 | UTRN | 144902604 | 144906645 | + |
| 162 | chr6 | UTRN | 145169033 | 145169085 | + | 239 | chr6 | UTRN | 144903276 | 144907300 | + |
| 163 | chr6 | UTRN | 145169156 | 145169202 | + | 240 | chr6 | UTRN | 144904334 | 144908358 | + |
| 164 | chr6 | UTRN | 145169270 | 145169315 | + | 241 | chr6 | UTRN | 144905025 | 144909055 | + |
| 165 | chr6 | UTRN | 145171814 | 145171863 | + | 242 | chr6 | UTRN | 144906864 | 144910908 | + |
| 166 | chr6 | UTRN | 145173631 | 145173718 | + | 243 | chr6 | UTRN | 144907055 | 144911078 | + |
| 167 | chr6 | UTRN | 144608489 | 144612535 | + | 244 | chr6 | UTRN | 144908040 | 144912085 | + |
| 168 | chr6 | UTRN | 144610994 | 144615040 | + | 245 | chr6 | UTRN | 144916990 | 144921013 | + |
| 169 | chr6 | UTRN | 144612120 | 144616162 | + | 246 | chr6 | UTRN | 144933390 | 144937427 | + |
| 170 | chr6 | UTRN | 144612968 | 144617021 | + | 247 | chr6 | UTRN | 144936199 | 144940248 | + |
| 171 | chr6 | UTRN | 144616862 | 144620901 | + | 248 | chr6 | UTRN | 144939446 | 144943489 | + |
| 172 | chr6 | UTRN | 144619690 | 144623714 | + | 249 | chr6 | UTRN | 144939551 | 144943596 | + |
| 173 | chr6 | UTRN | 144623028 | 144627096 | + | 250 | chr6 | UTRN | 144939700 | 144943748 | + |
| 174 | chr6 | UTRN | 144623129 | 144627174 | + | 251 | chr6 | UTRN | 144939856 | 144943912 | + |
| 175 | chr6 | UTRN | 144623319 | 144627379 | + | 252 | chr6 | UTRN | 144939912 | 144943988 | + |
| 176 | chr6 | UTRN | 144626965 | 144631011 | + | 253 | chr6 | UTRN | 144940080 | 144944136 | + |
| 177 | chr6 | UTRN | 144631818 | 144635869 | + | 254 | chr6 | UTRN | 144942667 | 144946712 | + |
| 178 | chr6 | UTRN | 144631933 | 144635968 | + | 255 | chr6 | UTRN | 144943160 | 144947207 | + |
| 179 | chr6 | UTRN | 144656267 | 144660302 | + | 256 | chr6 | UTRN | 144948918 | 144952987 | + |
| 180 | chr6 | UTRN | 144683087 | 144687140 | + | 257 | chr6 | UTRN | 144950595 | 144954650 | + |
| 181 | chr6 | UTRN | 144693039 | 144697063 | + | 258 | chr6 | UTRN | 144952758 | 144956804 | + |
| 182 | chr6 | UTRN | 144697670 | 144701699 | + | 259 | chr6 | UTRN | 144958952 | 144962996 | + |
| 183 | chr6 | UTRN | 144702043 | 144706398 | + | 260 | chr6 | UTRN | 144966386 | 144970438 | + |
| 184 | chr6 | UTRN | 144704312 | 144708345 | + | 261 | chr6 | UTRN | 144979668 | 144983709 | + |
| 185 | chr6 | UTRN | 144704654 | 144708704 | + | 262 | chr6 | UTRN | 144983026 | 144987072 | + |
| 186 | chr6 | UTRN | 144719683 | 144723738 | + | 263 | chr6 | UTRN | 144997637 | 145001686 | + |
| 187 | chr6 | UTRN | 144720580 | 144724627 | + | 264 | chr6 | UTRN | 144997750 | 145001785 | + |
| 188 | chr6 | UTRN | 144722848 | 144726889 | + | 265 | chr6 | UTRN | 144997904 | 145001956 | + |
| 189 | chr6 | UTRN | 144725897 | 144729947 | + | 266 | chr6 | UTRN | 145010224 | 145014561 | + |
| 190 | chr6 | UTRN | 144744408 | 144748448 | + | 267 | chr6 | UTRN | 145015897 | 145019969 | + |
| 191 | chr6 | UTRN | 144747102 | 144751152 | + | 268 | chr6 | UTRN | 145015978 | 145020021 | + |
| 192 | chr6 | UTRN | 144747948 | 144752026 | + | 269 | chr6 | UTRN | 145017229 | 145021261 | + |
| 193 | chr6 | UTRN | 144748728 | 144752789 | + | 270 | chr6 | UTRN | 145019232 | 145023278 | + |
| 194 | chr6 | UTRN | 144748789 | 144752853 | + | 271 | chr6 | UTRN | 145019336 | 145023382 | + |
| 195 | chr6 | UTRN | 144755162 | 144759214 | + | 272 | chr6 | UTRN | 145029285 | 145033331 | + |
| 196 | chr6 | UTRN | 144755214 | 144759274 | + | 273 | chr6 | UTRN | 145036424 | 145040467 | + |
| 197 | chr6 | UTRN | 144756752 | 144760807 | + | 274 | chr6 | UTRN | 145040706 | 145044751 | + |
| 198 | chr6 | UTRN | 144756807 | 144760864 | + | 275 | chr6 | UTRN | 145045775 | 145049820 | + |
| 199 | chr6 | UTRN | 144759513 | 144763579 | + | 276 | chr6 | UTRN | 145049549 | 145053592 | + |
| 200 | chr6 | UTRN | 144763456 | 144767506 | + | 277 | chr6 | UTRN | 145059899 | 145063941 | + |
| 201 | chr6 | UTRN | 144766420 | 144770461 | + | 278 | chr6 | UTRN | 145061569 | 145065615 | + |
| 202 | chr6 | UTRN | 144766737 | 144770764 | + | 279 | chr6 | UTRN | 145067445 | 145071497 | + |
| 203 | chr6 | UTRN | 144770549 | 144774627 | + | 280 | chr6 | UTRN | 145070959 | 145075005 | + |
| 204 | chr6 | UTRN | 144772960 | 144777001 | + | 281 | chr6 | UTRN | 145077115 | 145081162 | + |
| 205 | chr6 | UTRN | 144777914 | 144781960 | + | 282 | chr6 | UTRN | 145077204 | 145081271 | + |
| 206 | chr6 | UTRN | 144778026 | 144782070 | + | 283 | chr6 | UTRN | 145078780 | 145082816 | + |
| 207 | chr6 | UTRN | 144778278 | 144782324 | + | 284 | chr6 | UTRN | 145078843 | 145082885 | + |
| 208 | chr6 | UTRN | 144781879 | 144785933 | + | 285 | chr6 | UTRN | 145079884 | 145083930 | + |
| 209 | chr6 | UTRN | 144781933 | 144785995 | + | 286 | chr6 | UTRN | 145085734 | 145089827 | + |
| 210 | chr6 | UTRN | 144798953 | 144802999 | + | 287 | chr6 | UTRN | 145085827 | 145089911 | + |
| 211 | chr6 | UTRN | 144800780 | 144804822 | + | 288 | chr6 | UTRN | 145086046 | 145090124 | + |
| 212 | chr6 | UTRN | 144801427 | 144805473 | + | 289 | chr6 | UTRN | 145086210 | 145090245 | + |
| 213 | chr6 | UTRN | 144801714 | 144805742 | + | 290 | chr6 | UTRN | 145086678 | 145090723 | + |
| 214 | chr6 | UTRN | 144801774 | 144805849 | + | 291 | chr6 | UTRN | 145088281 | 145092327 | + |
| 215 | chr6 | UTRN | 144804673 | 144808714 | + | 292 | chr6 | UTRN | 145088884 | 145092934 | + |
| 216 | chr6 | UTRN | 144806684 | 144810739 | + | 293 | chr6 | UTRN | 145091542 | 145095591 | + |
| 217 | chr6 | UTRN | 144806739 | 144810803 | + | 294 | chr6 | UTRN | 145092155 | 145096199 | + |
| 218 | chr6 | UTRN | 144807834 | 144811881 | + | 295 | chr6 | UTRN | 145094714 | 145098756 | + |
| 219 | chr6 | UTRN | 144809266 | 144813310 | + | 296 | chr6 | UTRN | 145099237 | 145103284 | + |
| 220 | chr6 | UTRN | 144812476 | 144816522 | + | 297 | chr6 | UTRN | 145099598 | 145103642 | + |
| 221 | chr6 | UTRN | 144813156 | 144817199 | + | 298 | chr6 | UTRN | 145125145 | 145129194 | + |
| 222 | chr6 | UTRN | 144818469 | 144822529 | + | 299 | chr6 | UTRN | 145125467 | 145129507 | + |
| 223 | chr6 | UTRN | 144830193 | 144834243 | + | 300 | chr6 | UTRN | 145125866 | 145129929 | + |
| 224 | chr6 | UTRN | 144833120 | 144837166 | + | 301 | chr6 | UTRN | 145126105 | 145130160 | + |
| 225 | chr6 | UTRN | 144833862 | 144837907 | + | 302 | chr6 | UTRN | 145126415 | 145130460 | + |
| 226 | chr6 | UTRN | 144835423 | 144839465 | + | 303 | chr6 | UTRN | 145130350 | 145134397 | + |
| 227 | chr6 | UTRN | 144835943 | 144839989 | + | 304 | chr6 | UTRN | 145130917 | 145134974 | + |
| 228 | chr6 | UTRN | 144842263 | 144846304 | + | 305 | chr6 | UTRN | 145131779 | 145135802 | + |
| 229 | chr6 | UTRN | 144856722 | 144860798 | + | 306 | chr6 | UTRN | 145132097 | 145136169 | + |

| SEQ ID | Chrom | Gene | Chr. Start | Chr. End | Strand |
|---|---|---|---|---|---|
| 307 | chr6 | UTRN | 145132835 | 145136881 | + |
| 308 | chr6 | UTRN | 145140034 | 145144135 | + |
| 309 | chr6 | UTRN | 145140629 | 145144676 | + |
| 310 | chr6 | UTRN | 145146750 | 145150806 | + |
| 311 | chr6 | UTRN | 145147936 | 145151984 | + |
| 312 | chr6 | UTRN | 145151900 | 145156300 | + |
| 313 | chr6 | UTRN | 145152735 | 145156782 | + |
| 314 | chr6 | UTRN | 145153438 | 145157468 | + |
| 315 | chr6 | UTRN | 145154972 | 145159019 | + |
| 316 | chr6 | UTRN | 145155440 | 145159555 | + |
| 317 | chr6 | UTRN | 145155566 | 145159621 | + |
| 318 | chr6 | UTRN | 145156149 | 145160194 | + |
| 319 | chr6 | UTRN | 145158356 | 145162409 | + |
| 320 | chr6 | UTRN | 145159881 | 145163927 | + |
| 321 | chr6 | UTRN | 145165107 | 145169151 | + |
| 322 | chr6 | UTRN | 145165205 | 145169243 | + |
| 323 | chr6 | UTRN | 145166292 | 145170344 | + |
| 324 | chr6 | UTRN | 145167033 | 145171085 | + |
| 325 | chr6 | UTRN | 145167156 | 145171202 | + |
| 326 | chr6 | UTRN | 145167270 | 145171315 | + |
| 327 | chr6 | UTRN | 145169814 | 145173863 | + |
| 328 | chr6 | UTRN | 145171631 | 145175718 | + |
| 329 | chr6 | UTRN | 144608031 | 144608073 | − |
| 330 | chr6 | UTRN | 144612926 | 144612972 | − |
| 331 | chr6 | UTRN | 144628552 | 144628595 | − |
| 332 | chr6 | UTRN | 144633946 | 144633970 | − |
| 333 | chr6 | UTRN | 144650739 | 144650804 | − |
| 334 | chr6 | UTRN | 144657045 | 144657093 | − |
| 335 | chr6 | UTRN | 144696995 | 144697041 | − |
| 336 | chr6 | UTRN | 144747612 | 144747674 | − |
| 337 | chr6 | UTRN | 144747879 | 144747925 | − |
| 338 | chr6 | UTRN | 144759816 | 144759863 | − |
| 339 | chr6 | UTRN | 144768238 | 144768312 | − |
| 340 | chr6 | UTRN | 144780036 | 144780082 | − |
| 341 | chr6 | UTRN | 144782886 | 144782935 | − |
| 342 | chr6 | UTRN | 144795766 | 144795789 | − |
| 343 | chr6 | UTRN | 144806556 | 144806601 | − |
| 344 | chr6 | UTRN | 144854365 | 144854401 | − |
| 345 | chr6 | UTRN | 144858769 | 144858809 | − |
| 346 | chr6 | UTRN | 144861763 | 144861805 | − |
| 347 | chr6 | UTRN | 144865560 | 144865594 | − |
| 348 | chr6 | UTRN | 144871095 | 144871118 | − |
| 349 | chr6 | UTRN | 144872146 | 144872179 | − |
| 350 | chr6 | UTRN | 144873792 | 144873815 | − |
| 351 | chr6 | UTRN | 144875726 | 144875775 | − |
| 352 | chr6 | UTRN | 144881389 | 144881429 | − |
| 353 | chr6 | UTRN | 144902992 | 144903093 | − |
| 354 | chr6 | UTRN | 144913242 | 144913292 | − |
| 355 | chr6 | UTRN | 144916606 | 144916629 | − |
| 356 | chr6 | UTRN | 144953033 | 144953075 | − |
| 357 | chr6 | UTRN | 144957938 | 144957985 | − |
| 358 | chr6 | UTRN | 144960849 | 144960900 | − |
| 359 | chr6 | UTRN | 144963737 | 144963802 | − |
| 360 | chr6 | UTRN | 144980957 | 144981000 | − |
| 361 | chr6 | UTRN | 144981226 | 144981271 | − |
| 362 | chr6 | UTRN | 144981350 | 144981396 | − |
| 363 | chr6 | UTRN | 144981507 | 144981542 | − |
| 364 | chr6 | UTRN | 144983660 | 144983707 | − |
| 365 | chr6 | UTRN | 145005066 | 145005095 | − |
| 366 | chr6 | UTRN | 145005500 | 145005548 | − |
| 367 | chr6 | UTRN | 145021339 | 145021384 | − |
| 368 | chr6 | UTRN | 145036068 | 145036136 | − |
| 369 | chr6 | UTRN | 145036766 | 145036820 | − |
| 370 | chr6 | UTRN | 145038552 | 145038606 | − |
| 371 | chr6 | UTRN | 145058056 | 145058096 | − |
| 372 | chr6 | UTRN | 145059402 | 145059450 | − |
| 373 | chr6 | UTRN | 145060834 | 145060905 | − |
| 374 | chr6 | UTRN | 145062448 | 145062475 | − |
| 375 | chr6 | UTRN | 145063125 | 145063160 | − |
| 376 | chr6 | UTRN | 145063273 | 145063302 | − |
| 377 | chr6 | UTRN | 145071318 | 145071359 | − |
| 378 | chr6 | UTRN | 145079495 | 145079543 | − |
| 379 | chr6 | UTRN | 145090227 | 145090266 | − |
| 380 | chr6 | UTRN | 145095420 | 145095465 | − |
| 381 | chr6 | UTRN | 145097191 | 145097232 | − |
| 382 | chr6 | UTRN | 145098097 | 145098128 | − |
| 383 | chr6 | UTRN | 145098960 | 145099005 | − |
| 384 | chr6 | UTRN | 145106983 | 145107024 | − |
| 385 | chr6 | UTRN | 145124174 | 145124220 | − |
| 386 | chr6 | UTRN | 145128278 | 145128325 | − |
| 387 | chr6 | UTRN | 145142105 | 145142152 | − |
| 388 | chr6 | UTRN | 145149926 | 145149972 | − |
| 389 | chr6 | UTRN | 145153110 | 145153155 | − |
| 390 | chr6 | UTRN | 145155586 | 145155641 | − |
| 391 | chr6 | UTRN | 145156956 | 145157020 | − |
| 392 | chr6 | UTRN | 145161886 | 145161931 | − |
| 393 | chr6 | UTRN | 145166490 | 145166527 | − |
| 394 | chr6 | UTRN | 145167701 | 145167736 | − |
| 395 | chr6 | UTRN | 145173585 | 145173627 | − |
| 396 | chr6 | UTRN | 144606031 | 144610073 | − |
| 397 | chr6 | UTRN | 144610926 | 144614972 | − |
| 398 | chr6 | UTRN | 144626552 | 144630595 | − |
| 399 | chr6 | UTRN | 144631946 | 144635970 | − |
| 400 | chr6 | UTRN | 144648739 | 144652804 | − |
| 401 | chr6 | UTRN | 144655045 | 144659093 | − |
| 402 | chr6 | UTRN | 144694995 | 144699041 | − |
| 403 | chr6 | UTRN | 144745612 | 144749674 | − |
| 404 | chr6 | UTRN | 144745879 | 144749925 | − |
| 405 | chr6 | UTRN | 144757816 | 144761863 | − |
| 406 | chr6 | UTRN | 144766238 | 144770312 | − |
| 407 | chr6 | UTRN | 144778036 | 144782082 | − |
| 408 | chr6 | UTRN | 144780886 | 144784935 | − |
| 409 | chr6 | UTRN | 144793766 | 144797789 | − |
| 410 | chr6 | UTRN | 144804556 | 144808601 | − |
| 411 | chr6 | UTRN | 144852365 | 144856401 | − |
| 412 | chr6 | UTRN | 144856769 | 144860809 | − |
| 413 | chr6 | UTRN | 144859763 | 144863805 | − |
| 414 | chr6 | UTRN | 144863560 | 144867594 | − |
| 415 | chr6 | UTRN | 144869095 | 144873118 | − |
| 416 | chr6 | UTRN | 144870146 | 144874179 | − |
| 417 | chr6 | UTRN | 144871792 | 144875815 | − |
| 418 | chr6 | UTRN | 144873726 | 144877775 | − |
| 419 | chr6 | UTRN | 144879389 | 144883429 | − |
| 420 | chr6 | UTRN | 144900992 | 144905093 | − |
| 421 | chr6 | UTRN | 144911242 | 144915292 | − |
| 422 | chr6 | UTRN | 144914606 | 144918629 | − |
| 423 | chr6 | UTRN | 144951033 | 144955075 | − |
| 424 | chr6 | UTRN | 144955938 | 144959985 | − |
| 425 | chr6 | UTRN | 144958849 | 144962900 | − |
| 426 | chr6 | UTRN | 144961737 | 144965802 | − |
| 427 | chr6 | UTRN | 144978957 | 144983000 | − |
| 428 | chr6 | UTRN | 144979226 | 144983271 | − |
| 429 | chr6 | UTRN | 144979350 | 144983396 | − |
| 430 | chr6 | UTRN | 144979507 | 144983542 | − |
| 431 | chr6 | UTRN | 144981660 | 144985707 | − |
| 432 | chr6 | UTRN | 145003066 | 145007095 | − |
| 433 | chr6 | UTRN | 145003500 | 145007548 | − |
| 434 | chr6 | UTRN | 145019339 | 145023384 | − |
| 435 | chr6 | UTRN | 145034068 | 145038136 | − |
| 436 | chr6 | UTRN | 145034766 | 145038820 | − |
| 437 | chr6 | UTRN | 145036552 | 145040606 | − |
| 438 | chr6 | UTRN | 145056056 | 145060096 | − |
| 439 | chr6 | UTRN | 145057402 | 145061450 | − |
| 440 | chr6 | UTRN | 145058834 | 145062905 | − |
| 441 | chr6 | UTRN | 145060448 | 145064475 | − |
| 442 | chr6 | UTRN | 145061125 | 145065160 | − |
| 443 | chr6 | UTRN | 145061273 | 145065302 | − |
| 444 | chr6 | UTRN | 145069318 | 145073359 | − |
| 445 | chr6 | UTRN | 145077495 | 145081543 | − |
| 446 | chr6 | UTRN | 145088227 | 145092266 | − |
| 447 | chr6 | UTRN | 145093420 | 145097465 | − |
| 448 | chr6 | UTRN | 145095191 | 145099232 | − |
| 449 | chr6 | UTRN | 145096097 | 145100128 | − |
| 450 | chr6 | UTRN | 145096960 | 145101005 | − |
| 451 | chr6 | UTRN | 145104983 | 145109024 | − |
| 452 | chr6 | UTRN | 145122174 | 145126220 | − |
| 453 | chr6 | UTRN | 145126278 | 145130325 | − |
| 454 | chr6 | UTRN | 145140105 | 145144152 | − |
| 455 | chr6 | UTRN | 145147926 | 145151972 | − |
| 456 | chr6 | UTRN | 145151110 | 145155155 | − |
| 457 | chr6 | UTRN | 145153586 | 145157641 | − |
| 458 | chr6 | UTRN | 145154956 | 145159020 | − |
| 459 | chr6 | UTRN | 145159886 | 145163931 | − |
| 460 | chr6 | UTRN | 145164490 | 145168527 | − |

-continued

| SEQ ID | Chrom | Gene | Chr. Start | Chr. End | Strand |
|---|---|---|---|---|---|
| 461 | chr6 | UTRN | 145165701 | 145169736 | – |
| 462 | chr6 | UTRN | 145171585 | 145175627 | – |

Single Strand Oligonucleotides (Antisense Strand of Target Gene)
SeqID range: 463-307980
SeqIDs w/o G Runs:
475-1059, 1073-1276, 1291-1599, 1613-1879, 1893-1923, 1937-1959, 1974-2113, 2122-2142, 2156-2229, 2243-2253, 2267-2357, 2371-2393, 2419-2489, 2503-2619, 2631-2647, 2669-2671, 2685-2704, 2724-2790, 2801-2816, 2828-2896, 2908-2928, 2942, 2956-3326, 3348-3504, 3519-3557, 3572-3632, 3646-3692, 3707-3750, 3764-3800, 3808-3891, 3898-3902, 3921-3950, 3964-3975, 3990-4004, 4018-4031, 4056-4189, 4203-4267, 4281-4556, 4570-4943, 4957-5145, 5166-5311, 5327-5419, 5433-5543, 5557-5635, 5649-6239, 6253-6380, 6394-6496, 6510-6928, 6942-7134, 7157-8180, 8201-8459, 8481-8492, 8506-8696, 8710-8833, 8847-8869, 8883-8932, 8946-8949, 8971-9192, 9226-9244, 9258-9288, 9303-9312, 9339-9437, 9451-9462, 9476-9538, 9552-9616, 9630-9646, 9661-9667, 9681-9971, 9985-10440, 10454-10469, 10483-10649, 10663-10752, 10766-10918, 10933-11098, 11112-11278, 11292-11840, 11855-11982, 11996-12019, 12033-12186, 12200-12341, 12355-12677, 12691-12843, 12857-12865, 12879-12917, 12931-12972, 12985-13071, 13082-13115, 13129-13176, 13191-13587, 13602-13770, 13792-13956, 13970-13976, 13990-14287, 14297-14309, 14332-14445, 14458-14509, 14541-14573, 14587-14641, 14664-14742, 14756-14774, 14788-14989, 14997-15207, 15221-15266, 15281-15464, 15478-15530, 15544-15560, 15574-16579, 16593-16792, 16806-16869, 16883-17116, 17130-17466, 17480-17536, 17542-17564, 17579-17602, 17616-17638, 17648-17835, 17849-18046, 18060-18216, 18229, 18243-18292, 18306-18372, 18386-18565, 18579-18588, 18602-18655, 18669-19217, 19231-19331, 19343-19398, 19412-19446, 19454-19613, 19627-19742, 19756-19759, 19775-20189, 20203-20233, 20247-20448, 20467-20485, 20499-20519, 20534-20584, 20602-20743, 20757-20796, 20811-20822, 20836-20882, 20900-20951, 20958-20989, 21003-21011, 21025-21035, 21049-21105, 21133-21139, 21153-21170, 21184-21188, 21214-21263, 21277-21301, 21316-21366, 21380-21395, 21411-21523, 21537-21562, 21577-21581, 21599-21626, 21647-21658, 21673-21738, 21752-21831, 21866-21901, 21916-21945, 21959-22101, 22122-22128, 22143-22200, 22215-22250, 22264-22277, 22292-22327, 22336-22432, 22446-22475, 22489-22514, 22528-22646, 22660-22692, 22706-22779, 22793-22983, 22997-23069, 23083-23804, 23814-23837, 23840-23852, 23859-24072, 24086-24248, 24262-24582, 24596-24663, 24677-24696, 24710-24956, 24972-24982, 25008-25033, 25047-25061, 25095-25108, 25122-25126, 25140-25158, 25172-25195, 25210-25260, 25274-25359, 25373-25586, 25600-25610, 25624-25764, 25778-25793, 25818-25820, 25840-25972, 25992-26034, 26048-26055, 26077-26104, 26118-26444, 26458-26476, 26490-26515, 26547-26608, 26622-26642, 26657-26681, 26695-26711, 26725-26862, 26876-26986, 27000-27115, 27129-27154, 27168-27230, 27244-27629, 27643-27707, 27721-27815, 27829-27876, 27890-27985, 27999-28050, 28063-28099, 28113-28114, 28128-28204, 28218-28262, 28276-28358, 28397-28445, 28460-28502, 28516-28662, 28676-28764, 28778-28795, 28809, 28822-28825, 28850-28895, 28903-28929, 28943-29021, 29035-29116, 29130-29368, 29382-29690, 29714-30031, 30045-30129, 30143-30521, 30539, 30553-30560, 30592-30600, 30614-30756, 30770-31738, 31752-31761, 31775-31847, 31861-32143, 32157-32493, 32507-32577, 32615-32736, 32750-32752, 32767-32787, 32801-33022, 33036-33051, 33065-33173, 33188-33206, 33220-33275, 33290-34111, 34120-34125, 34139-34540, 34554-34737, 34745-34749, 34765-34832, 34846-34947, 34961-35017, 35031-35094, 35108-35281, 35295-35380, 35394-35789, 35803-35833, 35848-36211, 36225-36465, 36479-36492, 36497-36531, 36538-36578, 36591-36607, 36621-36634, 36637-36676, 36696-36710, 36724-36759, 36772-36874, 36888-37002, 37016-37457, 37471-37574, 37588-37760, 37776-37783, 37799-37807, 37830-38163, 38177-38309, 38321-38401, 38415-38496, 38510-38566, 38580-38734, 38748-38759, 38773-38778, 38792-38872, 38886-38956, 38970-39034, 39048-39451, 39465, 39479-39663, 39677-40297, 40312-40520, 40534-40733, 40747-40760, 40777-41542, 41561-41601, 41615-41628, 41642-41649, 41663-41667, 41682-41697, 41711-41897, 41942-41944, 41958-41980, 41994-42066, 42080-42228, 42242-42255, 42265-42267, 42281-42287, 42296-42319, 42333-42384, 42398-42467, 42482-42519, 42532-42659, 42673-43048, 43062-43311, 43325-43450, 43464-43552, 43566-43662, 43673-43718, 43737-43750, 43753-43783, 43793-43813, 43822-43838, 43852-43993, 44007-44063, 44077-44127, 44141-44202, 44216, 44231-44802, 44816-44819, 44840-44959, 44973-45049, 45101-45190, 45204-45535, 45549-45555, 45569-45934, 45955-46195, 46209-46479, 46506-46603, 46630-46687, 46701-46727, 46741-46803, 46817-47031, 47045-47105, 47119-47451, 47465-47571, 47585-47612, 47620-47750, 47754-47758, 47780-47842, 47856-47937, 47951-48006, 48021-48043, 48057-48156, 48170-48171, 48186-48564, 48578-48700, 48714-49138, 49152-49252, 49266-49402, 49416-49800, 49814-50016, 50038-50172, 50186-50318, 50331-50463, 50478-50632, 50646-50683, 50700-50743, 50757-50958, 50972-51254, 51268-51609, 51624-51656, 51670-51769, 51783-52236, 52250-52251, 52274-52606, 52621-52912, 52926-53012, 53033-53457, 53471-54305, 54319-54322, 54336-54735, 54749-54831, 54845-54932, 54946-55069, 55084-55468, 55483-55499, 55513-55661, 55675-55701, 55715-55750, 55761-55769, 55782-55803, 55809-55845, 55850-55854, 55876-55950, 55964-56060, 56074-56099, 56113-56138, 56165-56201, 56216-56259, 56273-56672, 56686-56756, 56770-57330, 57344-57421, 57435-57465, 57480-57510, 57524-57745, 57759-58186, 58200-58941, 58955-59032, 59048-59115, 59129-59179, 59193-59247, 59262-59346, 59360-59454, 59468-59763, 59777-60113, 60127-60129, 60143-60207, 60221-60322, 60337-60474, 60489-60496, 60510-60830, 60846-61109, 61123-61247, 61261-61268, 61291-61358, 61372-61463, 61478-61558, 61572-61628, 61642-61926, 61940-62417, 62431-62785, 62799-63194, 63217-63299, 63313-64131, 64145-64416, 64430-64690, 64704-64920, 64934-65498, 65512-65604, 65618-65619, 65635-65703, 65717-66224, 66238-66497, 66511-66556, 66570-66575, 66590-66838, 66852-67374, 67388-67749, 67763-68076, 68090-68145, 68159-68189, 68203-68354, 68369, 68383-68520, 68534-68560, 68576-68865, 68879-68915, 68929-69314, 69318-69359, 69365-69445, 69454-69744, 69758-69878, 69892-69932, 69946-70105, 70120-70190, 70196-70731, 70751-70753, 70767-70811, 70826-70921, 70937-71239, 71253-71258, 71272-71575, 71579-71603, 71617-71621, 71624-71667, 71686-71720, 71734-72397, 72411-72412, 72426-72519, 72533-72578, 72593-72876, 72890-72894, 72908-72987, 73013-73041, 73067-73126, 73140-73255, 73270-73364, 73378-73410, 73426-73495, 73509-73578, 73605-73616, 73631-73690, 73704-73719, 73733-73796, 73811-73864, 73890-74138, 74152-74189, 74214-74305, 74320-74477, 74491-74546, 74562-74566, 74579-74740, 74754-74899, 74913-75285, 75301-76253, 76267-76602, 76616-76846, 76861-76940, 76954-76955, 76965-77010, 77020-77047, 77055-77066, 77080-77240, 77263-77470, 77472-77543, 77553-77573, 77579-78056, 78070-78082, 78096-78139, 78153-78253, 78267-78344, 78365-78514, 78535-78556, 78570-78678, 78693-79023, 79037-80301, 80315-80497, 80512-80616, 80630-80721, 80736-80785, 80799-80844, 80859-80936, 80951-81045, 81059-81170, 81184-81192, 81207-81223, 81237-81402, 81426-81672, 81686-81699, 81713-81805, 81819-81910, 81928-81985, 81999-82000, 82014-82061, 82076-82210, 82229-82637, 82651-82703, 82717-83142, 83156-83258, 83272-83420, 83434-84194, 84210-84287, 84301-84327, 84342-84468, 84482-84485, 84499-84569, 84571, 84583-84681, 84698-84707, 84713-85094, 85109-85173, 85188-85218, 85232-85389, 85403-85413, 85427-85648, 85662-85673, 85687-86234, 86248-86592, 86606-86660, 86674-86819, 86833-86996, 87010-87206, 87220-87233, 87247-87274, 87288-87351, 87365-87673, 87687-87864, 87878-87920, 87935-88061, 88075-88310, 88324-88489, 88503-88635, 88649-89334, 89348-89466, 89480-89563, 89578-89598, 89612-89619, 89634-89720, 89734-89772, 89786-89992, 89994-90114, 90128-90142, 90157-90190, 90197-90223, 90237-90373, 90387-90536, 90550-90650, 90664-91341, 91355-91547, 91561-91595, 91609-92030, 92044-92050, 92064-92085, 92099-92271, 92285-92305, 92350-92352, 92367-92388, 92402-92659, 92673-92747, 92765-92817, 92831-92885, 92899-93202, 93217-93436, 93450-93797, 93811-93850, 93865-94319, 94335-94716, 94729-94759, 94768-94811, 94825-94842, 94861-94876, 94884-94891, 94905-94927, 94941-95498, 95512-95633, 95647-95811, 95825-96125, 96141-96218, 96232-96243, 96257-96262, 96284-96321, 96337, 96344-96549, 96563-96832, 96846-96954, 96975-97118, 97132-97141, 97155-97374, 97388-97606, 97620-98130, 98146-98505, 98519-98552, 98566-98727, 98736-98752, 98767-98887, 98902-99133, 99147-99431, 99445-99724, 99738-100131, 100145-100341, 100357-100431, 100445-100509, 100523-100609, 100626-100652, 100666-100680, 100694-100814, 100828-100908, 100943-101114, 101128-101209, 101218-101251, 101262-101284, 101288-101429, 101461-101516, 101522-101547, 101558-101600, 101605-101894, 101908-101909, 101923-102088, 102102-102185, 102199-102403, 102417-102428, 102442-102939, 102941-102994, 103009-103053, 103077-103237, 103251-103415, 103430-103490, 103493-103537, 103552-103626, 103640-103780, 103794-103819, 103833-103836, 103850-104000, 104014-104436, 104450-104459, 104473-105152, 105167-105290, 105310-105322, 105332-105354, 105357-105380, 105391-105553, 105567-105656, 105663-105681, 105696-105701, 105723-105750, 105755-105889, 105904-105933, 105959-105980, 106005-106607, 106621-106904, 106918-107106, 107120-107946, 107967-107973, 107987-107999, 108027-108028, 108042-108066, 108080, 108091-108233, 108249-108350, 108364-108420, 108434-108467, 108481-108810, 108824-109201, 109215-109230, 109244-109278, 109293-109490, 109499-109523, 109533-109879, 109893-110058, 110072-110126, 110140-110198, 110212-110253, 110272-110327, 110341-110357, 110372-110404, 110419-110448, 110461-110526, 110540-110556, 110565-110582, 110588-110602, 110606-110622, 110646-110654, 110684-110700, 110714-110727, 110741-110804, 110818-110847, 110873-110880, 110894-110929, 110952-110955, 110982-111018, 111045-111048, 111062-111068, 111090-111091, 111117-111141, 111155, 111169-111208, 111222-111408, 111417-111437, 111451-111609, 111617-111754, 111768-112059, 112073-112375, 112389-112648, 112663-112754, 112768-112834, 112849-112862, 112871-112962, 112975-113026, 113034-113100, 113114-113269, 113283-113290, 113304-113354, 113368-113564, 113577-113748, 113769-113775, 113789-113802, 113816, 113844-113846, 113860-113868, 113896-113915, 113929-114127, 114140-114224, 114238-114421, 114435-114731, 114745-114955, 114969-116221, 116235-116292, 116309-116782, 116796-117023, 117037-117334, 117348-118168, 118191-118606, 118620-118893, 118907-118922, 118937-118976, 118979-119032, 119054-119059, 119067-119157, 119171-119205, 119219-119252, 119266-119550, 119552-119573, 119580-120189, 120203-120593, 120607-120661, 120675-120753, 120767-120771, 120785-121046, 121059-121079, 121081-121126, 121130-121144, 121158-121341, 121355-121365, 121379-121586, 121600-121601, 121616-121800, 121819-121960, 121974-122093, 122108-122403, 122417-122756, 122770-123271, 123285-123325, 123330-123355, 123369-123453, 123467-123773, 123787-124049, 124063-124064, 124078-124136, 124151-124264, 124279-124300, 124314-124395, 124409-124533, 124547-124793, 124796-124866, 124884-125071, 125085-125540, 125554-126847, 126861-126885, 126891-126915, 126923-126976, 127001-127389, 127403-127705, 127720-127738, 127753-127779, 127793-128040, 128054-128384, 128419-128747, 128761-128779, 128790-128817, 128831-128836, 128850-128881, 128895-128961, 128971-129928, 129942-129949, 129963-130091, 130105-130627, 130641-131308, 131313-131383, 131392-131761, 131775-131791, 131805-131842, 131856-131966, 131980-133117, 133131-133589, 133603-133641, 133655-133669, 133683-133838, 133832-134050, 134064-134266, 134281-134598, 134612-134631, 134645-134676, 134690-134787, 134801-134949, 134963-135170, 135184-135273, 135294-135860, 135874-135963, 135977-136190, 136204-136373, 136387-136463, 136478-136481, 136502-136586, 136600-136622, 136637-136640, 136654-136655, 136669-136701, 136718-136781, 136795-136897, 136911-137090, 137104-137278, 137298-137381, 137400-137761, 137766-137815, 137817-137847, 137860-137892, 137906-138174, 138178-138215, 138229-138259, 138269-138737, 138751-139082, 139096-139119, 139133-139254, 139268-139379, 139393-139540, 139554-139587, 139613-139862, 139872-139968, 139973-140000, 140011-140048, 140061-140116, 140131-140135, 140149-140199, 140213-140493, 140507-140703, 140717-140720, 140742-140850, 140864-141316, 141330-141493, 141507-141547, 141561-141616, 141629-141685, 141699-141939, 141953-141954, 141968-142062, 142076-142100, 142114-142708, 142723-142740, 142754-143020, 143035-143929, 143943-144342, 144356-144499, 144513-144615, 144630-144738, 144752-144818, 144833-144940, 144943-145047, 145061-145235, 145249-

145479, 145499-145502, 145541-145751, 145765-145943, 145957-146015, 146029-146068, 146083-146140, 146155-146432, 146447-146562, 146576-146654, 146668-146744, 146765-146829, 146843-147001, 147017-147349, 147363-147746, 147761-147876, 147890-148122, 148136-148988, 149002-149398, 149417-149446, 149460-149711, 149725-149897, 149916-150042, 150056-150061, 150075-150563, 150580-150877, 150892-151182, 151196-151291, 151306-151315, 151329-151425, 151439-151491, 151505-151515, 151529-151647, 151661-151695, 151709-151798, 151813-151891, 151906-153564, 153576-153983, 153997, 154011-154042, 154056-154364, 154378-155446, 155460-155481, 155495-155685, 155688-155911, 155925-156073, 156087-156243, 156257-156433, 156448-156622, 156649-156659, 156673-157056, 157071-157281, 157301-157330, 157351-157512, 157526-157657, 157671-158269, 158285-158342, 158356-158659, 158673-158762, 158777-158940, 158949-159552, 159566-159769, 159783-159861, 159881-160019, 160033-160449, 160476-160528, 160542-160688, 160702-160757, 160771-161005, 161019-161054, 161079-161519, 161533-161564, 161578-161657, 161671-161907, 161931-161944, 161970-162030, 162051-162176, 162190-162601, 162615-162735, 162749-162783, 162811-162917, 162931-163041, 163055-163060, 163074-163352, 163388-163657, 163671-163685, 163700-163900, 163914-163995, 164009-164654, 164669-164674, 164688-164750, 164764-165099, 165113-165158, 165172-165530, 165544-165717, 165731-165837, 165853-165940, 165954-166035, 166049-166271, 166285-166388, 166402-166925, 166939-167110, 167125-167467, 167481-167506, 167520-167531, 167545, 167559-167780, 167796-167974, 167988-168275, 168280-168692, 168706-168896, 168910-168956, 168970-169387, 169402-169643, 169657-170980, 170994-171042, 171058-171186, 171200-171570, 171593-172021, 172031-172046, 172059-172393, 172408-172462, 172476-172499, 172513-172763, 172777-172847, 172861-172992, 173006-173100, 173114-173304, 173318-173509, 173525-173937, 173939-174103, 174117-174220, 174235-174268, 174284-174285, 174296-174524, 174559-174567, 174582-174665, 174679, 174693-174713, 174728-174813, 174827-175606, 175620-175790, 175804-176302, 176316-176476, 176506-176719, 176723-176745, 176750-176761, 176772-176844, 176849-176851, 176864-177101, 177115-177143, 177157-177337, 177351-177363, 177377-177387, 177402-177522, 177536-177576, 177590-177634, 177648-177689, 177703-177742, 177756-177919, 177933-177982, 177996-178005, 178029-178480, 178490-178534, 178542-178654, 178673-178693, 178701-178771, 178775-178814, 178827-179121, 179136-179879, 179894-179952, 179966-180124, 180139-180155, 180169-180346, 180369-180393, 180418-180467, 180481-180490, 180517-180530, 180544-180587, 180601-180895, 180909-180958, 180972-181127, 181144-181187, 181202-181298, 181312-181323, 181337-181345, 181360-181488, 181502-181657, 181670-181982, 181996-182075, 182089-182420, 182436-182471, 182485-182543, 182557-182567, 182581-182706, 182720-183183, 183197-183661, 183677-183780, 183794-184136, 184150-184308, 184322-184416, 184430-184543, 184557-184673, 184687-184753, 184767-184918, 184932-185239, 185255-185452, 185466-185623, 185637-185656, 185670-185699, 185713-185743, 185757-185810, 185824-185911, 185925-185947, 185961-186207, 186221-186464, 186478-186828, 186848-186850, 186864-187261, 187275-187421, 187435-187445, 187459-187672, 187686-187689, 187704-187796, 187810-187857, 187871-187988, 188002-188133, 188147-188198, 188212-188301, 188315-188325, 188339-188936, 188951-188978, 189002-189263, 189277-189351, 189365-189420, 189435-189653, 189667-189675, 189689-189798, 189812-189985, 190001-190147, 190173-190594, 190610-190667, 190681-190713, 190734-191031, 191045-191248, 191262-191392, 191406-191463, 191478-191663, 191677-192169, 192183-192332, 192346-192454, 192468-192546, 192558-192754, 192768-192988, 193002-193416, 193430-193742, 193756-193811, 193825-194075, 194089-194121, 194136-194223, 194242-194243, 194282-194748, 194757-194762, 194776-194791, 194831-194832, 194850-194859, 194866-194994, 194997-195187, 195201-195281, 195295-195326, 195340-195356, 195370-195672, 195686-196495, 196509-196868, 196882-197138, 197152-197264, 197278-197389, 197403-197849, 197869-197893, 197907-197991, 198006-198123, 198138-198176, 198191-198210, 198224-198236, 198251-198275, 198303-198351, 198377-198388, 198402-198451, 198478-198482, 198505-198507, 198521-198557, 198571-198847, 198862-198985, 198999-199007, 199021-199034, 199048-199159, 199173-199277, 199303-199385, 199400-199403, 199417-199441, 199455, 199469-199472, 199499-199538, 199552-199603, 199625-199645, 199659-199671, 199686-199722, 199736-199744, 199759-199779, 199793-200084, 200095-200124, 200133-200147, 200150-200165, 200168-200208, 200214-200237, 200252-200365, 200379-200392, 200406-200412, 200426-200458, 200472-200479, 200493-200517, 200531-200818, 200832-200844, 200863-200872, 200887-200924, 200926-200972, 200986-201347, 201357-201447, 201461-201504, 201518-201567, 201581-201729, 201743-201761, 201776-202084, 202098-202125, 202210-202441, 202455-202616, 202633-202658, 202671-203064, 203078-203112, 203126-203663, 203677-204297, 204311-204477, 204491-205562, 205577-205581, 205595-205598, 205612-205628, 205642-205689, 205703-205733, 205747-205964, 205978-206196, 206210-206303, 206311-206927, 206941-207188, 207208-207453, 207467-207489, 207499-207517, 207530-207581, 207583-207613, 207627-207985, 207999-208033, 208047-208186, 208200-208215, 208229-208444, 208458-208849, 208863-208984, 208999-209047, 209061-209137, 209151-209177, 209191-209199, 209213-209220, 209247-209482, 209496-209502, 209522-209549, 209563-209688, 209702-209999, 210013-210042, 210067-210455, 210482-210590, 210604-210869, 210883-210893, 210908-210919, 210933-210985, 211000-211200, 211214-211329, 211343-211366, 211380-211464, 211478-211677, 211687-211724, 211738-211795, 211809-211873, 211887-212085, 212099-212184, 212198-212213, 212227-212349, 212363-212408, 212422-212594, 212600-212783, 212797-212802, 212818-212875, 212889-212918, 212942-212965, 212979-213004, 213027-213142, 213156-213731, 213746-

213987, 214001-214299, 214313-214371, 214385-214431, 214445-214747, 214761-214919, 214940-214960, 214969-215010, 215019-215029, 215037-215042, 215054-215069, 215083-215302, 215306-215355, 215367-215439, 215451-215487, 215498-215619, 215645-215892, 215907-215949, 215963-215973, 215986-216157, 216171-216187, 216202-216756, 216771-216775, 216789-216857, 216879-216883, 216897-216914, 216928-216940, 216954-217016, 217030-217221, 217235-217561, 217579-217605, 217620-217673, 217688-217984, 217998-218152, 218157-218802, 218816-218825, 218839-218867, 218881-218998, 219021-219050, 219062-219077, 219117-219149, 219163-219317, 219331-219482, 219497-219535, 219558-219584, 219598-219623, 219637-219708, 219722-219748, 219762-220099, 220113-220372, 220386-220714, 220724-220734, 220747-220753, 220758-220782, 220792-220836, 220851-220859, 220873-220876, 220890-220918, 220927-220964, 220971-221168, 221182-221512, 221526-221541, 221563-221571, 221585-221620, 221634-221775, 221792-221797, 221818-221873, 221887-221929, 221943-222001, 222015-222034, 222050-222055, 222071-222075, 222089-222135, 222149-222591, 222624-222744, 222759-222820, 222834-223012, 223033-223091, 223105, 223109-223153, 223167-223175, 223182-223231, 223242-223266, 223272-223306, 223319-223413, 223427-223837, 223862-224186, 224205-224463, 224477-225090, 225104-225177, 225191-225362, 225376-225552, 225566-225611, 225625-225668, 225682-225701, 225716-225793, 225807-226206, 226220-226480, 226494-226850, 226864-227126, 227131-227142, 227156-227173, 227185-227476, 227490-227640, 227654-227946, 227959-228237, 228251-228314, 228328-228402, 228416-228511, 228525-228560, 228574-228642, 228656-228685, 228699-228802, 228816-229441, 229455-230311, 230335-230340, 230354-230448, 230462-230522, 230536-230650, 230664-230680, 230695, 230710-230738, 230752-230772, 230786-231064, 231078-231147, 231161-231321, 231335-232578, 232592-232733, 232747-232799, 232803-232825, 232833-232847, 232850-232902, 232916-233028, 233031-233224, 233238-233268, 233282, 233291-233921, 233936-234001, 234015-234018, 234033-234039, 234053-234105, 234119-234185, 234201-234268, 234282-234673, 234687-234689, 234703-234830, 234844-235022, 235036-235198, 235217-235238, 235252-235260, 235283-235383, 235408-235461, 235475-235669, 235683-235703, 235728-235794, 235809-236171, 236186-236574, 236588-236672, 236686-236704, 236751-236930, 236944-236949, 236974-237052, 237066-237089, 237104-237242, 237256-237371, 237385-237541, 237561-238063, 238078-238097, 238121-238220, 238233-238258, 238272-238438, 238452-238511, 238526-238552, 238566-239339, 239353-239690, 239704-239806, 239820-239889, 239900-240084, 240092-240178, 240192-240205, 240215-240233, 240247-240298, 240320-240824, 240838-241026, 241040-241582, 241597-242092, 242106-242221, 242235-242284, 242298-242370, 242385-243017, 243031-243082, 243096-243536, 243550-243775, 243795-243806, 243820-243938, 243952-244102, 244116-244123, 244137-244569, 244583-244784, 244798-244935, 244949-244988, 245002-245245, 245259-245261, 245275-245394, 245409-245442, 245456-245667, 245683-245692, 245702-245721, 245731-245737, 245744-246235, 246251-246354, 246368-246411, 246426-246450, 246464-246610, 246624-246765, 246779-246842, 246857-247120, 247134-247230, 247245-247294, 247309-247352, 247367-247405, 247419-247452, 247467-247503, 247517-247526, 247545-247782, 247791-247862, 247867-247916, 247931-247933, 247943-248295, 248309-248314, 248329-248342, 248365-248723, 248737-248779, 248794-249701, 249715-249754, 249768-249795, 249809-250005, 250020-250280, 250294-250547, 250561-250995, 251009-251010, 251024-251037, 251051-251173, 251187-251259, 251279-251293, 251307-251447, 251469-251618, 251642-251796, 251810-251954, 251968-251984, 251998-252011, 252025-252164, 252178-252306, 252320-252395, 252409-252424, 252438-252523, 252550-252715, 252729-252766, 252780-252842, 252857-253206, 253220-253514, 253538-253596, 253603-253622, 253635-253641, 253651-253662, 253667-253723, 253738-253965, 253979-254047, 254064-254083, 254105-254131, 254136-254142, 254164, 254173-254733, 254763-254770, 254786-255162, 255177-255204, 255218-255316, 255330-255338, 255352-255587, 255601-255723, 255737-255797, 255811-255860, 255874-255876, 255890-256359, 256374-256464, 256478-256521, 256535-256755, 256769-256857, 256871-257322, 257336-257598, 257612-257689, 257705-257706, 257721-257884, 257903-257957, 257971-257983, 258003-258013, 258039-258079, 258093-258097, 258111-258189, 258204-258250, 258264-258385, 258406-258417, 258431-258468, 258482-258686, 258700-259216, 259230-259282, 259297-260016, 260030-260085, 260100-260187, 260201-260596, 260622-260650, 260664-260689, 260712-261028, 261042-261279, 261293-262000, 262015-262087, 262101-262221, 262235-262398, 262412-262413, 262428-263498, 263512-263868, 263882-264020, 264034-264078, 264092-264118, 264133-264206, 264220-264607, 264633-264635, 264649-264756, 264770-265001, 265015-265037, 265051-265233, 265247-265339, 265354-265386, 265400-265411, 265426-265477, 265491-265494, 265508-265528, 265532-265546, 265560-265670, 265684-265895, 265909-266004, 266018-266116, 266130-266197, 266211-266357, 266371-266529, 266543-266570, 266584-266712, 266726-266914, 266930-267051, 267065-267079, 267093-267102, 267116-267121, 267135-267196, 267210-267285, 267299-267571, 267585-267853, 267867-268072, 268086-268103, 268126-268169, 268183-268273, 268287-268430, 268444-268873, 268887-269049, 269064-269149, 269163-269255, 269269-269373, 269387-269555, 269569-269600, 269614-269701, 269715-269946, 269961-270559, 270573-270614, 270629-270935, 270949-271482, 271497-272342, 272356-272431, 272445-272631, 272644-272657, 272671-272916, 272932-273063, 273077-273264, 273280-273294, 273308-273388, 273403-273407, 273421-273452, 273466-274132, 274146-274302, 274316-274599, 274613-274649, 274663-274704, 274727-274886, 274900-274904, 274918-274976, 274990-275062, 275076-275288, 275302-275464, 275473-275681, 275696-275982, 275996-276122, 276136-276144, 276158-276182, 276197-276392, 276406-276735, 276749-277133, 277148-

277481, 277495-277666, 277680-277980, 277994-278092, 278106-278540, 278554-279095, 279109-279334, 279348-279830, 279844-280186, 280201-280224, 280239-280571, 280587-280648, 280663-280717, 280732-280785, 280800-280841, 280862-280902, 280921-280972, 280986-281177, 281192-281212, 281226-281263, 281277-281281, 281295-281947, 281961-282357, 282371-282513, 282527-282652, 282667-282758, 282772-282830, 282844-282858, 282872-282992, 283007-283056, 283070-283107, 283121-283484, 283498-283683, 283697-283865, 283879-284069, 284083-284105, 284119-284144, 284158-284162, 284176-284184, 284198-284299, 284313-284402, 284416-284548, 284562-284675, 284692-284701, 284715-284807, 284833-284993, 285007-285067, 285090-285303, 285317-285610, 285624-285638, 285652-285917, 285932-286330, 286335-286345, 286357-286358, 286383-286403, 286419-286421, 286428-287111, 287126-287182, 287205-287278, 287292-287308, 287322-287354, 287368-287423, 287437-287469, 287488-287829, 287843-287904, 287919-287976, 287990-288075, 288091-288120, 288135-288171, 288185-288255, 288269-288474, 288488-288521, 288535-288825, 288839-288973, 288987-289088, 289102-289127, 289142-289149, 289163-289294, 289310-289578, 289592-289649, 289663-289683, 289698-289866, 289881-289887, 289901-290032, 290046-290052, 290066-290444, 290474-290773, 290787-290812, 290826-291164, 291178-291189, 291214-291223, 291237-291453, 291467-291484, 291524-291766, 291780-291907, 291922-291943, 291962-291996, 292010-292140, 292154-292302, 292318-292477, 292491-292495, 292510-292556, 292570-292584, 292599-292828, 292842-293028, 293042-293046, 293060-293258, 293273-293285, 293288-293303, 293306-293641, 293656-293742, 293757-293906, 293921-294024, 294038-294047, 294061-294377, 294391-294450, 294475-294922, 294936-294954, 294968-295019, 295028-295061, 295072-295291, 295305-295342, 295350-295606, 295620-295685, 295689-295964, 295978-296012, 296014-296047, 296052-296059, 296071-296087, 296118-296137, 296152-296253, 296267-296302, 296316-296356, 296374-296377, 296400-296493, 296508-296653, 296667-296822, 296836-296968, 296982-297030, 297051-297098, 297112-297283, 297297-297369, 297385-297395, 297409-297454, 297468-297490, 297504-297609, 297626-297693, 297718-297818, 297832-297840, 297854-297987, 298001-298174, 298188-298260, 298274-298368, 298382-298421, 298435-298560, 298574-298821, 298835-298962, 298976-299242, 299256-299340, 299354-299356, 299370-299835, 299849-300472, 300496-300806, 300820-300854, 300869-301030, 301044-301085, 301106-301107, 301121-301438, 301453-301558, 301573-301580, 301594-301607, 301621-301807, 301823-301970, 301984-302064, 302078-302144, 302160-302163, 302187-302302, 302316-302491, 302510-302555, 302569-302615, 302629-302727, 302741-303035, 303049-303135, 303149-303169, 303183-303265, 303279-303369, 303383-303427, 303441-303507, 303521-303653, 303667-304191, 304205-304225, 304239-304701, 304716-305241, 305255-305269, 305284-305427, 305441-305501, 305515-305549, 305561-305794, 305812-306017, 306020-306042, 306049-306054, 306057-306106, 306108-306112, 306115-306132, 306138-306149, 306163-306164, 306179-306216, 306225-306228, 306230-306247, 306250-306302, 306305-306310, 306312-306329, 306335-306346, 306354-306379, 306382-306394, 306396-306422, 306427-306433, 306435-306502, 306506-306520, 306522-306531, 306534, 306541-306544, 306548-306550, 306556-306597, 306602-306623, 306630-306659, 306664-306685, 306687-306690, 306693-306697, 306699-306703, 306715-306723, 306728-306736, 306738-306749, 306752-306782, 306788-306798, 306803-306804, 306807, 306814-306815, 306833-306854, 306856-306858, 306862-306864, 306867-306869, 306871-306905, 306909, 306920-306952, 306963-307021, 307023-307037, 307041-307048, 307052-307053, 307062-307063, 307067-307084, 307086-307104, 307111-307113, 307115-307148, 307154-307164, 307171-307286, 307295-307309, 307312-307314, 307316-307322, 307324-307352, 307355-307388, 307392-307444, 307446-307644, 307658-307679, 307694-307784, 307790-307882, 307888-307926, 307928-307940, 307942-307975, 307977-307980

SeqIDs w/o miR Seeds:
467, 469-472, 474, 477, 479-484, 487-488, 491-494, 496-497, 504, 506-508, 512-513, 515-518, 521-523, 525-526, 528, 530, 532, 536-544, 546-554, 556-557, 561-567, 569-575, 577-582, 584-589, 592-596, 598-601, 603-605, 609-613, 615, 617-618, 621-623, 625, 628, 630-634, 636-638, 643, 645-647, 649, 651-653, 656, 659-664, 666, 668, 670, 672, 674-678, 680, 682-689, 691-703, 706, 709-710, 712, 714-715, 718, 720-724, 727-728, 730-733, 735-741, 743-747, 749-751, 753-754, 757-759, 761, 764-766, 769-770, 772-773, 775-776, 778, 780-781, 783-786, 788-791, 793, 795-801, 803, 805-808, 810-811, 813, 815-817, 823, 827-834, 837-840, 842-844, 847-849, 851, 853-857, 859, 861, 863, 867-868, 871, 873-877, 880-885, 887-888, 890, 893-897, 899-900, 903-904, 906-907, 910-911, 915, 917-922, 927, 930-932, 937-939, 941, 943, 947-949, 951-953, 958-960, 962-966, 968-970, 972-973, 975, 977, 979, 984, 988-990, 993-994, 996-1005, 1008, 1011, 1013-1021, 1023-1024, 1027-1028, 1031, 1034, 1036-1039, 1041-1042, 1045-1047, 1049, 1051, 1053-1054, 1056-1057, 1059-1060, 1064, 1067, 1070, 1073-1077, 1079-1080, 1082-1085, 1087, 1089, 1091, 1093-1096, 1100-1101, 1103, 1105, 1108-1117, 1119, 1121-1123, 1126-1128, 1130-1133, 1137, 1139, 1141-1142, 1147, 1149-1154, 1157, 1159, 1161-1162, 1165, 1167, 1169, 1171, 1173-1179, 1183-1185, 1187, 1189, 1191-1197, 1199-1206, 1210-1212, 1214, 1216-1219, 1221, 1224-1228, 1232, 1234-1235, 1241-1242, 1246-1247, 1249-1253, 1255-1258, 1261-1268, 1272, 1274-1275, 1278, 1285, 1292-1294, 1296, 1298, 1301-1304, 1307-1310, 1312, 1315-1318, 1320-1322, 1324, 1326-1328, 1331, 1333-1334, 1337, 1340-1346, 1348-1349, 1353, 1357-1360, 1363, 1368-1374, 1378-1381, 1383-1384, 1386, 1390-1391, 1393-1394, 1396-1397, 1400-1401, 1403, 1405-1407, 1409, 1412-1414, 1416, 1424, 1427, 1429-1435, 1437-1443, 1445, 1448, 1451-1455, 1457-1459, 1461, 1465-1466, 1469, 1471-1472, 1474-1476, 1478-1487, 1489-1490, 1492, 1494, 1496-1497, 1500-1502, 1504-1507, 1509, 1511, 1513, 1515-1516, 1518, 1520-1522, 1524-1525, 1527-1533, 1535, 1537-1539, 1541-1543, 1545-1548, 1550-1552, 1554, 1558-1560, 1562-1564, 1566-1568, 1572, 1575, 1577-1578, 1581-1582, 1588, 1590, 1594, 1599, 1606-1617, 1619, 1624, 1626, 1628-1631, 1634, 1637-1638, 1640, 1642-1644, 1648-1649, 1651-1652, 1654-1658, 1662-1664, 1666, 1668-1669, 1672, 1674, 1676, 1678-1683, 1687-1692, 1695-1697, 1699-1702, 1706-1707, 1710, 1712-1720, 1725, 1727-1733, 1735-1736, 1738-1743, 1745, 1747, 1749-1751, 1753-1756, 1761-1763, 1765-1773, 1776-1777, 1779-1786, 1788-1789, 1791-1793, 1795-1796, 1799-1801, 1803-1804, 1808, 1810-1816, 1819-1820, 1824-1829, 1831-1833, 1835, 1837, 1840-1841, 1845, 1849, 1852, 1854-1875, 1877, 1879, 1881, 1883-1884, 1886-1887, 1891-1896, 1899-1900, 1905, 1909, 1914-1915, 1917-1919, 1921-1922, 1928, 1931-1932, 1934-1936, 1938-1941, 1946, 1949, 1952-1958, 1960, 1963-1964, 1969, 1972, 1976-1977, 1981, 1983, 1985-1987, 1989, 1991-1995, 1997, 2003-2005, 2008, 2013-2020, 2026-2031, 2033, 2035-2038, 2041-2042, 2044, 2046-2052, 2054-2059, 2061-2062, 2064, 2066-2070, 2076-2078, 2081-2082, 2084, 2086-2087, 2089, 2092-2095, 2097-2098, 2100, 2102, 2105, 2109, 2112, 2118, 2120, 2126-2129, 2131-2138, 2141-2142, 2146, 2150, 2152-2153, 2155-2156, 2158-2160, 2162-2163, 2168-2172, 2174, 2176, 2179, 2183, 2185, 2188-2189, 2191, 2193, 2196, 2200, 2202-2203, 2205, 2207, 2209-2212, 2214-2219, 2221, 2223-2226, 2228, 2231, 2238, 2241-2242, 2244, 2248-2250, 2252-2253, 2255-2256, 2259, 2261-2262, 2264-2265, 2267, 2270-2272, 2277-2280, 2282-2283, 2285-2287, 2289-2297, 2299-2302, 2304-2309, 2316, 2318-2319, 2325, 2327-2334, 2336, 2338-2339, 2341-2343, 2345-2346, 2351, 2353-2356, 2358, 2360, 2362, 2364, 2367-2373, 2376-2378, 2380-2383, 2386-2387, 2389-2392, 2395, 2400-2401, 2403, 2406-2407, 2409, 2412, 2414, 2416-2422, 2425-2427, 2429-2433, 2435, 2437-2439, 2444-2446, 2453-2456, 2458, 2461, 2463, 2465-2466, 2468-2469, 2471-2476, 2478-2480, 2482-2483, 2485-2489, 2493, 2496-2497, 2499, 2501-2505, 2507, 2509-2510, 2512, 2514-2515, 2517, 2519-2521, 2523-2527, 2532, 2534, 2536-2538, 2540, 2545-2548, 2551-2552, 2554, 2556-2557, 2560, 2562-2564, 2566-2568, 2570, 2573, 2575-2576, 2581-2587, 2589-2594, 2596-2604, 2608-2613, 2615, 2619, 2622, 2624, 2626-2628, 2630-2631, 2635, 2637-2638, 2640, 2642-2644, 2646-2647, 2650-2651, 2654-2656, 2659-2663, 2665-2669, 2674, 2676-2681, 2683, 2685, 2687, 2689-2691, 2693, 2697, 2699-2700, 2706, 2708-2709, 2711-2712, 2714-2715, 2717, 2723-2727, 2729-2732, 2734-2742, 2744-2745, 2748, 2750-2751, 2753, 2756, 2758-2759, 2765, 2767-2770, 2772, 2774, 2778, 2780, 2786, 2789, 2794, 2796-2797, 2800-2801, 2803, 2805-2806, 2810, 2812-2815, 2821-2826, 2829-2834, 2836-2837, 2839-2840, 2843-2855, 2859-2864, 2866, 2868-2870, 2872-2873, 2876, 2878-2880, 2882-2885, 2892, 2894-2895, 2899, 2901, 2903-2906, 2909-2911, 2916-2920, 2922-2925, 2930-2933, 2935, 2938, 2940, 2945, 2947-2951, 2953-2958, 2960-2965, 2967-2969, 2971, 2974-2978, 2981-2982, 2985-2988, 2991-2992, 2996-2998, 3000-3001, 3003, 3006, 3008, 3013, 3015-3016, 3018-3021, 3023-3024, 3026-3032, 3035-3044, 3046, 3048, 3050-3054, 3056-3068, 3071, 3074-3081, 3083, 3085-3088, 3090-3094, 3099-3102, 3106-3112, 3114-3118, 3121-3123, 3125-3131, 3133-3138, 3141-3144, 3146, 3150, 3153-3154, 3156, 3158, 3161-3162, 3164-3167, 3172, 3174-3178, 3180-3182, 3184, 3186-3191, 3193, 3195, 3199, 3202-3210, 3212-3214, 3218, 3220-3221, 3224, 3226-3227, 3230-3235, 3238-3239, 3244-3247, 3249-3251, 3253, 3255-3260, 3262-3264, 3268, 3270-3281, 3284-3286, 3288-3293, 3295-3301, 3303-3307, 3310, 3312-3317, 3323-3325, 3333-3334, 3336, 3341-3345, 3348-3350, 3354-3355, 3359-3368, 3372, 3375, 3377-3379, 3382, 3384-3386, 3389, 3391, 3393-3395, 3399-3403, 3405-3406, 3408, 3410, 3415-3417, 3419-3421, 3424, 3426, 3428, 3430-3432, 3434, 3436-3438, 3440-3443, 3445-3446, 3449, 3452-3453, 3457, 3461-3463, 3466, 3469-3472, 3475, 3477-3478, 3480, 3482, 3486, 3490, 3492-3497, 3499-3501, 3503, 3505, 3510-3511, 3513, 3515-3522, 3524-3525, 3530-3534, 3536, 3539-3544, 3546-3550, 3552-3553, 3557, 3564, 3566-3567, 3570-3574, 3576-3577, 3579-3581, 3583-3585, 3589, 3592, 3599, 3601, 3603, 3605-3608, 3610-3612, 3615-3620, 3622, 3625-3633, 3636-3648, 3650-3651, 3653-3657, 3659, 3661, 3667-3669, 3671-3673, 3675-3676, 3678-3682, 3684, 3686-3687, 3690-3693, 3700-3701, 3704-3705, 3709, 3711, 3714, 3718, 3722-3725, 3727-3728, 3730-3734, 3736-3743, 3746-3749, 3752-3753, 3759-3761, 3764, 3768, 3771, 3773-3776, 3778-3779, 3782, 3784-3785, 3789-3790, 3792, 3795, 3799, 3806, 3810-3811, 3813, 3817, 3820-3823, 3828, 3831, 3833-3835, 3837-3838, 3840-3842, 3844, 3848-3854, 3856-3859, 3861, 3863-3864, 3868, 3874-3875, 3877-3880, 3882, 3886-3890, 3896-3901, 3904-3907, 3910, 3912, 3914-3919, 3921-3937, 3939-3940, 3942-3943, 3945-3951, 3955, 3959-3963, 3966-3968, 3973, 3975, 3982-3983, 3985, 3987-3988, 3990-3991, 3993-3998, 4004, 4008-4009, 4011-4014, 4016-4017, 4024-4025, 4028, 4030-4031, 4033-4034, 4038, 4040, 4045, 4048, 4050-4052, 4055-4057, 4059, 4061-4065, 4068-4072, 4077-4079, 4081-4082, 4084, 4086, 4088, 4092, 4094, 4096-4097, 4101-4105, 4109, 4111-4113, 4115-4116, 4119, 4121, 4123, 4126-4129, 4131, 4135, 4138, 4140, 4142, 4145-4147, 4149-4150, 4153, 4156, 4159-4161, 4164, 4166, 4168-4173, 4176-4178, 4181, 4183-4188, 4194-4196, 4198-4200, 4202-4208, 4210-4211, 4213-4216, 4218-4219, 4221-4224, 4226-4227, 4229-4231, 4233-4242, 4244-4246, 4248, 4252-4253, 4256-4257, 4262, 4264-4265, 4267-4270, 4278, 4283-4284, 4287, 4292, 4295-4299, 4302-4303, 4305, 4307-4308, 4310, 4313-4318, 4321, 4323-4325, 4328, 4331, 4334, 4337-4339, 4341-4343, 4346-4347, 4349, 4351-4352, 4354-4357, 4359-4360, 4363, 4365-4372, 4374-4378, 4380, 4382-4386, 4388-4390, 4392, 4394-4404, 4406, 4410-4411, 4413-4414, 4418-4419, 4421-4422, 4424-4438, 4441-4447, 4452-4456, 4459, 4462-4472, 4474, 4479, 4481-4491, 4493-4495, 4497, 4499, 4501-4504, 4506-4514, 4516-4520, 4522-4527, 4529, 4531-4538, 4541-4544, 4546-4548, 4551-4552, 4554, 4556-4557, 4561-4563, 4566-4570, 4572-4573, 4575-4579, 4584-4585, 4587-4591, 4594-4599, 4602-4607, 4609, 4612-4614, 4616, 4618-4620, 4623, 4625-4627, 4629-4636, 4640-4646, 4649-4650, 4653-4656, 4658-4659, 4662-4667, 4670-4671, 4673-4677, 4683-4690, 4693, 4697-4701, 4703-4704, 4706, 4710-4716, 4720, 4723, 4726-4734, 4739-4741, 4743-4755, 4757, 4759-4761, 4764-4765, 4767, 4769, 4771-4774, 4778, 4780-4787, 4790-4793, 4795-4797, 4800, 4802-4812, 4815, 4817, 4819-4822, 4825, 4827-4830, 4836-4840, 4842-4843, 4845-4846, 4848-4851, 4854-4856, 4858-4862, 4864-4865, 4868-4877, 4880-4885, 4887, 4890, 4892-4893, 4895-4897, 4901-4902, 4904-4906, 4908-4910, 4914-4915, 4919-4921, 4923, 4926-4927, 4929, 4932-4933, 4935, 4937, 4939, 4942-4943, 4945, 4947-4950, 4953, 4955-4963, 4965-4966, 4968, 4973-4976, 4979-4986, 4988-4993, 4996-5002, 5004, 5006-5007, 5010-5032, 5034-5035, 5039, 5041-5045, 5047-5051, 5054-5059, 5062, 5065-5067, 5070-5074, 5076-5077, 5079-5081, 5084-5089, 5092, 5094, 5097-5100, 5104, 5106, 5108-5111, 5113-5114, 5116, 5120, 5122, 5124-5125, 5127, 5129-5134, 5137-5138, 5140, 5142, 5147, 5149, 5152, 5155, 5157-5163, 5165-5166, 5169-5173, 5175-5180, 5182-5183, 5185-5187, 5190-5191, 5199-5200, 5202, 5204-5209, 5211-5212, 5217-5219, 5222-5223, 5225, 5229-5242, 5245-5249, 5253-5255, 5260, 5263-5272, 5276-5277, 5279-5284, 5287-5291, 5293-5298, 5300, 5306-5307, 5309-5310, 5315, 5318, 5323-5324, 5326-5331, 5335, 5337-5346, 5348-5349, 5351-5353, 5357-5358, 5361-5363, 5365, 5367-5368, 5370, 5372-5380, 5382-5385, 5387-5396, 5398, 5400-5402, 5405-5409, 5411, 5413, 5419, 5422-5423, 5425-5427, 5429-5434, 5437, 5439-5445, 5447-5452, 5454, 5456, 5458-5462, 5466, 5468-5470, 5472-5483, 5485, 5487-5488, 5490-5495, 5498, 5500-5501, 5503, 5506, 5509, 5515, 5520, 5522, 5528, 5531, 5533-5536, 5538, 5540, 5543, 5546-5547, 5551-5553, 5555-5557, 5560-5574, 5577, 5581, 5583-5585, 5587, 5590, 5592-5593, 5597-5600, 5603, 5611-5612, 5614, 5616-5617, 5619-5621, 5623-5624, 5626-5628, 5630-5634, 5636, 5639-5640, 5642, 5644, 5647-5649, 5656-5658, 5660-5662, 5665-5666, 5668-5669, 5671-5672, 5674, 5677-5683, 5685, 5687-5690, 5692-5693, 5695-5697, 5699-5701, 5703, 5705-5706, 5708, 5711-5717, 5719-5720, 5724, 5727-5731, 5733-5735, 5737-5738, 5741, 5743, 5745, 5751-5756, 5758-5761, 5763, 5771, 5773-5780, 5782-5789, 5791-5793, 5795-5800, 5802-5804, 5806-5810, 5814-5816, 5818-5820, 5822-5825, 5827-5828, 5831-5832, 5835-5841, 5843, 5846, 5848-5854, 5857-5858, 5861-5863, 5867, 5872-5875, 5877, 5881, 5883-5894, 5896-5898, 5901, 5903-5905, 5907-5909, 5913-5914, 5920-5921, 5923, 5925-5926, 5929-5930, 5932, 5934-5939, 5941, 5943-5949, 5951-5952, 5954-5957, 5959, 5961-5963, 5965-5966, 5968-5972, 5974-5975, 5978-5984, 5988-5989, 5991, 5993-6001, 6003-6006, 6008-6009, 6011, 6013, 6016-6017, 6020-6022, 6024-6026, 6028-6030, 6032-6038, 6040-6045, 6047-6048, 6051-6052, 6054-6062, 6064-6065, 6070-6073, 6076-6079, 6082-6089, 6091-6093, 6096-6098, 6100, 6104, 6106-6109, 6111-6113, 6115-6117, 6120-6122, 6125-6126, 6128-6129, 6131, 6134-6138, 6141-6142, 6144, 6146-6147, 6150-6153, 6155-6158, 6160-6161, 6163-6169, 6171, 6173-6177, 6180, 6182-6188, 6190-6197, 6199, 6201-6204, 6207-6211, 6213-6215, 6217-6218, 6220-6221, 6223, 6225, 6227-6228, 6230-6234, 6236-6239, 6241, 6244-6249, 6251-6261, 6264-6265, 6268-6276, 6278, 6281-6283, 6285-6287, 6289-6294, 6296, 6307-6312, 6315-6316, 6318-6319, 6322, 6324-6331, 6333-6335, 6338-6339, 6341, 6344-6345, 6347-6352, 6354, 6356, 6359-6368, 6370-6371, 6377, 6380, 6385-6386, 6388, 6390, 6392-6394, 6396-6402, 6404-6405, 6410-6411, 6414-6423, 6427-6431, 6433-6434, 6436-6437, 6439-6440, 6442-6445, 6448-6455, 6457-6462, 6464-6466, 6469-6470, 6472, 6474-6476, 6478-6494, 6496, 6499, 6501, 6503-6505, 6507-6522, 6524-6526, 6529, 6531, 6533-6536, 6538-6539, 6541, 6544, 6546-6547, 6553-6556, 6559-6560, 6562-6565, 6567-6571, 6573-6575, 6580, 6582-6584, 6586-6595, 6598-6600, 6603-6609, 6611-6612, 6614-6621, 6623, 6626, 6631-6632, 6634-6640, 6642-6644, 6646, 6648-6649, 6651-6657, 6659-6665, 6669-6673, 6675-6676, 6680-6685, 6687-6690, 6692-6695, 6697-6708, 6710-6711, 6713-6715, 6718-6721, 6723, 6725, 6727-6728, 6730, 6732, 6734, 6736, 6738-6739, 6743-6744, 6746, 6748, 6750-6752, 6754-6758, 6760-6761, 6764-6767, 6769-6770, 6772-6773, 6775-6790, 6795, 6797-6799, 6801-6803, 6805-6806, 6809, 6811-6812, 6814-6817, 6819-6820, 6822-6828, 6831-6836, 6838, 6840-6842, 6845, 6847-6849, 6851, 6855, 6857-6860, 6862-6866, 6868-6869, 6872, 6874, 6881-6887, 6890-6894, 6903-6904, 6908-6919, 6923-6927, 6929, 6932, 6935-6938, 6943, 6945, 6948-6949, 6952-6953, 6955-6957, 6959-6964, 6966-6971, 6973-6977, 6980, 6982-6984, 6986-6989, 6992, 6995-7004, 7006-7008, 7011-7013, 7015, 7017, 7019-7021, 7023-7026, 7032-7034, 7036-7039, 7043, 7046, 7049-7051, 7053-7056, 7058, 7061, 7063, 7065-7066, 7069-7071, 7073, 7075-7078, 7080-7082, 7085-7089, 7092, 7095-7098, 7100-7103, 7105-7106, 7109, 7112-7118, 7121-7125, 7131-7138, 7140-7143, 7148, 7150, 7153, 7155, 7163-7165, 7167, 7169, 7172-7174, 7176-7178, 7180, 7183-7185, 7187-7189, 7191-7194, 7196-7203, 7207-7209, 7211-7212, 7215-7217, 7219-7224, 7227-7228, 7230-7237, 7240, 7242-7245, 7247-7248, 7252, 7255-7257, 7259-7261, 7263-7274, 7277-7285, 7288, 7290-7294, 7296, 7298-7305, 7307-7310, 7316, 7318-7320, 7322-7324, 7327-7329, 7331, 7334, 7336-7344, 7346-7347, 7351, 7355-7362, 7366, 7368-7369, 7371-7372, 7374-7376, 7379, 7381-7383, 7388-7391, 7395-7397, 7399-7400, 7403-7404, 7411-7414, 7416-7418, 7420, 7422, 7424-7425, 7428-7441, 7445-7450, 7452-7454, 7456-7458, 7460, 7462-7464, 7466, 7469, 7472-7473, 7475, 7480-7489, 7491, 7493-7494, 7496-7500, 7502-7503, 7506, 7509, 7511-7514, 7516-7518, 7520, 7523, 7525-7537, 7541, 7543, 7545-7546, 7550-7556, 7558, 7560, 7562-7564, 7566, 7568, 7570-7571, 7573-7574, 7580-7585, 7588-7590, 7593, 7595, 7597-7599, 7608, 7611, 7613, 7617-7618, 7620, 7623-7627, 7630, 7633-7634, 7636, 7638-7640, 7642, 7644, 7648, 7650-7651, 7653, 7655-7657, 7659-7663, 7665-7667, 7669, 7672-7676, 7678, 7680-7681, 7683-7685, 7687-7695, 7698, 7700, 7702-7710, 7712-7714, 7716, 7718, 7721-7726, 7728-7736, 7738-7744, 7746, 7748, 7751-7753, 7755, 7757, 7759-7761, 7764-7765, 7767-7769, 7771-7775, 7777, 7779, 7782, 7784-7786, 7789, 7791-7792, 7794-7798, 7800, 7802, 7805, 7812-7815, 7817-7820, 7822-7823, 7825, 7827, 7829, 7832-7833, 7835, 7839-7840, 7843, 7845-7852, 7854, 7858-7862, 7865, 7867-7868, 7870-7872, 7875-7880, 7882, 7885-7886, 7889-7891, 7894-7895, 7898-7899, 7901-7903, 7905-7908, 7910-7912, 7917-7921, 7923-7924, 7926-7931, 7933-7935, 7937-7941, 7943, 7946-7949, 7951-7958, 7960, 7962-7966, 7971-7976, 7978-7980, 7983, 7985-7991, 7994-7997, 8000-8001, 8003, 8005-8006, 8008, 8010, 8012-8016, 8018-8019, 8021-8028, 8030, 8032-8036, 8038-8041, 8043-8044, 8047-8052, 8054, 8057, 8059, 8061, 8063, 8065-8068, 8071, 8073-8077, 8079-8080, 8084, 8093-8094, 8096, 8098-8105, 8108-8109, 8112-8113, 8116-8120, 8122-8123, 8125, 8127-8130, 8132-8134, 8137-8144, 8148-8154, 8156-8157, 8161, 8164-8165, 8167, 8169, 8173, 8175, 8178, 8180-8182, 8192, 8195-8199, 8201-8204, 8207-8209, 8215-8220, 8222-8223, 8225-8226, 8229, 8231-8232, 8237, 8239, 8244-8246, 8248, 8250, 8252-8258, 8260-8261, 8263, 8265-8267, 8269-8270, 8272, 8276, 8279, 8282-8284, 8287-8288, 8292, 8294-8295, 8297-8300, 8302, 8304-8305, 8307, 8309-8317, 8321, 8323, 8326-8327, 8331-8336, 8338, 8340-8344, 8346-8347, 8352, 8354-8355, 8357-8358, 8362-8365, 8367, 8370, 8372-8373, 8376-8378, 8381-8387, 8389, 8391, 8393-8394, 8396, 8398, 8402-8405, 8407, 8409, 8411-8412, 8415-8416, 8418-8436, 8438-8439, 8441-8442, 8445-8448, 8451-8454, 8456-8460, 8465-8469, 8471, 8479, 8482, 8484-8485, 8487, 8489, 8491-8492, 8494, 8496-8498, 8501, 8504-8507, 8510-8511, 8513, 8517-8520, 8522-8524, 8526-8528, 8530-8531, 8545-8546, 8548-8555, 8557, 8559-8561, 8563-8566, 8568, 8570-8575, 8577-8588, 8590, 8592-8595, 8597, 8602-8604, 8606, 8608-8612, 8617, 8619, 8621-8623, 8633, 8635, 8638, 8640-8641, 8643-8644, 8647, 8649, 8651-8653, 8656-8660, 8665, 8667-8668, 8676-8680, 8682-8686, 8688, 8692-8693, 8696-8697, 8701-8704, 8707, 8709, 8722-8723, 8726, 8728, 8731-8735, 8737, 8743, 8745-8747, 8749, 8755, 8757-8759, 8761, 8764-8768, 8770, 8772-8773, 8775-8780, 8782, 8785-8787, 8789, 8792-8793, 8795-8797, 8799-8800, 8805, 8810-8811, 8816-8817, 8820, 8824-8827, 8829-8830, 8832-8833, 8835, 8838-8839, 8842, 8845, 8847-8849, 8851-8855, 8857, 8860-8870, 8874-8878, 8880-8881, 8885-8886, 8888, 8893, 8895-8900, 8903-8910, 8912, 8915-8916, 8918-8925, 8927-8931, 8935, 8937, 8940-8942, 8945, 8959, 8969, 8971, 8973-8977, 8980-8981, 8983-8984, 8986, 8989, 8992-8998, 9000, 9002, 9005-9006, 9011-9012, 9015, 9018, 9020, 9023-9024, 9026-9028, 9032, 9035-9036, 9043-9047, 9049, 9052, 9054, 9057, 9064-9065, 9069-9079, 9081, 9083-9089, 9092-9094, 9096-9097, 9099, 9102-9103, 9106, 9108-9111, 9113-9115, 9117-9119, 9123-9127, 9129, 9131-9137, 9139, 9141, 9143, 9149-9158, 9161-9163, 9165, 9167-9170, 9172, 9174, 9177-9178, 9180-9183, 9187, 9190-9192, 9197-9198, 9200, 9203, 9211-9212, 9215, 9217-9224, 9226-9229, 9232-9233, 9235-9240, 9242-9244, 9247, 9254, 9256-9257, 9259-9261, 9263-9266, 9268, 9271, 9280-9285, 9287, 9290, 9295-9297, 9301, 9303, 9305, 9307-9311, 9315, 9319-9320, 9322, 9329-9332, 9334, 9339-9340, 9342-9344, 9346-9350, 9352, 9354-9355, 9357-9359, 9361, 9363-9366, 9368-9371, 9373, 9375-9378, 9380-9382, 9385, 9388, 9390, 9393-9398, 9400, 9403-9404, 9408, 9410, 9414, 9416-9417, 9421, 9424, 9426, 9428-9429, 9432-9433, 9435-9438, 9441, 9444, 9446, 9449-9453, 9456-9458, 9462-9465, 9467-9468, 9472, 9476, 9478-9480, 9483, 9487-9488, 9490, 9492-9494, 9497-9499, 9505, 9508-9511, 9514-9515, 9517, 9520-9521, 9525, 9527-9528, 9531-9541, 9543-9550, 9558, 9560-9561, 9563-9565, 9567-9568, 9570-9573, 9575, 9579, 9581-9583, 9585-9591, 9593-9596, 9598, 9601, 9603, 9606, 9612-9613, 9618, 9620, 9622, 9624, 9626, 9630-9631, 9633-9635, 9637, 9644, 9647-9648, 9655-9656, 9658-9663, 9673-9675, 9677, 9681, 9684-9692, 9694-9695, 9698, 9701-9702, 9705-9707, 9709, 9711-9717, 9723, 9725-9728, 9731, 9733-9738, 9743-9749, 9751-9752, 9754, 9757-9758, 9760-9763, 9767, 9770, 9772, 9774-9775, 9777-9779, 9781, 9783, 9786-9789, 9791, 9793, 9795-9796, 9800-9803, 9805, 9808-9811, 9813-9816, 9818-9819, 9821-9824, 9827-9835, 9838, 9840-9841, 9843-9851, 9854-9862, 9865, 9867-9870, 9873-9878, 9881, 9884-9887, 9890-9918, 9920-9921, 9923, 9926, 9928, 9930-9937, 9939, 9941-9944, 9946-9947, 9954-9959, 9961, 9965, 9967-9968, 9970-9972, 9974, 9978-9979, 9981-9982, 9984-9986, 9988-9989, 9991-9992, 9994, 9996, 9998-9999, 10001, 10003-10013, 10015-10018, 10020-10021, 10023, 10025-10027, 10030-10032, 10034-10035, 10037-10048, 10051-10052, 10054-10055, 10057-10058, 10060, 10063-10078, 10080-10087, 10090-10091, 10093-10095, 10099-10101, 10103, 10106-10108, 10110-10113, 10115-10119, 10121-10122, 10127-10128, 10131-10133, 10135-10136, 10138, 10142-10147, 10149-10157, 10159-10160, 10162, 10164-10174, 10176, 10178-10181, 10183, 10185-10188, 10190-10192, 10195, 10197-10200, 10202-10204, 10206-10207, 10209-10212, 10215-10219, 10221-10222, 10228-10234, 10236, 10238-10239, 10242, 10246-10254, 10256-10259, 10261-10264, 10267-10271, 10273, 10275-10276, 10278, 10280, 10282-10284, 10286-10287, 10289-10290, 10292-10295, 10297-10305, 10307, 10310-10315, 10319-10328, 10330-10333, 10336, 10339, 10342, 10345-10348, 10350-10352, 10354-10355, 10359, 10361, 10363, 10365, 10368, 10370-10374, 10377-10378, 10380-10382, 10384, 10386, 10389-10390, 10394, 10396-10399, 10402, 10406, 10409-10412, 10415-10416, 10418, 10422, 10424, 10426, 10428-10429, 10431-10433, 10438-10440, 10447, 10449-10450, 10453, 10456, 10458, 10460-10462, 10464, 10466, 10468-10469, 10471, 10473, 10475-10478, 10480-10483, 10485-10487, 10489, 10491-10492, 10496, 10501, 10505, 10507-10511, 10513-10516, 10521-10535, 10541-10542, 10544-10545, 10547-10548, 10550-10557, 10560-10562, 10565, 10567, 10569, 10571-10574, 10576-10583, 10586-10587, 10589, 10592, 10594-10596, 10598, 10600, 10603-10604, 10607, 10609-10612, 10614-10615, 10618-10625, 10628, 10630-10632, 10635-10636, 10638-10641, 10643, 10645-10646, 10648, 10652, 10654-10657, 10660-10668, 10670-10671, 10675-10678, 10680, 10682, 10684-10692, 10694-10697, 10699-10708, 10711-10713, 10715, 10717, 10719, 10722-10723, 10728-10730, 10732-10733, 10735, 10737-10747, 10749-10750, 10752-10754, 10756, 10758, 10760-10763, 10766, 10768-10774, 10780, 10783-10784, 10786, 10790-10796, 10798, 10800-10805, 10808-10809, 10811-10813, 10815, 10817-10818, 10820, 10823, 10826, 10829-10832, 10834-10836, 10838-10839, 10841-10845, 10848-10852, 10855-10860, 10862-10863, 10867-10873, 10876, 10879, 10882-10886, 10888, 10890-10891, 10893, 10895-10897, 10900-10903, 10905, 10908, 10912-10917, 10920, 10922, 10924, 10926-10927, 10929-10931, 10933-10939, 10942-10943, 10945, 10947-10954, 10958-10959, 10962-10963, 10965, 10967, 10970-10973, 10977-10980, 10982, 10984-10985, 10987, 10989-10992, 10994, 10997-11000, 11002, 11004, 11006-11008, 11010, 11012-11018, 11023-11025, 11028-11035, 11037-11039, 11041, 11045-11046, 11048-11049, 11051-11058, 11060-11062, 11064-11065, 11068-11074, 11076-11079, 11081, 11083-11090, 11092-11093, 11096, 11103-11104, 11107-11108, 11110-11113, 11115-11119, 11121, 11125, 11127-11128, 11130, 11135, 11138, 11141, 11144-11145, 11148-11149, 11151, 11157, 11160, 11162-11165, 11167, 11173, 11175-11176, 11182, 11184, 11190-11191, 11193-11197, 11199, 11201, 11203, 11205-11206, 11210-11216, 11218, 11220, 11222-11223, 11226-11229, 11231-11238, 11243-11244, 11246-11248, 11253-11255, 11257-11262, 11270-11273, 11275, 11277, 11281-11282, 11284-11292, 11296-11300, 11302-11304, 11306-11307, 11309-11310, 11313-11314, 11317, 11320, 11322-11325, 11327-11335, 11337, 11343-11344, 11346-11348, 11351, 11354, 11358-11360, 11363-11364, 11366-11370, 11372-11387, 11390, 11392-11394, 11396, 11400, 11402-11404, 11406-11409, 11412-11414, 11416-11418, 11420-11429, 11432-11438, 11440, 11442, 11444-11445, 11448, 11450, 11453, 11455-11457, 11459-11467, 11469-11470, 11472-11473, 11475-11477, 11479-11490, 11493-11495, 11498, 11501-11503, 11505-11507, 11510-11511, 11513-11516, 11519-11523, 11525, 11527-11536, 11538-11539, 11541-11562, 11565-11567, 11569-11573, 11575-11577, 11580, 11582-11583, 11585-11586, 11588, 11590-11591, 11594, 11596-11598, 11600, 11603, 11605-11614, 11617-11618, 11622, 11626, 11628-11629, 11631-11635, 11637-11640, 11642, 11646, 11650, 11652, 11656-11658, 11662-11663, 11665-11666, 11668-11669, 11671-11674, 11676-11678, 11681, 11683-11685, 11687, 11690-11692, 11694-11699, 11701-11706, 11708-11713, 11717-11719, 11725, 11727-11728, 11730, 11732, 11735-11737, 11742, 11744-11745, 11747, 11749-11754, 11756-11757, 11760-11763, 11765, 11768, 11770-11774, 11777-11778, 11780, 11782-11787, 11791-11793, 11797-11798, 11800-11806, 11808, 11811, 11813-11814, 11817-11825, 11827-11829, 11832, 11834-11838, 11840, 11842, 11848-11849, 11851, 11853-11855, 11857-11859, 11863-11868, 11870-11871, 11873-11875, 11877, 11879-11884, 11887, 11889-11892, 11895-11904, 11906-11907, 11910-11912, 11914-11915, 11917, 11919, 11921, 11925-11932, 11935, 11937-11938, 11940-11941, 11944-11945, 11947-11951, 11954, 11956, 11958, 11960-11962, 11964, 11966, 11972-11974, 11979, 11985-11986, 11989-11991, 11993, 11998-11999, 12005-12007, 12009-12011, 12013-12015, 12018-12019, 12025, 12027-12028, 12034-12035, 12037-12039, 12041-12046, 12048-12054, 12056-12059, 12061, 12063, 12065-12068, 12071-12072, 12074-12078, 12080-12081, 12083-12084, 12086, 12088-12089, 12092-12093, 12095, 12097-12102, 12104-12109, 12111, 12115, 12117-12120, 12123-12124, 12127, 12129-12130, 12132, 12134, 12136-12137, 12139-12142, 12144-12146, 12149-12150, 12153, 12155-12156, 12159-12166, 12168, 12170, 12172-12173, 12176-12183, 12187, 12191-12197, 12200-12201, 12206-12211, 12213-12218, 12220-12221, 12224, 12226-12232, 12234, 12237-12240, 12242-12246, 12249, 12251-12254, 12256, 12259, 12261, 12263-12265, 12267, 12269-12270, 12273-12280, 12282-12288, 12290-12291, 12293-12294, 12296, 12298-12300, 12302-12304, 12306, 12310-12311, 12313, 12315-12320, 12322-12323, 12330-12331, 12333, 12335-12336, 12338, 12340-12341, 12345, 12347-12351, 12354-12355, 12357, 12359, 12362-12370, 12372-12375, 12377-12386, 12388-12389, 12394, 12398-12400, 12402, 12405, 12407, 12409-12413, 12420-12422, 12424-12427, 12429, 12431-12432, 12434, 12436-12437, 12442, 12446-12456, 12458, 12461-12462, 12464, 12466-12468, 12470-12474, 12476-12478, 12481-12482, 12485-12486, 12488-12489, 12491-12494, 12497-12502, 12504, 12506, 12509-12514, 12516-12526, 12528, 12531, 12533, 12535-12541, 12543, 12546-12549, 12551, 12553-12557, 12560-12568, 12571, 12574-12581, 12584, 12586-12592, 12594, 12598, 12600-12604, 12606, 12608, 12611-12615, 12618, 12621-12622, 12624-12625, 12628, 12630-12632, 12634-12636, 12638-12645, 12648-12654, 12659, 12661, 12663-12665, 12667-12668, 12671-12674, 12676, 12682-12685, 12687-12698, 12700-12708, 12710-12713, 12716, 12718, 12720-12727, 12729, 12731-12733, 12737-12738, 12741-12743, 12745, 12747-12749, 12751, 12753, 12756-12761, 12763-12768, 12772-12782, 12786-12787, 12793, 12795-12797, 12799, 12801, 12803, 12805, 12808-12810, 12812, 12814, 12817-12821, 12823-12827, 12830-12831, 12833-12837, 12840-12841, 12843, 12849-12855, 12857-12859, 12861-12865, 12869-12872, 12874-12875, 12877-12878, 12881, 12886-12890, 12892, 12894-12900, 12902, 12907, 12911, 12915, 12917, 12919-12920, 12925-12926, 12931, 12936, 12939, 12941-12942, 12945-12946, 12948, 12951, 12957-12958, 12960-12961, 12963-12965, 12967, 12971-12973, 12977, 12979, 12982, 12984, 12986-12987, 12989-12994, 12997-12998, 13001-13002, 13005, 13008-13011, 13013-13016, 13018, 13021, 13025-13030, 13033-13037, 13039, 13042-13043, 13049, 13051, 13053, 13056-13063, 13065-13067, 13070, 13075, 13077, 13080, 13082-13091, 13096-13100, 13106-13109, 13111-13116, 13118-13120, 13122, 13124-13125, 13127, 13130-13131, 13135, 13137-13139, 13142, 13146-13151, 13153-13154, 13158, 13160-13176, 13182-13183, 13186, 13188-13189, 13192-13193, 13196, 13200, 13202, 13204-13205, 13207-13208, 13211, 13213-13214, 13216-13218, 13220-13225, 13227-13231, 13233, 13237-13239, 13241-13242, 13246-13256, 13258-13259, 13261-13262, 13265, 13267-13269, 13272, 13274, 13276, 13279-13280, 13282-13283, 13285, 13287, 13289, 13292, 13294-13297, 13299-13305, 13307, 13310-13311, 13315, 13317, 13319, 13321, 13324-13325, 13327-13333, 13335-13338, 13340-13341, 13345-13352, 13354-13355, 13357-13361, 13367-13369, 13371, 13374-13378, 13381-13391, 13401, 13403-13405, 13408-13409, 13411, 13413-13418, 13420, 13422-13424, 13426-13428, 13431-13434, 13440, 13442-13445, 13450-13451, 13455, 13457-13461, 13463-13464, 13468-13469, 13471, 13474-13475, 13478, 13482-13484, 13488-13491, 13494-13495, 13498-13499, 13501-13507, 13509-13512, 13514-13515, 13517-13519, 13522-13524, 13526-13532, 13537, 13539-13541, 13543-13546, 13548-13549, 13551, 13555-13564, 13566-13568, 13570-13576, 13578-13580, 13582-13587, 13590-13595, 13597-13600, 13602, 13604, 13607-13615, 13618, 13620-13622, 13624, 13627, 13629-13632, 13635-13636, 13638-13639, 13642-13645, 13647-13648, 13650-13652, 13656-13660, 13664-13666, 13673, 13677, 13679, 13685, 13688-13694, 13697-13706, 13708-13710, 13713-13714, 13722-13723, 13727, 13729, 13731-13732, 13734-13735, 13741, 13743-13745, 13747-13750, 13753, 13755, 13757-13758, 13765, 13767-13771, 13773-13774, 13776-13778, 13784, 13787-13794, 13798, 13802, 13804-13813, 13815, 13817-13818, 13820, 13822-13823, 13829-13830, 13832-13834, 13837-13838, 13840-13841, 13843-13848, 13851-13852, 13854-13856, 13859-13862, 13864-13866, 13868-13872, 13876-13877, 13880-13881, 13883-13888, 13890-13898, 13900-13901, 13904-13905, 13908-13910, 13912-13914, 13916-13917, 13920, 13923-13929, 13935-13936, 13938-13941, 13947, 13949-13951, 13953-13956, 13960-13961, 13963-13966, 13969, 13973, 13975, 13978, 13980, 13985-13993, 13998, 14000-14005, 14007, 14011-14012, 14014, 14016, 14021-14023, 14025, 14028, 14031-14040, 14042-14046, 14049-14051, 14053-14062, 14064-14066, 14071, 14073-14074, 14076, 14078, 14080-14084, 14086-14087, 14089-14094, 14096-14097, 14099, 14102-14109, 14123, 14126, 14129, 14131-14135, 14137, 14139-14144, 14147, 14150, 14152, 14155-14161, 14163-14164, 14170, 14173-14178, 14180-14181, 14184-14186, 14188-14190, 14194, 14196-14198, 14200-14201, 14203-14205, 14209-14212, 14214, 14216-14222, 14226-14227, 14229-14232, 14234-14235, 14237-14238, 14240, 14244, 14249, 14252-14255, 14257-14260, 14262-14264, 14266-14270, 14272-14273, 14276, 14278, 14281, 14283, 14285-14290, 14295-14296, 14299, 14302, 14304-14306, 14309-14310, 14314-14315, 14318, 14327-14328, 14330, 14332, 14335, 14339, 14341, 14344, 14347, 14350, 14352, 14354-14362, 14364, 14366-14367, 14371, 14373-14378, 14380, 14382-14383, 14385-14393, 14396-14397, 14399-14403, 14405, 14407, 14409, 14412, 14419, 14422, 14424-14425, 14427-14430, 14432-14434, 14436, 14441, 14449-14454, 14459-14461, 14467-14468, 14470-14471, 14473, 14478, 14480-14482, 14486-14489, 14492-14494, 14497-14506, 14517-14519, 14525, 14527, 14532-14533, 14535-14536, 14540-14545, 14547-14548, 14550-14552, 14554-14556, 14559-14561, 14563, 14566-14567, 14569-14571, 14573, 14576-14580, 14583-14589, 14591-14593, 14595, 14598, 14600-14601, 14603-14612, 14614, 14617-14618, 14621-14629, 14631-14633, 14637, 14643, 14647-14650, 14655, 14662, 14664-14665, 14671, 14673-14679, 14681-14682, 14684, 14687-14688, 14690-14694, 14696-14697, 14699, 14702, 14704, 14708, 14711-14712, 14715-14717, 14719-14723, 14725-14727, 14731-14732, 14734-14743, 14745, 14747-14755, 14758-14759, 14761-14762, 14764, 14766-14771, 14773-14775, 14778, 14781-14783, 14785-14787, 14791-14803, 14806-14813, 14816-14817, 14820-14823, 14825, 14827-14829, 14832-14833, 14835, 14837-14844, 14848, 14852, 14854, 14856, 14859, 14861-14866, 14868, 14870-14875, 14877-14878, 14880-14885, 14887-14889, 14892, 14896-14897, 14899, 14902-14910, 14912-14915, 14917, 14919, 14921, 14925-14927, 14930, 14933-14934, 14936-14938, 14940, 14942-14944, 14946-14948, 14951, 14953-14954, 14957-14960, 14962-14964, 14966-14967, 14973-14976, 14981, 14983, 14987, 14989-14992, 14996-14997, 14999-15002, 15004-15013, 15015, 15018-15020, 15022-15025, 15027, 15029-15030, 15032, 15034, 15037-15042, 15044-15049, 15051-15053, 15055, 15060, 15065-15067, 15071-15073, 15076, 15080-15082, 15084-15091, 15093-15094, 15097, 15099-15101, 15104-15108, 15111, 15114-15119, 15122, 15124, 15128, 15130-15133, 15138, 15141, 15144-15152, 15154, 15156-15160, 15162-15166, 15168-15186, 15189-15191, 15193-15194, 15199-15206, 15208, 15210-15211, 15213, 15215, 15218-15219, 15224-15225, 15227-15230, 15232-15233, 15236, 15238-15239, 15242-15246, 15248-15253, 15257-15264, 15266, 15277, 15281, 15284-15285, 15288, 15293, 15295, 15297, 15300, 15302, 15305, 15307, 15309, 15312, 15315-15323, 15325, 15327-15334, 15339-15340, 15342-15343, 15345-15347, 15349-15351, 15353-15354, 15358, 15360, 15363-15365, 15367, 15370-15371, 15373, 15375-15376, 15384, 15387-15388, 15391, 15393-15394, 15397, 15400-15411, 15413-15416, 15418-15420, 15424, 15426-15427, 15430, 15432, 15435-15443, 15445, 15447-15448, 15451, 15454, 15459, 15461, 15463-15467, 15471-15474, 15476, 15479-15483, 15486-15493, 15495-15496, 15498-15500, 15502-15505, 15511-15512, 15514-15518, 15522-15529, 15534-15538, 15541, 15543, 15545, 15548-15551, 15553, 15555-15556, 15559-15561, 15565, 15567, 15569-15570, 15573-15575, 15579, 15582-15583, 15587-15588, 15590-15592, 15595, 15597-15600, 15602-15603, 15605-15606, 15608-15609, 15612, 15615, 15617-15618, 15620-15621, 15623, 15625-15631, 15633-15634, 15637, 15639, 15643-15644, 15647, 15649, 15651-15658, 15660-15663, 15665, 15667-15668, 15670, 15672, 15676-15686, 15688, 15692, 15694-15701, 15703-15704, 15707, 15710-15712, 15714-15718, 15720-15737, 15739-15742, 15744, 15748, 15750-15753, 15755-15756, 15758-15759, 15761-15762, 15764, 15770, 15772, 15776-15777, 15780-15781, 15783, 15786, 15788-15789, 15791-15794, 15796-15800, 15802-15807, 15811, 15813-15815, 15817-15818, 15820, 15822, 15825-15832, 15834-15837, 15840-15841, 15843-15844, 15847, 15850, 15852-15853, 15856-15857, 15859-15863, 15866-15868, 15870-15873, 15875, 15877, 15879, 15881-15886, 15890, 15892-15894, 15897-15898, 15900-15901, 15905, 15908-15916, 15919-15928, 15930-15934, 15936-15942, 15945-15947, 15950-15953, 15957, 15960, 15962, 15966-15967, 15969-15970, 15972-15977, 15979, 15982-15986, 15988, 15991-16002, 16005, 16007-16008, 16011, 16013-16014, 16016-16019, 16021, 16025-16037, 16039-16042, 16045-16046, 16048-16049, 16053-16065, 16067, 16070-16074, 16076, 16078, 16081-16083, 16085, 16087-16089, 16093-16094, 16096-16097, 16100-16105, 16107-16109, 16112, 16116-16118, 16120-16121, 16124-16125, 16129-16131, 16133-16134, 16136-16139, 16142, 16144-16145, 16148-16151, 16155, 16159-16163, 16167-16168, 16171-16172, 16176, 16179-16180, 16182-16185, 16187-16191, 16193-16201, 16203, 16206-16209, 16211-16213, 16217-16218, 16220-16222, 16224-16225, 16230, 16232-16235, 16237-16244, 16246-16247, 16249-16255, 16259-16260, 16262, 16264-16267, 16269-16277, 16281-16288, 16290, 16293, 16295-16297, 16300-16301, 16305-16306, 16308, 16310, 16312-16320, 16322-16324, 16329-16331, 16333, 16335-16336, 16338, 16340-16341, 16344-16345, 16347, 16349-16350, 16352-16356, 16359, 16361, 16363-16369, 16372-16376, 16378-16389, 16391, 16393-16402, 16408-16409, 16411-16412, 16415, 16418-16424, 16426, 16428-16433, 16435-16437, 16439, 16441-16442, 16444, 16447, 16449, 16451, 16453-16455, 16457, 16461, 16468, 16470-16477, 16480-16481, 16483, 16485-16486, 16488-16491, 16493, 16495-16498, 16500-16504, 16506, 16508, 16510-16511, 16513-16521, 16525-16527, 16529, 16533-16536, 16538, 16540-16544, 16546, 16548-16550, 16552-16555, 16557-16558, 16561-16563, 16567-16570, 16572-16576, 16578, 16585, 16588, 16593-16596, 16598-16603, 16605-16606, 16608, 16610-16613, 16616-16618, 16620, 16622-16623, 16625, 16628, 16632-16641, 16643, 16645-16646, 16648-16649, 16651-16652, 16654, 16656-16657, 16659-16660, 16664, 16667-16672, 16674, 16677, 16679-16680, 16682, 16684, 16686-16687, 16689-16692, 16694, 16698-16705, 16707-16708, 16710-16712, 16716-16718, 16720, 16722-16724, 16726-16728, 16730-16733, 16735-16737, 16739-16741, 16744, 16748-16750, 16752-16758, 16762-16766, 16768-16770, 16776-16778, 16781, 16783-16786, 16788-16793, 16797, 16799-16800, 16802, 16805, 16809-16818, 16820, 16822-16824, 16826, 16829, 16831-16835, 16839-16842, 16845-16848, 16850-16853, 16855-16856, 16858, 16860-16861, 16863-16871, 16873, 16876-16877, 16883, 16886-16887, 16889-16896, 16899, 16903, 16906-16911, 16913, 16916, 16919, 16921, 16926, 16928, 16931, 16934, 16936-16938, 16940-16946, 16948-16949, 16951-16957, 16959-16962, 16964-16969, 16974, 16976-16979, 16983-16984, 16986-16991, 16995-16997, 16999-17003, 17006, 17008, 17013-17016, 17018-17019, 17021, 17023-17024, 17026-17027, 17029-17045, 17048-17056, 17058-17063, 17065, 17067-17069, 17071-17077, 17080-17084, 17088-17090, 17093-17094, 17096-17103, 17105, 17107-17115, 17125, 17128, 17130, 17132-17133, 17136, 17138-17139, 17141-17146, 17148, 17150, 17153-17154, 17156-17157, 17159-17160, 17162-17165, 17168-17169, 17173-17177, 17179-17182, 17186-17191, 17194-17201, 17203-17204, 17208-17212, 17214-17223, 17225-17226, 17228, 17230, 17232-17233, 17235-17236, 17238, 17241-17242, 17244-17246, 17249-17250, 17252, 17255-17259, 17261-17263, 17265-17270, 17272-17273, 17276, 17283-17284, 17286-17294, 17296, 17298, 17300, 17302-17309, 17311-17312, 17314-17315, 17318-17323, 17327-17330, 17332-17335, 17337-17341, 17343, 17347, 17349-17356, 17359-17361, 17364-17365, 17367-17370, 17373-17379, 17382-17383, 17387-17389, 17392, 17395-17398, 17400-17401, 17405-17409, 17411-17413, 17415-17416, 17418, 17420, 17422-17425, 17428-17437, 17439, 17441, 17443-17445, 17448, 17450, 17452-17455, 17457-17466, 17468, 17472-17473, 17480, 17482-17484, 17486-17488, 17490-17492, 17494-17495, 17498-17499, 17501-17503, 17507-17514, 17518-17520, 17523-17524, 17526-17528, 17531, 17533-17534, 17536, 17538-17539, 17543, 17546-17549, 17551-17555, 17559, 17561, 17563, 17566, 17568, 17578-17586, 17588, 17590-17591, 17593-17594, 17597, 17600, 17602-17603, 17605-17609, 17611-17612, 17614-17616, 17619-17620, 17628-17632, 17634-17635, 17637, 17641, 17644-17646, 17648-17649, 17651, 17654-17655, 17657-17658, 17660, 17663-17664, 17667, 17669, 17671-17672, 17674-17680, 17682-17685, 17688-17689, 17691-17693, 17695-17696, 17698-17699, 17701-17702, 17704-17705, 17707-17708, 17710-17711, 17713-17718, 17720, 17722-17732, 17735, 17738-17749, 17751-17760, 17762-17766, 17768-17773, 17775-17777, 17779-17780, 17783-17784, 17786-17788, 17790-17796, 17798-17799, 17801-17802, 17804, 17807, 17809-17810, 17812-17815, 17817, 17819-17823, 17825, 17829, 17831-17837, 17844-17845, 17847-17855, 17857-17859, 17864-17869, 17871-17881, 17883-17884, 17886, 17891, 17893-17895, 17897-17899, 17901, 17903-17907, 17909, 17911-17915, 17917, 17919, 17922, 17925-17929, 17932-17934, 17936-17937, 17939, 17941-17942, 17946, 17948, 17951, 17953, 17955-17959, 17962-17970, 17975-17978, 17980-17981, 17983, 17985-17987, 17989, 17991-17997, 18000-18001, 18006-18007, 18009-18010, 18013, 18021, 18024-18025, 18028, 18031-18032, 18034-18037, 18039, 18045, 18047, 18051, 18053-18054, 18056-18062, 18065, 18067, 18074-18075, 18077-18078, 18082, 18084, 18087-18090, 18095, 18097, 18101-18102, 18104-18105, 18108-18109, 18111-18121, 18123, 18125-18126, 18128-18129, 18133-18135, 18137-18139, 18148-18149, 18151-18161, 18163-18165, 18167, 18169-18170, 18173, 18176, 18181-18191, 18193-18195, 18197, 18200-18201, 18211-18212, 18214-18216, 18222-18223, 18228-18229, 18232, 18237, 18239-18242, 18244, 18246-18247, 18249-18250, 18252-18253, 18255, 18259, 18261, 18263, 18266-18267, 18269, 18273-18274, 18277-18280, 18282-18289, 18292-18294, 18296, 18299-18301, 18303-18304, 18306, 18308, 18310-18311, 18313-18314, 18317-18319, 18322-18326, 18330-18334, 18339-18340, 18346-18349, 18353, 18355-18357, 18359, 18361-18364, 18366-18368, 18371-18372, 18380, 18386-18387, 18389, 18392, 18394, 18398-18399, 18401-18402, 18405-18408, 18413, 18415-18416, 18418-18422, 18425-18427, 18431-18432, 18435, 18437, 18439-18440, 18442, 18445, 18450-18452, 18454-18456, 18460-18462, 18465, 18468-18470, 18472-18473, 18476, 18479, 18482-18483, 18485-18489, 18491, 18493-18495, 18497-18498, 18500, 18503-18508, 18510-18514, 18517-18527, 18529, 18531, 18534-18538, 18540, 18542, 18544, 18546, 18548-18550, 18552, 18555-18561, 18566, 18571-18572, 18575-18576, 18579, 18582, 18585, 18587-18588, 18591-18592, 18596-18597, 18599, 18601-18603, 18606, 18608-18611, 18613, 18615-18620, 18622-18624, 18629-18632, 18634-18636, 18640-18641, 18643-18650, 18652, 18654-18655, 18660-18663, 18668-18672, 18675-18679, 18681, 18684, 18687-18689, 18697-18703, 18707, 18711, 18714, 18716-18718, 18721, 18727-18728, 18734, 18737, 18739, 18741-18742, 18746, 18750-18752, 18760, 18764-18766, 18768-18769, 18771, 18773, 18775-18776, 18778-18779, 18782-18783, 18785, 18790-18791, 18793-18794, 18796-18798, 18800-18809, 18811-18813, 18815-18816, 18818-18819, 18821-18823, 18826-18828, 18833-18835, 18837-18838, 18840, 18842-18843, 18847-18851, 18853, 18856, 18859-18860, 18863-18864, 18866-18869, 18872, 18874, 18876, 18879-18891, 18893, 18896-18899, 18901-18906, 18908, 18910, 18912, 18915-18919, 18921-18923, 18926-18929, 18931-18932, 18935, 18937, 18939-18942, 18944-18945, 18947-18949, 18952, 18954, 18960-18963, 18965, 18967-18969, 18973-18976, 18978, 18981, 18983-18984, 18986-18993, 18996, 18998-18999, 19001, 19004-19006, 19008-19013, 19015-19018, 19020-19022, 19025-19028, 19032-19033, 19037, 19042-19044, 19047-19049, 19054-19055, 19057, 19059-19060, 19062-19067, 19070-19071, 19073-19075, 19077-19080, 19083, 19085-19087, 19089, 19091, 19095-19097, 19100, 19102-19104, 19106-19112, 19114-19117, 19119-19122, 19126-19130, 19132-19133, 19136, 19138-19139, 19141, 19146, 19149-19151, 19153-19154, 19156-19158, 19160-19164, 19167-19168, 19172, 19174, 19176, 19179-19180, 19184-19187, 19189-19190, 19192-19193, 19195-19198, 19200-19201, 19203-19208, 19210-19216, 19218, 19221-19222, 19227-19228, 19230-19231, 19234, 19241-19242, 19244-19246, 19248-19249, 19251, 19253-19254, 19257, 19260-19263, 19267, 19269, 19271-19272, 19274-19275, 19277-19278, 19280-19286, 19292-19295, 19297, 19299, 19302, 19307-19308, 19310-19311, 19313, 19315-19317, 19319, 19321-19322, 19325, 19328, 19330, 19333, 19337-19338, 19341, 19344-19347, 19351-19352, 19354, 19357-19358, 19360-19363, 19365, 19367-19369, 19372, 19377, 19381-19382, 19391-19396, 19398-19399, 19402-19404, 19407, 19411-19416, 19418-19422, 19424-19432, 19434-19437, 19440, 19445-19446, 19450-19451, 19457-19462, 19464-19468, 19470-19471, 19474-19475, 19478-19482, 19484, 19486-19496, 19499-19504, 19506, 19508, 19510-19512, 19520, 19523-19525, 19529, 19532-19533, 19535-19536, 19541, 19544, 19547-19560, 19566, 19569-19573, 19575-19577, 19579, 19581-19583, 19586-19588, 19591-19597, 19599, 19601-19605, 19608-19610, 19612, 19614-19615, 19617, 19619-19622, 19624-19625, 19627-19629, 19634-19635, 19637-19641, 19643-19651, 19654-19655, 19657, 19659-19661, 19663, 19665-19669, 19671-19673, 19675, 19680-19682, 19685, 19687, 19691-19693, 19695-19705, 19708-19711, 19713-19716, 19718, 19720-19721, 19723-19727, 19731, 19733, 19735-19740, 19742, 19744, 19752, 19754-19755, 19758, 19760, 19766, 19768, 19770, 19772-19774, 19776-19780, 19785-19786, 19788, 19790-19792, 19794-19795, 19797-19798, 19800-19802, 19804, 19806-19807, 19809, 19812-19813, 19816, 19819, 19821-19823, 19825-

19826, 19828-19831, 19834, 19837, 19840, 19843, 19845, 19847, 19850-19852, 19855-19858, 19862, 19865-19866, 19868-19869, 19872-19874, 19876-19880, 19882-19883, 19885-19891, 19897, 19899, 19903-19907, 19911-19913, 19915-19917, 19919-19920, 19922-19927, 19929-19930, 19932-19938, 19940, 19942-19948, 19950-19958, 19960-19961, 19963, 19965, 19967-19970, 19975-19976, 19978, 19980-19985, 19987, 19989-19992, 19996, 19998-19999, 20001-20008, 20012, 20015-20019, 20022, 20027-20033, 20038, 20040-20042, 20044, 20046-20048, 20050, 20053-20055, 20060, 20065-20068, 20070-20080, 20082-20087, 20089-20092, 20094-20096, 20099, 20103, 20105, 20107, 20109-20110, 20114-20128, 20131, 20134-20137, 20139, 20141-20143, 20145-20146, 20148, 20150-20151, 20157-20161, 20166, 20169-20172, 20175, 20177-20178, 20182, 20186-20187, 20189-20194, 20201-20204, 20206, 20209-20213, 20215, 20217, 20219-20220, 20224-20227, 20229, 20231-20233, 20238-20241, 20244-20245, 20248-20250, 20252-20253, 20257-20260, 20262-20263, 20265-20266, 20269-20282, 20285, 20287, 20291, 20294, 20296-20297, 20301-20324, 20326-20329, 20332-20337, 20340-20341, 20343, 20345-20346, 20348-20354, 20356, 20358, 20362-20364, 20368, 20370, 20372-20379, 20381-20390, 20392, 20394, 20396-20399, 20401-20408, 20410, 20412-20417, 20423-20424, 20426, 20431-20433, 20436-20439, 20441-20442, 20445-20447, 20450, 20458-20459, 20461, 20463-20467, 20470, 20473-20478, 20480-20482, 20485, 20489-20492, 20494, 20499-20501, 20504, 20506-20509, 20511-20512, 20514, 20516, 20518-20520, 20526, 20530, 20532-20533, 20536, 20540, 20542-20549, 20551-20558, 20561-20563, 20565-20566, 20568-20569, 20571-20573, 20578-20579, 20583, 20586, 20589, 20593, 20595, 20597, 20599-20600, 20602, 20607, 20609, 20611, 20616-20617, 20621-20626, 20628, 20631-20632, 20634, 20638-20641, 20643-20645, 20647-20649, 20651-20653, 20655-20663, 20668, 20670-20677, 20680-20684, 20686-20687, 20692-20697, 20699, 20702-20703, 20707-20708, 20710-20713, 20717, 20719, 20721-20723, 20726, 20728-20730, 20733-20734, 20736, 20739-20742, 20745, 20748-20752, 20754-20755, 20757, 20759, 20761, 20763-20767, 20770-20772, 20774, 20776, 20780-20793, 20796, 20802, 20805-20806, 20808-20809, 20816-20817, 20820-20823, 20826, 20831-20837, 20839, 20841, 20844-20850, 20854-20855, 20859, 20862, 20869-20870, 20873-20874, 20876-20880, 20889-20892, 20894-20898, 20901-20902, 20905, 20907-20911, 20913-20914, 20917, 20924-20928, 20930, 20933-20938, 20940, 20942-20951, 20953-20954, 20957-20958, 20960, 20963-20964, 20966-20969, 20971-20975, 20982, 20984, 20987, 20992, 20994-20998, 21000-21003, 21005-21011, 21014-21018, 21020-21021, 21025, 21027, 21029-21033, 21037, 21041-21046, 21048-21050, 21052, 21054-21056, 21060, 21062, 21065, 21067, 21070, 21073-21077, 21080-21083, 21085, 21087, 21089, 21091-21093, 21095, 21099, 21101, 21103-21105, 21109, 21113, 21117-21118, 21120, 21122-21123, 21126-21129, 21131-21132, 21134-21141, 21143-21144, 21151-21166, 21168-21169, 21179-21182, 21184, 21187-21189, 21191, 21194, 21197, 21199, 21203, 21205-21206, 21208-21210, 21213-21214, 21216-21225, 21227-21233, 21235-21237, 21239-21241, 21244, 21246, 21248-21250, 21252-21253, 21255-21258, 21261-21264, 21269, 21272, 21275, 21278, 21281-21285, 21287-21290, 21295, 21299-21301, 21305, 21307-21308, 21310-21315, 21317-21318, 21325-21332, 21334-21338, 21340-21342, 21345, 21347, 21351-21357, 21359, 21361, 21364-21366, 21371-21373, 21375-21376, 21378-21380, 21384-21388, 21390-21391, 21393, 21399, 21402-21404, 21406-21407, 21412-21414, 21416-21417, 21419, 21423, 21425-21427, 21429-21441, 21443-21444, 21448, 21450, 21452-21453, 21456-21458, 21460, 21463-21467, 21470-21471, 21476, 21480-21484, 21486-21490, 21494, 21496-21499, 21501-21504, 21506-21509, 21511, 21520-21521, 21525, 21528, 21535-21537, 21540, 21542-21543, 21546-21547, 21550-21553, 21555-21556, 21558, 21560, 21563, 21570-21574, 21579, 21581, 21584, 21589, 21591-21593, 21596-21598, 21606, 21613-21614, 21616-21622, 21624, 21633-21639, 21642-21649, 21654-21655, 21658-21660, 21664, 21666, 21669, 21671, 21675-21678, 21680-21681, 21683-21684, 21686, 21688-21694, 21697, 21699-21710, 21714-21715, 21721-21726, 21728, 21730-21738, 21744, 21746-21750, 21756, 21758, 21761-21767, 21769-21771, 21773-21774, 21780-21784, 21786-21787, 21790, 21793, 21798-21800, 21803-21804, 21806, 21808-21810, 21815-21817, 21821, 21823, 21825, 21827-21828, 21831, 21833-21834, 21836-21839, 21845, 21847-21850, 21853, 21858, 21860, 21863, 21866-21870, 21876-21882, 21884, 21886-21887, 21889, 21892, 21897-21903, 21907, 21912-21913, 21916-21920, 21922-21924, 21927-21928, 21931-21932, 21934-21935, 21937-21938, 21940-21943, 21945-21946, 21949, 21952, 21956-21958, 21961-21962, 21966-21967, 21969, 21975-21977, 21979-21980, 21982-21983, 21986, 21988-21991, 21994, 21998-21999, 22001, 22007, 22009-22016, 22018-22023, 22025-22027, 22030, 22036-22037, 22041, 22046, 22050-22054, 22056-22060, 22062, 22064-22069, 22072-22077, 22082-22085, 22087-22089, 22091-22093, 22096-22098, 22106-22107, 22112-22114, 22117-22121, 22123, 22125-22126, 22128-22129, 22135, 22138-22143, 22145-22146, 22149-22157, 22159, 22162-22164, 22167-22169, 22172-22176, 22178, 22180, 22182-22183, 22186, 22189-22190, 22196, 22199, 22202, 22213-22216, 22219-22232, 22234-22236, 22242, 22244, 22246, 22249-22252, 22254-22263, 22271, 22274-22276, 22279, 22281, 22283-22286, 22290-22292, 22294-22295, 22297, 22299-22301, 22304, 22306, 22308-22310, 22315, 22317, 22319-22326, 22328, 22331, 22338-22340, 22342-22350, 22353-22357, 22359-22360, 22362-22363, 22366-22369, 22375, 22377-22383, 22386-22392, 22399-22404, 22407-22424, 22426-22430, 22432-22435, 22439-22446, 22448-22452, 22454-22461, 22465-22466, 22469-22470, 22472-22473, 22475-22478, 22480, 22482-22489, 22493-22496, 22499-22500, 22502, 22504-22507, 22509, 22511-22513, 22517, 22521-22528, 22530-22537, 22539-22540, 22542, 22545-22546, 22548-22549, 22551-22553, 22555-22557, 22560, 22563-22564, 22567-22568, 22570-22571, 22573, 22575-22576, 22581, 22583, 22585-22587, 22591-22598, 22600-22609, 22611-22619, 22621, 22623, 22625-22626, 22632, 22636-22637, 22639-22642, 22644-22648, 22650-22652, 22654-22655, 22657, 22659, 22661, 22663-22664, 22669, 22672-22673, 22676-22678, 22680-22682, 22684-22688, 22690-22692, 22695-22696, 22699-22704, 22707, 22710-22712, 22714-22717, 22725, 22727, 22729-22730, 22732, 22734-22739, 22741-22745, 22748, 22751-22753, 22756-22757, 22759-22767, 22772, 22774-22779, 22787-22792, 22796, 22798, 22801, 22803-22816, 22818-22819, 22822-22824, 22827-22833, 22835, 22840, 22842, 22844, 22849, 22852-22856, 22858, 22861-22863, 22866, 22868-22874, 22876, 22881, 22884-22887, 22889, 22891, 22894-22895, 22897, 22899-22900, 22902, 22904-22910, 22913-22914, 22920, 22922-22925, 22927, 22929-22932, 22934-22941, 22945, 22948, 22951-22953, 22955, 22957, 22959-22960, 22966-22967, 22971, 22973, 22976-22979, 22981-22983, 22985, 22987, 22991, 22993-22995, 22997-22999, 23002-23003, 23006-23010, 23013-23019, 23021, 23023-23026, 23031-23034, 23039, 23042-23044, 23046, 23050-23051, 23053-23055, 23058-23062, 23064-23066, 23068, 23070, 23075, 23077-23085, 23087-23088, 23090-23098, 23101, 23103-23105, 23108, 23111-23119, 23125-23128, 23130, 23135, 23137-23141, 23144, 23146-23149, 23151-23153, 23159, 23163, 23166, 23169-23171, 23173-23174, 23181-23188, 23190-23192, 23195, 23197-23199, 23201, 23203-23204, 23206-23218, 23221-23223, 23225-23229, 23231-23232, 23238-23239, 23241, 23243-23248, 23252-23253, 23255-23259, 23261, 23263-23264, 23266-23268, 23270-23272, 23274-23275, 23277-23278, 23280-23292, 23294, 23297-23299, 23301, 23305-23309, 23314-23317, 23321, 23327-23330, 23333, 23335, 23337, 23339, 23343-23344, 23348, 23350, 23352-23353, 23363, 23367-23373, 23377-23378, 23383-23391, 23393, 23396, 23399-23400, 23402, 23406, 23408-23417, 23419-23429, 23432, 23435-23436, 23438-23443, 23445-23454, 23457, 23459, 23461-23463, 23465-23468, 23470-23472, 23474-23478, 23480-23483, 23487-23488, 23490-23496, 23498-23503, 23505-23506, 23508, 23510-23513, 23518-23523, 23526-23534, 23537, 23541-23542, 23544-23560, 23563-23565, 23567-23569, 23571-23578, 23580, 23583-23584, 23587-23588, 23590-23592, 23594-23595, 23598, 23600-23605, 23607, 23611-23618, 23620-23625, 23629-23630, 23635, 23637, 23639, 23642, 23644-23650, 23652, 23654-23664, 23672-23674, 23677, 23680-23685, 23687-23688, 23691-23696, 23698-23700, 23702-23705, 23707, 23713-23717, 23719-23721, 23723-23724, 23726-23727, 23729-23733, 23735-23736, 23739-23742, 23744, 23746-23751, 23753-23755, 23757, 23759, 23767-23771, 23773-23774, 23776, 23779-23781, 23785-23787, 23789, 23791-23795, 23798-23802, 23804-23805, 23808-23811, 23814-23815, 23817, 23819-23823, 23831, 23836-23841, 23845, 23847-23851, 23855, 23859, 23861-23862, 23864-23865, 23867-23870, 23872-23873, 23877, 23881-23887, 23890-23892, 23897, 23899-23900, 23902-23904, 23906-23916, 23918, 23925-23926, 23929-23934, 23936-23939, 23941-23944, 23949-23950, 23953-23956, 23959-23962, 23965-23966, 23969-23972, 23974-23977, 23979, 23981, 23983-23984, 23988, 23992-24005, 24007-24008, 24010-24012, 24014-24016, 24018-24025, 24028, 24034, 24037-24038, 24040-24041, 24043, 24045-24046, 24049, 24051, 24053-24054, 24057-24061, 24063-24064, 24072, 24077-24082, 24084-24088, 24090, 24095-24098, 24100-24105, 24109-24112, 24114, 24116-24119, 24121, 24123-24128, 24130-24137, 24139-24141, 24143-24145, 24149-24151, 24153-24156, 24159-24162, 24164, 24167-24168, 24171-24172, 24178-24181, 24184, 24187-24188, 24190-24191, 24193, 24196, 24199-24208, 24210-24211, 24213-24214, 24218-24223, 24226-24233, 24235, 24238-24240, 24242-24243, 24245, 24248, 24250, 24252, 24256, 24258, 24260-24261, 24263-24267, 24269, 24273-24278, 24281-24283, 24289-24290, 24293-24297, 24299-24301, 24303, 24305-24307, 24309-24312, 24315-24320, 24324-24330, 24341-24352, 24355, 24357, 24359-24364, 24366-24367, 24369-24371, 24374, 24376, 24379, 24382-24383, 24388-24392, 24394-24395, 24397-24401, 24404, 24406-24411, 24418-24429, 24431, 24435-24438, 24440, 24442, 24444-24445, 24448, 24450, 24452-24454, 24457-24458, 24461, 24465-24469, 24471-24477, 24479, 24481, 24483, 24486-24487, 24489-24492, 24494, 24496, 24498-24500, 24502-24507, 24511-24513, 24519-24520, 24522, 24525-24527, 24529, 24534-24536, 24538-24540, 24544, 24549, 24551-24552, 24554-24556, 24558, 24560-24563, 24565, 24568-24576, 24578-24582, 24584, 24590, 24592, 24594-24595, 24597, 24600-24604, 24608, 24615-24616, 24618, 24622-24625, 24630, 24632-24633, 24635-24644, 24646, 24649-24659, 24661-24663, 24671, 24674-24676, 24678, 24680, 24682-24683, 24686, 24688, 24690-24693, 24696, 24701, 24704, 24707, 24712-24718, 24720-24726, 24728-24730, 24732, 24738-24739, 24744-24745, 24748-24749, 24751-24755, 24757-24762, 24764-24765, 24768, 24770-24775, 24778, 24780-24781, 24784-24787, 24789, 24791, 24795, 24797, 24801, 24803-24807, 24810-24811, 24814, 24817-24832, 24834, 24836-24840, 24843-24850, 24852, 24855-24861, 24863, 24865-24869, 24872-24877, 24879-24882, 24884-24887, 24891-24892, 24894-24896, 24900-24907, 24910, 24913, 24916-24917, 24924-24929, 24931-24934, 24936, 24938-24939, 24941-24948, 24950-24955, 24962, 24966, 24968-24969, 24973-24974, 24977, 24979, 24982-24983, 24986, 24988-24992, 24995, 24997-25001, 25006, 25008, 25010, 25013-25014, 25020-25023, 25025, 25028-25029, 25031, 25034-25035, 25037, 25040-25043, 25045, 25047-25048, 25051-25054, 25057-25059, 25063, 25065-25068, 25073, 25076, 25079-25080, 25086-25087, 25089-25091, 25093-25095, 25098-25099, 25102-25103, 25105, 25111-25113, 25116-25121, 25124, 25126, 25131-25134, 25136, 25138, 25143, 25146-25147, 25151-25152, 25154, 25156, 25158-25160, 25162-25166, 25169, 25171, 25173, 25175-25177, 25179-25180, 25185-25194, 25197, 25199, 25201-25204, 25206, 25210, 25214, 25218, 25220, 25222, 25224-25227, 25229-25230, 25232-25233, 25235-25238, 25240-25243, 25245-25246, 25249-25254, 25257, 25259-25260, 25265, 25268-25270, 25272-25273, 25275, 25277, 25280-25281, 25283-25285, 25287, 25290, 25292-25294, 25297-25302, 25304-25307, 25309-25310, 25313, 25315-25317, 25319-25322, 25324-25326, 25330-25331, 25336, 25338-25342, 25344, 25347-25349, 25353-25355, 25359, 25364-25366, 25371-25372, 25374-25381, 25383-25388, 25391-25392, 25394-25396, 25398-25402, 25405-25406, 25409-25410, 25413-25414, 25416-25419, 25421-25425, 25428-25430, 25432-25433, 25436, 25438, 25440-25447, 25449-25452, 25454, 25456-25459, 25461-25463, 25467-25468, 25471-25477, 25479-25489, 25491-25492, 25494, 25496, 25498, 25502-25503, 25507, 25509-25510, 25512-25516, 25521-25522, 25524-25525, 25528-25532, 25534-25539, 25541-25542, 25545-25546, 25548-25550, 25553-25554, 25556, 25558-25564, 25568-25575, 25577-25578, 25580-25581, 25584-25585, 25587, 25590-25591, 25595, 25597-25600, 25602-25603, 25606-25607, 25609-25610, 25612-25613, 25616-25617, 25620, 25622-25624, 25626-25628, 25631-25638, 25640-25650, 25652-25654, 25656-25657, 25660, 25664-25666, 25668, 25670-25680, 25683-25688, 25691-25701, 25703, 25705-25718, 25720-25721, 25723, 25725, 25728-25729, 25731-25733, 25735-25736, 25738, 25741, 25745-25746, 25750, 25755, 25757, 25759-25760, 25762-25764, 25769-25770, 25774, 25776-25777, 25779, 25781, 25783-25787, 25794-25795, 25799, 25806, 25809-25810, 25813-25814, 25817, 25826, 25829-25830, 25833-25838, 25840, 25842, 25845-25851, 25853, 25858, 25860-25865, 25867-25868, 25871-25873, 25875-25876, 25878, 25882-25890, 25892-25894, 25897-25902, 25904-25908, 25910, 25912-25913, 25915-25918, 25921, 25923, 25925, 25927, 25929, 25931-25932, 25937, 25939-25941, 25943-25945, 25950, 25952-25955, 25962-25968, 25970-25972, 25974, 25978, 25981, 25983-25986, 25989, 25991, 25995-25998, 26001, 26003, 26005-26011, 26013-26014, 26019-26022, 26024, 26028-26030, 26032-26035, 26037-26038, 26041, 26044, 26046-26049, 26051, 26054-26055, 26059, 26061-26064, 26069, 26074, 26077-26080, 26082, 26086, 26089-26096, 26098, 26100-26102, 26104-26108, 26110-26112, 26117-26119, 26121, 26125-26127, 26129-26132, 26136, 26138-26145, 26147, 26149, 26151-26156, 26158, 26160, 26162-26163, 26166-26167, 26169, 26172-26175, 26179-26185, 26187-26189, 26191, 26194, 26199-26200, 26204, 26207-26211, 26219, 26221, 26223-26225, 26228-26232, 26234-26237, 26240-26241, 26243-26246, 26248, 26255, 26258-26260, 26262, 26264-26265, 26267, 26271, 26273-26277, 26279-26283, 26286-26294, 26296, 26298-26300, 26303, 26306-26311, 26313, 26315-26323, 26329-26334, 26337-26338, 26342, 26345-26348, 26351, 26353-26355, 26358, 26360-26363, 26365-26371, 26373, 26375, 26378-26380, 26383-26388, 26390, 26392, 26394-26396, 26398-26401, 26403-26406, 26411-26419, 26423, 26425, 26428, 26430, 26434, 26436-26441, 26443-26444, 26450, 26454, 26456, 26459-26462, 26465-26466, 26468, 26470-26471, 26474-26476, 26480-26481, 26483, 26486, 26488-26490, 26492-26494, 26498-26507, 26509-26511, 26514, 26516, 26520, 26526-26528, 26530-26532, 26534, 26536, 26539-26540, 26543-26545, 26547, 26549, 26551, 26554, 26556-26557, 26560-26562, 26564-26566, 26568-26573, 26576-26580, 26582-26583, 26587, 26590, 26593, 26595, 26600-26602, 26606, 26610, 26614, 26617-26618, 26626, 26629, 26631-26633, 26635-26636, 26639, 26641, 26643, 26646, 26648-26650, 26652-26653, 26655-26659, 26662-26666, 26672-26673, 26675-26676, 26678-26682, 26685-26686, 26688-26690, 26692, 26694-26696, 26698, 26700, 26702, 26704-26706, 26710, 26714, 26718-26719, 26721, 26727-26734, 26738, 26740, 26745, 26749, 26754-26755, 26757, 26760-26761, 26763-26764, 26766, 26768-26769, 26775-26783, 26786-26787, 26789-26790, 26792-26794, 26796, 26802-26803, 26805-26806, 26809-26815, 26824-26834, 26836, 26838, 26840-26841, 26848-26850, 26852-26853, 26858, 26861-26863, 26866-26867, 26873, 26875-26876, 26878-26882, 26884-26885, 26887-26897, 26899-26902, 26904, 26906, 26908, 26911-26912, 26914-26915, 26917, 26922-26924, 26926-26927, 26930-26931, 26934-26940, 26942, 26944, 26946-26948, 26950, 26954-26955, 26959, 26961, 26963-26964, 26966, 26971, 26975-26977, 26979, 26981-26987, 26990, 26992, 26994-26997, 27006-27007, 27011, 27013-27016, 27019-27021, 27029-27030, 27032-27035, 27037-27038, 27040-27045, 27047, 27050-27054, 27056-27057, 27061-27066, 27069, 27076, 27078, 27080-27083, 27085, 27087-27089, 27091, 27093, 27096-27097, 27099-27101, 27104-27110, 27114-27115, 27118, 27122, 27124-27125, 27128-27129, 27132, 27136, 27138-27142, 27144, 27146-27148, 27150-27152, 27154-27158, 27160-27165, 27167-27168, 27171-27173, 27175-27177, 27179-27181, 27184-27185, 27187-27189, 27193, 27196-27200, 27202-27206, 27208, 27211-27212, 27214-27215, 27218-27220, 27222, 27224-27225, 27228, 27230, 27234, 27237, 27242-27243, 27246-27247, 27249, 27251-27253, 27255, 27263-27264, 27266, 27268-27270, 27272-27276, 27278, 27280, 27282-27285, 27287, 27289, 27294, 27296-27301, 27304, 27306-27310, 27316-27317, 27319-27322, 27324, 27328, 27330, 27334, 27337, 27340-27342, 27344-27349, 27351, 27353-27358, 27362, 27366-27368, 27372, 27375-27376, 27378-27382, 27384, 27388-27390, 27392-27393, 27395, 27397-27400, 27403, 27405, 27407-27410, 27412-27414, 27417-27421, 27424, 27426, 27430-27434, 27437-27438, 27441-27445, 27447-27448, 27450-27451, 27454-27458, 27461-27463, 27465, 27468-27470, 27472-27477, 27479-27480, 27483, 27488-27492, 27494-27500, 27502, 27504, 27508, 27510, 27513-27516, 27518-27519, 27521, 27527-27528, 27530-27531, 27537-27539, 27545, 27547-27549, 27552-27554, 27556-27557, 27559-27561, 27565-27567, 27569-27570, 27572, 27575-27580, 27583, 27586, 27588, 27590-27595, 27598-27607, 27609-27625, 27628-27630, 27634, 27637, 27639, 27642, 27646-27648, 27651-27653, 27656-27659, 27665, 27667-27669, 27671-27673, 27675-27679, 27682-27683, 27685, 27687-27692, 27694-27696, 27698, 27701, 27703, 27705, 27710-27717, 27719-27720, 27723-27727, 27733, 27735-27736, 27740-27752, 27756, 27759-27765, 27767-27769, 27771-27774, 27776-27784, 27786-27793, 27795, 27797, 27801-27803, 27806-27807, 27809-27811, 27814-27815, 27821, 27824, 27827, 27829, 27831-27832, 27834-27835, 27838-27839, 27841-27855, 27858-27859, 27861-27862, 27867-27871, 27874-27878, 27881-27882, 27884-27886, 27888-27895, 27897-27900, 27903-27910, 27912-27916, 27918-27919, 27921-27922, 27924, 27927, 27929, 27931-27933, 27935, 27937-27941, 27943, 27945, 27947-27955, 27957-27958, 27960, 27963, 27965, 27967, 27969-27970, 27974-27977, 27979, 27981, 27984, 27991-27993, 27997-27999, 28001, 28008-28010, 28012, 28016, 28021, 28028, 28030-28033, 28035-28037, 28039, 28043, 28045, 28049-28050, 28058-28061, 28063, 28065, 28068, 28071-28073, 28078, 28080-28082, 28084-28085, 28087, 28089-28092, 28094, 28097-28100, 28110-28116, 28118-28121, 28123-28125, 28127-28129, 28132, 28134-28136, 28138-28141, 28143, 28147-28148, 28156-28157, 28161-28162, 28164-28169, 28173, 28178, 28180-28185, 28187, 28189-28190, 28192, 28198-28199, 28203, 28206, 28208-28209, 28212, 28215-28217, 28220, 28224, 28231, 28233-28239, 28242, 28245-28246, 28248, 28253, 28256, 28260-28263, 28266, 28269, 28274, 28277-28281, 28283, 28285-28287, 28291, 28293, 28295, 28297, 28299-28302, 28305-28307, 28309, 28311-28313, 28316, 28319, 28321, 28323, 28325, 28329-28331, 28334, 28336, 28338, 28340, 28342, 28344, 28349, 28351-28352, 28359, 28361-28362, 28365, 28367, 28370-28372, 28375, 28377, 28380-28382, 28384, 28386, 28388-28392, 28394, 28396, 28400, 28404-28408, 28411-28413, 28417-28421, 28423, 28427-28433, 28439-28447, 28452, 28454-28458, 28461-28464, 28466-28469, 28475-28481, 28484-28485, 28487-28489, 28491-28498, 28500-28501, 28504, 28507-28513, 28515-28516, 28523-28527, 28530, 28534-28539, 28541-28551, 28553-28558, 28560-28562, 28565-28567, 28570, 28573-28574, 28576, 28578-28581, 28584-28585, 28587-28593, 28595-28597, 28599-28600, 28603, 28606, 28608-28613, 28616-28619, 28621-28623, 28630-28633, 28635-28638, 28640-28643, 28646-28656, 28660, 28662, 28669, 28671-28672, 28674-28675, 28677, 28680, 28682-28684, 28686-28687, 28689, 28691-28695, 28697-28698, 28700, 28702-28708, 28710, 28712-28714, 28716-28717, 28719, 28722-28726, 28728-28729, 28731, 28733-28734, 28736-28740, 28742-28743, 28745, 28747-28748, 28750, 28752, 28754, 28758-28760, 28762, 28766, 28772-28774, 28778, 28782, 28785-28786, 28789-28790, 28792-28793, 28796-28800, 28803-28804, 28806-28807, 28809, 28815-28818, 28820, 28822, 28826, 28828-28831, 28833, 28835, 28838-28841, 28844-28845, 28847, 28849-28850, 28853-28854, 28856-28860, 28865, 28867, 28869-28875, 28878-28879, 28882-28883, 28886-28888, 28890, 28892-28895, 28897, 28900, 28902, 28905, 28907-28912, 28915-28916, 28918-28921, 28923, 28926-28929, 28939, 28941-28942, 28944-28952, 28955-28956, 28958-28962, 28964-28968, 28970-28971, 28973-28981, 28983, 28985-28987, 28989-28991, 28993-29001, 29004-29007, 29009-29010, 29013, 29016-29023, 29025, 29027-29034, 29036-29042, 29044-29049, 29051-29052, 29054-29055, 29057, 29059, 29062, 29064-29065, 29067, 29069, 29071-29072, 29075-29076, 29080-29081, 29083-29084, 29087-29099, 29101-29102, 29104-29111, 29117, 29120-29125, 29127-29128, 29131, 29135, 29137-29144, 29147-29148, 29150, 29152, 29154, 29156, 29158-29163, 29165-29171, 29173, 29177, 29179-29180, 29182-29187, 29190, 29192-29194, 29197-29198, 29200, 29203, 29205, 29207-29208, 29212-29217, 29220-29225, 29227, 29229-29233, 29235-29236, 29238-29239, 29241-29242, 29244-29245, 29248-29249, 29251-29261, 29264, 29267, 29269-29270, 29273-29277, 29279, 29282, 29285-29289, 29291, 29293, 29296, 29298-29300, 29302-29309, 29313, 29315-29319, 29325, 29327-29328, 29330-29333, 29336, 29339-29342, 29347, 29352-29355, 29358-29369, 29372-29379, 29381, 29383-29390, 29392-29401, 29403-29412, 29414-29415, 29417-29420, 29422, 29424-29428, 29430-29432, 29434-29437, 29439-29442, 29444-29447, 29449-29454, 29458-29459, 29462, 29464-29467, 29470-29476, 29478-29479, 29482-29487, 29494, 29496-29497, 29501-29507, 29509, 29511, 29513-29515, 29517-29526, 29529-29535, 29538-29541, 29543-29544, 29546, 29550-29551, 29553, 29555, 29557-29563, 29565-29566, 29569-29576, 29578, 29581-29586, 29598-29603, 29605-29606, 29608, 29610-29611, 29613-29614, 29620, 29623-29625, 29627-29629, 29632, 29634, 29637-29638, 29640-29642, 29644-29645, 29647-29653, 29658-29661, 29663, 29666, 29668, 29670, 29672-29673, 29675, 29680-29681, 29684-29685, 29688, 29690, 29696-29697, 29699, 29710-29711, 29713-29714, 29717-29718, 29720-29721, 29723-29724, 29727-29728, 29734-29736, 29738, 29740-29745, 29747-29750, 29752, 29755-29757, 29759, 29761-29763, 29765-29766, 29768-29778, 29780, 29782-29783, 29785, 29787-29797, 29799-29805, 29813-29815, 29818, 29821-29825, 29827-29832, 29834, 29837-29841, 29843-29849, 29852-29853, 29856-29858, 29860-29862, 29864, 29866-29867, 29870, 29872, 29874-29875, 29878-29879, 29882-29883, 29885-29890, 29892, 29894-29896, 29898-29904, 29906-29909, 29912-29915, 29917, 29919, 29921-29923, 29925-29927, 29929, 29932-29933, 29935-29936, 29939-29940, 29943, 29945, 29947-29950, 29952-29954, 29956-29965, 29968-29969, 29972-29973, 29978-29983, 29985-29987, 29989-29995, 29997-29998, 30000-30001, 30004, 30006, 30008-30010, 30012, 30014-30016, 30018-30025, 30028-30033, 30037, 30039-30040, 30042, 30047-30049, 30051, 30053, 30055-30056, 30058-30060, 30062, 30064, 30068, 30070, 30072-30073, 30075-30076, 30078-30079, 30081-30084, 30086, 30088, 30091-30092, 30095-30104, 30106, 30109, 30111-30115, 30117, 30120-30122, 30124, 30126, 30128-30130, 30134-30137, 30139, 30142-30148, 30151, 30154, 30157, 30159-30163, 30165-30171, 30174-30176, 30178, 30181-30188, 30190-30197, 30199, 30202-30203, 30207-30211, 30214-30217, 30224, 30227, 30229-30231, 30233-30255, 30257-30259, 30261-30262, 30264-30266, 30268-30279, 30281, 30285, 30290-30298, 30300-30309, 30311-30312, 30314-30315, 30318-30319, 30322-30324, 30327-30329, 30331, 30334, 30336-30343, 30345-30346, 30348-30351, 30353-30358, 30360-30363, 30367-30368, 30371, 30373-30381, 30384, 30388-30392, 30394-30395, 30400-30404, 30408-30409, 30412, 30414, 30416-30417, 30420-30422, 30425, 30427-30428, 30432-30433, 30436, 30438, 30442, 30444-30448, 30450, 30455, 30462-30468, 30470, 30477-30478, 30480, 30485-30490, 30493-30494, 30496-30499, 30501-30502, 30504-30506, 30508, 30510-30512, 30514-30518, 30520, 30522-30524, 30527, 30529-30530, 30533-30537, 30540-30541, 30543-30545, 30548-30550, 30552-30557, 30559-30560, 30564, 30568-30569, 30571-30572, 30574, 30578-30582, 30587, 30589-30590, 30592-30608, 30610-30612, 30614, 30618-30621, 30624, 30629-30630, 30634-30636, 30640, 30642-30644, 30646, 30648-30649, 30651, 30653-30658, 30660, 30665, 30668, 30670-30674, 30679, 30682, 30684-30695, 30697-30698, 30700-30704, 30706-30709, 30711-30714, 30718, 30720, 30722, 30724-30725, 30728-30734, 30737, 30739-30742, 30744, 30746-30751, 30755, 30757-30760, 30765, 30768-30770, 30774, 30778, 30780-30788, 30791-30792, 30794-30800, 30802, 30804-30808, 30812, 30814-30816, 30820-30823, 30826, 30828-30830, 30832-30833, 30836, 30839-30845, 30847-30849, 30851-30853, 30855, 30858, 30860, 30862-30866, 30869-30871, 30873-30877, 30879, 30884-30885, 30887-30888, 30890-30895, 30897, 30902-30908, 30910, 30912, 30917, 30919, 30921-30922, 30926, 30930-30938, 30941-30945, 30947, 30949, 30951-30952, 30954, 30956-30958, 30960-30961, 30964-30974, 30979-30987, 30990-30993, 30998, 31000-31006, 31008-31009, 31011, 31013, 31015-31021, 31023, 31027-31035, 31038, 31040, 31042-31046, 31048-31053, 31055, 31057, 31061-

31066, 31068, 31070-31072, 31075-31082, 31090-31091, 31093, 31095-31097, 31099-31107, 31109-31119, 31121-31125, 31129-31133, 31139-31140, 31142-31143, 31146-31147, 31149-31152, 31155, 31157-31160, 31162, 31164-31167, 31169, 31171-31174, 31177-31186, 31188, 31190, 31192, 31194-31198, 31200-31203, 31206, 31209-31215, 31218, 31221, 31224-31229, 31231, 31233, 31236-31237, 31239, 31241-31254, 31256-31259, 31262, 31264, 31266, 31268-31272, 31275, 31278-31279, 31281, 31286-31287, 31291, 31295, 31298-31303, 31305, 31309-31313, 31315, 31317-31318, 31323-31327, 31329, 31331-31332, 31334-31335, 31337-31345, 31348-31352, 31355-31359, 31361, 31363-31364, 31366, 31370-31376, 31379, 31382, 31384-31387, 31389-31395, 31398-31402, 31404-31405, 31408-31410, 31413-31415, 31419, 31423, 31425-31428, 31431-31433, 31435-31437, 31441, 31444, 31446-31447, 31450, 31452-31453, 31455-31458, 31460-31465, 31467, 31469-31471, 31473-31474, 31476, 31478-31483, 31486-31487, 31491-31493, 31495-31497, 31499, 31501, 31503, 31505, 31507-31509, 31511, 31513, 31515-31520, 31522-31523, 31526, 31528, 31530-31532, 31534, 31542, 31545-31549, 31551-31554, 31556, 31558-31559, 31561-31562, 31564-31570, 31573-31577, 31579, 31582, 31584, 31586-31587, 31590-31598, 31602, 31606-31613, 31616-31617, 31619-31621, 31623-31626, 31634-31635, 31638-31639, 31643-31644, 31646-31648, 31650, 31652-31653, 31655-31660, 31662, 31664, 31666, 31668, 31676-31683, 31685-31686, 31688-31689, 31691-31692, 31698, 31700-31707, 31709-31710, 31712-31715, 31717-31718, 31723, 31725, 31727, 31731-31733, 31743-31747, 31753-31757, 31759-31761, 31769, 31771-31778, 31781-31782, 31784-31785, 31787-31788, 31791-31793, 31795-31797, 31800, 31804, 31806-31808, 31810, 31813, 31816-31818, 31820-31825, 31829-31831, 31833-31835, 31837-31839, 31843, 31847-31848, 31852-31853, 31855-31864, 31866-31872, 31874-31881, 31885-31886, 31889-31902, 31904-31905, 31907-31908, 31911, 31913-31916, 31918, 31920-31931, 31933, 31935-31940, 31944-31945, 31947, 31950, 31952-31959, 31961-31963, 31965, 31969-31971, 31974-31976, 31978, 31980-31981, 31983-31984, 31987-31988, 31990-31992, 31995-31997, 31999-32001, 32003-32004, 32007-32008, 32010-32014, 32016, 32018-32020, 32023, 32026, 32030-32032, 32034, 32036, 32040-32042, 32045, 32047, 32049-32052, 32056, 32059, 32062-32066, 32068-32070, 32074-32079, 32082, 32085, 32089-32091, 32093-32094, 32096-32097, 32099-32110, 32112-32116, 32119, 32121, 32124, 32126-32135, 32137, 32140-32144, 32148, 32154-32166, 32172-32174, 32176-32181, 32184-32188, 32190-32192, 32194-32197, 32199, 32201-32202, 32204-32207, 32209-32210, 32212-32216, 32218, 32221-32225, 32228, 32232-32238, 32241-32242, 32246-32247, 32249, 32251-32253, 32255, 32257, 32260-32265, 32268, 32270-32283, 32285-32286, 32288-32291, 32293, 32295-32299, 32303, 32305-32306, 32308-32310, 32312-32319, 32321-32325, 32327-32330, 32332-32334, 32337-32343, 32347-32348, 32350, 32353-32354, 32356-32358, 32360, 32363, 32366-32369, 32372-32375, 32377-32379, 32381, 32383-32386, 32389-32392, 32394-32403, 32405, 32407, 32409-32422, 32429-32430, 32432, 32434-32438, 32440, 32442-32443, 32447-32448, 32450, 32452-32462, 32464, 32467-32470, 32472, 32474-32475, 32477, 32479-32485, 32489-32490, 32492, 32495, 32498-32499, 32501-32502, 32504-32513, 32515-32517, 32519-32520, 32523, 32527-32532, 32535-32538, 32540-32548, 32552, 32554-32557, 32559, 32561, 32565-32567, 32570-32571, 32574-32576, 32579, 32583, 32585, 32590, 32593-32596, 32598, 32605, 32608-32609, 32611, 32613-32614, 32616-32620, 32622, 32627, 32629-32638, 32640-32643, 32645-32646, 32648, 32650, 32652-32655, 32658, 32661-32663, 32666-32669, 32672, 32677-32683, 32686, 32689, 32691-32696, 32700-32701, 32703-32713, 32716, 32719-32720, 32723-32727, 32729, 32731-32732, 32734, 32737-32738, 32740, 32742-32744, 32748, 32750, 32752, 32754, 32758-32759, 32761-32764, 32766, 32769-32772, 32774-32776, 32781-32786, 32790, 32792-32796, 32799, 32802, 32809, 32811, 32814-32817, 32819, 32821, 32823, 32825-32826, 32829-32832, 32834, 32836, 32838, 32840-32846, 32848-32853, 32855, 32857-32859, 32863, 32866, 32869-32871, 32873-32877, 32880, 32882, 32884, 32886-32887, 32889, 32891-32897, 32899-32907, 32909-32910, 32913-32919, 32921-32923, 32925-32927, 32929-32930, 32932, 32934-32938, 32940-32941, 32943, 32945-32947, 32950-32951, 32953-32954, 32957-32958, 32963-32969, 32971-32972, 32974-32976, 32978, 32981-32982, 32988-32989, 32991-32993, 32995, 32998-32999, 33002, 33004, 33007-33008, 33011-33013, 33015-33016, 33019, 33021, 33023, 33029, 33033-33034, 33044, 33046, 33050-33051, 33054-33056, 33058-33059, 33061-33064, 33066-33068, 33070-33078, 33080, 33082-33084, 33086, 33088-33090, 33092, 33095-33096, 33102-33103, 33105-33106, 33109, 33111-33112, 33114, 33120-33121, 33123-33124, 33126-33130, 33132-33138, 33141, 33143-33145, 33147-33149, 33151, 33153-33155, 33158-33161, 33166-33169, 33171, 33174, 33176, 33179, 33183, 33186, 33188-33189, 33192-33195, 33197, 33199, 33201, 33204-33208, 33210, 33212-33217, 33219, 33222-33224, 33226-33227, 33229-33233, 33236-33243, 33245-33250, 33252-33254, 33256, 33258-33260, 33262, 33264, 33266-33267, 33269, 33272-33276, 33278-33279, 33281, 33286-33287, 33289-33290, 33293, 33295-33297, 33299, 33302-33304, 33307-33308, 33310-33311, 33313, 33318-33319, 33321-33322, 33325-33327, 33329, 33331, 33333, 33335, 33337-33338, 33341, 33343-33347, 33350-33353, 33355-33358, 33360, 33364-33372, 33374-33375, 33377-33379, 33382-33386, 33388-33389, 33391-33400, 33403-33404, 33407, 33410, 33412-33416, 33418-33420, 33422-33423, 33425, 33427-33429, 33431-33433, 33435-33437, 33440-33441, 33443-33446, 33448, 33452, 33454-33455, 33458, 33460-33461, 33464-33467, 33470, 33472-33473, 33476, 33480-33481, 33483-33486, 33488-33494, 33496-33498, 33500, 33503-33507, 33509-33516, 33522-33523, 33525-33526, 33530, 33533-33534, 33539-33544, 33547, 33549, 33551-33555, 33557, 33559, 33561-33563, 33566-33570, 33572, 33574-33577, 33579, 33581, 33584-33588, 33591, 33593-33596, 33599, 33602-33606, 33608, 33610, 33612-33614, 33617, 33620, 33628, 33630, 33632, 33634-33643, 33647-33654, 33656, 33658-33659, 33662, 33664-33666, 33669-33672, 33675-33679, 33682-33687, 33689-33692, 33694, 33696, 33698-33700, 33705-33710, 33712-33714, 33717, 33719, 33722-33724, 33727-33728, 33730, 33732-33736, 33740-33742, 33744-33749, 33751, 33753-33757, 33759, 33761, 33764-33767, 33770, 33774, 33777-33778, 33780-33782, 33784, 33786-33789, 33793-33794, 33796-33799, 33802-33806, 33808-33813, 33816-33817, 33819-33823, 33826, 33828-33838, 33841-33845, 33847-33850, 33852-33867, 33869-33870, 33874, 33876-33882, 33887-33890, 33892, 33894-33897, 33899, 33901-33903, 33905, 33908-33910, 33913, 33918-33926, 33929-33931, 33933-33934, 33936-33938, 33940-33941, 33943, 33945-33947, 33949-33955, 33957-33960, 33962-33966, 33968-33970, 33973, 33975-33980, 33982, 33984, 33986, 33988, 33990, 33992-33998, 34000-34002, 34004, 34007-34008, 34010, 34013, 34019-34021, 34023, 34028-34030, 34032-34034, 34041-34043, 34045, 34048-34049, 34053-34054, 34056, 34060-34061, 34065, 34067-34072, 34079, 34081, 34083-34084, 34087-34092, 34094, 34096-34097, 34099-34100, 34102-34103, 34106, 34108-34110, 34114-34116, 34118-34122, 34124-34125, 34129-34130, 34132, 34135-34139, 34141-34145, 34147, 34149-34151, 34153-34155, 34157, 34161-34163, 34165-34167, 34169, 34171, 34174, 34177-34181, 34185-34190, 34192, 34194-34198, 34200, 34203-34204, 34207-34208, 34210-34223, 34227-34228, 34231-34235, 34238-34242, 34244, 34246, 34248, 34250, 34252-34255, 34257-34262, 34264-34265, 34270, 34275-34279, 34281-34282, 34284, 34286, 34288, 34290, 34292-34293, 34297, 34299-34301, 34304-34306, 34310-34311, 34320-34327, 34330, 34337-34344, 34346-34351, 34353-34355, 34358, 34360-34363, 34365-34366, 34370, 34372-34373, 34375-34378, 34380-34388, 34392-34396, 34398, 34401-34404, 34406-34407, 34409, 34411-34416, 34420-34422, 34425-34429, 34431-34433, 34435-34440, 34442-34443, 34445-34447, 34449-34456, 34458-34462, 34465-34470, 34472-34473, 34477, 34480, 34484-34488, 34494-34499, 34503, 34506-34507, 34510-34511, 34514-34518, 34520-34521, 34525-34528, 34531-34532, 34534, 34537-34539, 34543-34546, 34549-34550, 34552-34553, 34555-34557, 34559-34564, 34566-34570, 34572-34573, 34575, 34578, 34582-34587, 34589-34590, 34596-34598, 34600-34614, 34616-34619, 34621-34623, 34626-34627, 34633-34635, 34637-34639, 34643-34651, 34653, 34655-34656, 34659-34661, 34663-34667, 34670-34675, 34679-34684, 34686-34687, 34689-34697, 34699, 34701, 34704-34706, 34708, 34710, 34712-34713, 34715, 34717-34718, 34720, 34722-34725, 34727, 34731, 34734-34736, 34738-34739, 34741, 34743-34748, 34756, 34758, 34765-34767, 34769, 34776-34777, 34779-34784, 34786, 34789-34791, 34793-34796, 34799-34803, 34805, 34808, 34811-34812, 34815-34820, 34822, 34824, 34827-34832, 34835-34840, 34842, 34845-34846, 34848-34849, 34852, 34854-34856, 34858-34863, 34865, 34867, 34869-34871, 34873-34875, 34877, 34879-34882, 34885-34886, 34888-34889, 34891-34898, 34900-34904, 34906-34909, 34915-34917, 34919, 34921-34922, 34925-34928, 34931-34933, 34935-34936, 34938, 34941-34944, 34946-34947, 34949, 34951-34956, 34959-34961, 34963-34964, 34966-34968, 34970-34973, 34975-34981, 34986, 34988-35005, 35007-35010, 35013-35025, 35027-35031, 35034-35036, 35039-35040, 35042-35047, 35049-35055, 35058-35060, 35062, 35064-35067, 35069, 35073, 35075-35080, 35084-35087, 35092, 35094-35097, 35099, 35102-35108, 35110-35112, 35115-35122, 35124, 35126-35139, 35142, 35146-35149, 35151, 35153-35154, 35158, 35160, 35162-35166, 35170, 35172-35174, 35177, 35180-35185, 35187-35188, 35190-35191, 35193-35194, 35197-35199, 35203-35213, 35215-35216, 35219-35222, 35224-35225, 35227-35228, 35230, 35232-35235, 35241, 35244, 35246-35247, 35249-35252, 35254, 35257, 35259-35265, 35269-35271, 35273, 35275-35276, 35279-35280, 35282, 35284-35285, 35287, 35289-35292, 35294-35295, 35298-35299, 35301-35303, 35306-35308, 35310, 35314, 35316-35322, 35324-35325, 35328-35332, 35334-35341, 35343, 35345-35347, 35349-35352, 35354-35357, 35359-35360, 35362, 35364-35365, 35368-35372, 35374, 35376-35380, 35383-35386, 35388-35401, 35403-35404, 35406-35411, 35413-35414, 35416-35418, 35420, 35422-35425, 35427, 35430, 35433-35434, 35438-35439, 35442-35443, 35446-35447, 35451, 35453-35457, 35460-35462, 35464, 35467-35468, 35471, 35473, 35476, 35480-35481, 35484-35486, 35496-35497, 35499-35501, 35503, 35505, 35507, 35509-35511, 35513-35522, 35526, 35528-35538, 35541-35544, 35547, 35549, 35552, 35554-35555, 35558, 35561-35564, 35567-35568, 35575-35578, 35580, 35582-35586, 35589-35590, 35592-35595, 35597, 35599-35601, 35603-35604, 35606, 35608-35614, 35618-35619, 35622, 35624-35626, 35631, 35635-35638, 35640-35646, 35648, 35652-35653, 35655, 35658-35661, 35663-35680, 35682, 35684, 35687-35692, 35694-35700, 35702, 35704-35706, 35708-35709, 35711-35713, 35717, 35719-35720, 35722-35723, 35728-35729, 35731-35734, 35737-35739, 35742-35748, 35752, 35754-35758, 35760-35768, 35771, 35773-35776, 35778-35780, 35782-35783, 35785-35786, 35794-35796, 35798-35801, 35803-35805, 35807, 35809-35812, 35814-35816, 35819-35820, 35822-35823, 35825-35829, 35832-35833, 35841-35843, 35845-35850, 35855, 35857, 35859, 35861-35863, 35866-35868, 35870, 35872, 35874, 35884, 35886-35887, 35889, 35892-35899, 35902-35904, 35906-35913, 35915, 35918, 35920-35929, 35931-35936, 35938-35943, 35945, 35947-35954, 35959, 35961, 35963, 35967-35968, 35971-35974, 35977-35980, 35982, 35984-35985, 35988-35991, 35993-35997, 36002-36009, 36011, 36014, 36016-36023, 36025-36028, 36031, 36033, 36035, 36038-36040, 36042-36043, 36046, 36050, 36052-36054, 36057-36058, 36060-36061, 36063-36064, 36068-36074, 36076-36083, 36085-36089, 36092, 36095, 36097-36101, 36105-36108, 36112, 36114-36129, 36131, 36133-36136, 36142-36149, 36151, 36153-36155, 36157-36161, 36164-36166, 36169, 36171-36173, 36175-36177, 36179-36180, 36182, 36184, 36186-36187, 36189-36190, 36193, 36195, 36198-36200, 36202, 36205, 36207-36210, 36213-36214, 36216-36221, 36224-36225, 36227-36228, 36230-36238, 36241-36242, 36244-36245, 36247, 36249-36257, 36259-36260, 36262-36264, 36266, 36268, 36271-36273, 36276, 36278-36281, 36283, 36286-36287, 36289, 36291, 36294-36299, 36301-36302, 36305, 36307-36309, 36311-36314, 36316, 36318-36320, 36323-36328, 36330-36331, 36333-36340, 36342-36343, 36345, 36347, 36349, 36351-36352, 36358-36361, 36364, 36366, 36370-36374, 36377, 36381-36387, 36389-36391, 36394-36395, 36397-36402, 36404-36408, 36411-36417, 36419-36420, 36422-36426, 36429-36432, 36434-36435, 36437, 36439-36441, 36443-36446, 36449-36466, 36475-36478, 36480-36482, 36486, 36490, 36492-36494, 36500-36501, 36503-36506, 36508-36509, 36511-36514, 36517, 36520-36523, 36525-36527, 36529, 36531-36532, 36536-36544, 36546-36548, 36551-36556, 36558-36562, 36564-36565, 36568, 36571-36572, 36574, 36576, 36578, 36580-36581, 36583, 36586-36589, 36594-36595, 36597, 36601, 36603, 36606, 36615-36618, 36623, 36626-36629, 36631-36633, 36637, 36639, 36641, 36643-36649, 36651, 36656-36658, 36661, 36663-36669, 36671-36674, 36676, 36678, 36682, 36685, 36694, 36697-36698, 36702-36709, 36718-36719, 36721-36727, 36729, 36731, 36733, 36735-36736, 36738-36739, 36741, 36743-36746, 36749-36751, 36753, 36757, 36759-36761, 36765-36766, 36768, 36771-36776, 36778, 36780-36783, 36785, 36787, 36790, 36799, 36802, 36804-36831, 36836-36840, 36845-36853, 36856-36858, 36860, 36862, 36864, 36869-36871, 36873, 36876, 36878, 36880-36890, 36892-36895, 36898-36901, 36903-36904, 36906-36908, 36910-36911, 36913-36920, 36923-36927, 36929-36932, 36934-36936, 36939-36941, 36943, 36945, 36948-36952, 36954-36958, 36961-36964, 36971, 36974-36975, 36977, 36979, 36983-37004, 37009-37014, 37016, 37018-37020, 37023, 37025, 37027-37033, 37035-37036, 37038-37039, 37041-37042, 37045, 37047, 37049-37056, 37058-37060, 37064-37065, 37067-37074, 37077-37078, 37081-37082, 37084-37091, 37093-37095, 37098-37101, 37104, 37106-37108, 37110, 37113-37116, 37118-37121, 37123-37125, 37127, 37129-37130, 37132, 37134, 37136-37152, 37156, 37158-37163, 37165-37167, 37169-37170, 37173-37176, 37179-37181, 37183-37184, 37187, 37190-37195, 37197-37204, 37206-37207, 37209-37210, 37212-37214, 37216-37223, 37225-37228, 37231-37233, 37236-37237, 37240-37249, 37251, 37254-37258, 37260-37262, 37264-37265, 37267, 37269, 37271-37274, 37276-37278, 37284-37285, 37287, 37289-37290, 37293, 37295, 37297, 37299-37300, 37302-37303, 37305, 37309, 37311, 37313-37315, 37317, 37319, 37322-37326, 37328-37333, 37335, 37337-37340, 37342-37344, 37346-37350, 37352, 37354, 37358, 37367-37377, 37379-37382, 37384-37385, 37389, 37391, 37393-37394, 37403-37404, 37406-37407, 37409-37416, 37418-37421, 37426-37428, 37432-37434, 37436, 37439-37442, 37444, 37447-37450, 37452-37454, 37456-37462, 37464-37467, 37469, 37471-37472, 37475, 37481-37482, 37488-37489, 37492-37494, 37496, 37498-37501, 37504-37507, 37510-37513, 37515-37521, 37523-37524, 37528, 37532-37534, 37538-37539, 37541-37549, 37551-37552, 37554-37562, 37564, 37566, 37568-37569, 37571-37572, 37576, 37581, 37586, 37588-37590, 37597-37598, 37600-37605, 37610-37616, 37618-37621, 37624-37627, 37631, 37634, 37636-37643, 37646-37647, 37649-37650, 37653-37654, 37657-37660, 37663-37664, 37666, 37668-37669, 37671-37672, 37674, 37676, 37682-37685, 37689-37690, 37692-37695, 37700-37701, 37703-37704, 37706, 37712, 37715, 37718-37719, 37721-37723, 37725, 37727-37732, 37735, 37740, 37743, 37745, 37747-37749, 37751-37756, 37758-37759, 37771-37773, 37775-37776, 37778-37783, 37785, 37788, 37792-37795, 37799-37804, 37806-37807, 37810, 37815, 37819, 37821-37823, 37825, 37827-37831, 37843-37845, 37848-37855, 37857, 37860-37861, 37866-37868, 37871-37873, 37876-37880, 37882, 37884-37887, 37889-37891, 37894-37896, 37898-37900, 37902, 37904-37906, 37908, 37912-37915, 37918-37919, 37921-37923, 37925-37928, 37930-37936, 37938-37943, 37945-37946, 37948-37949, 37953-37960, 37962, 37964-37965, 37967-37968, 37970-37972, 37974-37979, 37981-37984, 37986-37987, 37990-37996, 38001-38002, 38004-38008, 38010-38011, 38014-38025, 38027-38029, 38031-38032, 38041-38044, 38046, 38049-38051, 38053-38056, 38058-38061, 38066-38069, 38071, 38073-38077, 38080-38081, 38083-38084, 38086-38087, 38089-38091, 38093, 38095-38108, 38110-38115, 38118-38120, 38123-38124, 38126, 38129-38130, 38134-38135, 38138, 38140-38141, 38144-38145, 38148-38152, 38154-38159, 38161, 38163-38174, 38176, 38178, 38180-38182, 38184-38185, 38189, 38191, 38194, 38196-38197, 38199-38201, 38203-38204, 38206-38207, 38209-38213, 38216, 38218-38222, 38227, 38230-38231, 38233-38242, 38244-38245, 38247-38248, 38250-38251, 38253-38256, 38258, 38260-38262, 38264-38266, 38268-38269, 38272, 38274, 38276-38279, 38282, 38285, 38288-38289, 38291, 38297-38299, 38302-38307, 38315-38316, 38318-38320, 38324, 38326-38335, 38337-38339, 38342-38343, 38345-38350, 38353-38357, 38359-38364, 38366-38371, 38377, 38380, 38382-38383, 38387, 38392, 38395-38396, 38399-38401, 38403-38406, 38408, 38412-38413, 38415-38416, 38418-38422, 38424-38425, 38427, 38429-38437, 38439-38440, 38442-38443, 38445-38446, 38448-38450, 38453-38458, 38460, 38463, 38466-38468, 38470-38474, 38476-38478, 38480-38485, 38487-38490, 38493-38496, 38499-38500, 38502-38506, 38508-38509, 38511-38521, 38524-38527, 38530-38533, 38535-38543, 38547, 38550-38551, 38555-38556, 38558, 38560-38561, 38563, 38565-38568, 38570, 38572-38574, 38577, 38580-38582, 38586, 38589, 38593-38594, 38597-38598, 38600-38602, 38605, 38607, 38609-38611, 38613, 38615-38618, 38621-38622, 38624, 38626-38627, 38630-38631, 38633-38634, 38637-38640, 38642, 38644-38646, 38648-38649, 38651-38655, 38657-38658, 38660-38661, 38663, 38665-38669, 38671-38675, 38677-38679, 38682-38686, 38689, 38691, 38694-38695, 38697-38703, 38707-38708, 38710, 38712, 38715-38717, 38721, 38726-38727, 38732, 38739-38742, 38744-38746, 38748-38749, 38752, 38755, 38759, 38763, 38765-38767, 38771-38775, 38778, 38784, 38786-38791, 38794, 38797, 38799-38805, 38807-38809, 38812-38813, 38815, 38818-38819, 38821-38823, 38828-38837, 38844, 38847, 38851-38852, 38854-38857, 38860, 38862-38865, 38867-38868, 38871-38872, 38876-38884, 38886-38887, 38889-38895, 38902, 38904-38905, 38909-38910, 38912, 38914, 38918, 38920, 38923-38928, 38930-38933, 38935-38938, 38940, 38942-38943, 38945-38946, 38948-38950, 38953-38956, 38958, 38960-38964, 38966, 38969-38974, 38980, 38984-38987, 38989-38990, 38994-38995, 38998-39008, 39010-39011, 39013-39014, 39016-39019, 39021, 39023, 39025-39032, 39034-39035, 39037-39038, 39041-39042, 39044-39050, 39052, 39056, 39058-39066, 39068-39075, 39080, 39084, 39086-39087, 39089, 39091-39093, 39095, 39097, 39099, 39101, 39105, 39108-39110, 39113-39114, 39117-39118, 39121-39123, 39126, 39129-39132, 39135, 39137-39142, 39145, 39147-39148, 39151-39153, 39155-39159, 39161-39165, 39167-39169, 39171, 39173-39174, 39176, 39178-39180, 39182-39183, 39185-39186, 39189, 39191-39193, 39195-39196, 39198-39199, 39201-39206, 39208-39216, 39218, 39222, 39226, 39228, 39230, 39232-39236, 39238-39239, 39241-39242, 39247, 39249-39250, 39253, 39259, 39263-39264, 39266-39267, 39270-39273, 39275, 39277-39279, 39281-39282, 39284-39296, 39300-39307, 39310-39314, 39317-39326, 39330-39334, 39336, 39338, 39345-39350, 39352-39353, 39355-39357, 39359-39363, 39367, 39369-39374, 39377-39380, 39382-39388, 39390-39394, 39396-39401, 39403-39404, 39407-39409, 39411-39413, 39415, 39417-39430, 39434-39441, 39443-39447, 39449-39450, 39453, 39456-39457, 39459-39466, 39469-39471, 39473-39475, 39477, 39480-39481, 39483-39488, 39490-39492, 39494-39499, 39501, 39503, 39505-39506, 39508-39510, 39512, 39514-39515, 39517-39524, 39527, 39529, 39532, 39535, 39538, 39540, 39543, 39545-39547, 39549-39551, 39555, 39557, 39559-39564, 39566, 39568-39569, 39574, 39576-39584, 39587-39589, 39592, 39595, 39598, 39600-39606, 39610-39612, 39614-39615, 39617, 39620-39621, 39623, 39627, 39631-39632, 39635-39636, 39638-39640, 39646, 39648-39651, 39653-39655, 39657, 39660-39662, 39665-39666, 39668-39672, 39674, 39676, 39678-39679, 39683-39684, 39687, 39689-39691, 39696-39704, 39706-39707, 39711-39715, 39720-39725, 39727, 39729-39731, 39734, 39736, 39739-39740, 39742, 39744-39745, 39750, 39752, 39755-39757, 39760, 39762-39763, 39765-39766, 39768, 39770-39771, 39775, 39778, 39780, 39787-39790, 39792, 39794, 39797, 39799, 39802-39807, 39809-39816, 39818-39820, 39823, 39826-39827, 39829-39835, 39837, 39839-39846, 39848, 39852, 39855-39856, 39858-39859, 39861-39862, 39864, 39866, 39868, 39874-39879, 39881-39884, 39888-39891, 39894-39896, 39898-39900, 39903, 39905-39908, 39910-39918, 39920-39922, 39925-39927, 39929-39931, 39936-39937, 39939-39942, 39946-39950, 39952-39957, 39959-39961, 39963-39970, 39972, 39974-39976, 39978, 39980, 39984-39989, 39991-39997, 39999, 40001-40002, 40004-40012, 40014-40016, 40018-40019, 40021-40022, 40024-40027, 40030-40033, 40035, 40038, 40041-40042, 40044, 40048-40051, 40053, 40056-40057, 40059-40074, 40076-40077, 40079-40080, 40082-40083, 40085-40089, 40092-40094, 40097, 40099, 40101-40102, 40106, 40108-40111, 40116-40119, 40124-40125, 40129-40130, 40134, 40138, 40140-40144, 40147-40152, 40154-40155, 40158, 40160-40163, 40165-40166, 40169-40176, 40178-40179, 40182, 40184-40186, 40190-40192, 40194-40201, 40204-40206, 40209-40215, 40217-40221, 40223-40225, 40232-40233, 40235, 40237-40239, 40242-40244, 40246-40255, 40257-40264, 40266-40268, 40271-40272, 40274-40276, 40278-40282, 40284, 40288-40296, 40298-40299, 40304, 40307-40310, 40313, 40316-40334, 40336, 40338-40339, 40341, 40346, 40351-40353, 40361-40362, 40366, 40369-40371, 40373, 40375-40385, 40388, 40392, 40400-40404, 40406, 40408-40409, 40412-40413, 40419-40420, 40422-40425, 40429, 40436-40437, 40439, 40441-40442, 40445, 40449-40451, 40453-40465, 40467-40472, 40477, 40479, 40481-40493, 40495-40496, 40498-40505, 40512-40514, 40518-40521, 40530-40532, 40534-40535, 40539-40542, 40544-40545, 40548, 40550, 40553, 40555-40559, 40561-40563, 40565, 40569-40578, 40580, 40582-40585, 40587-40588, 40590, 40592, 40594-40595, 40597-40600, 40602-40603, 40605-40606, 40609-40610, 40612-40613, 40616-40620, 40623, 40626-40629, 40631-40633, 40635-40642, 40644, 40646, 40648, 40650, 40652, 40654-40658, 40661-40663, 40666-40670, 40673-40676, 40678-40683, 40686-40689, 40691, 40693-40694, 40696-40697, 40699-40700, 40702-40707, 40711-40718, 40721-40722, 40724-40730, 40733-40734, 40737, 40739-40740, 40742, 40744-40745, 40748-40750, 40756-40759, 40761, 40769-40771, 40774, 40776, 40778, 40783-40787, 40789-40790, 40793-40794, 40796-40797, 40800, 40802-40812, 40816-40818, 40821, 40823, 40825, 40829, 40831, 40833, 40835-40836, 40838, 40840, 40842-40847, 40849, 40851-40852, 40854, 40857-40862, 40866-40874, 40880, 40882-40888, 40891-40894, 40897, 40900-40911, 40913, 40915-40921, 40923, 40925-40927, 40929, 40931, 40934-40935, 40940, 40942, 40944, 40947, 40950-40951, 40954, 40956-40959, 40962-40967, 40969-40978, 40981-40985, 40987-40988, 40990, 40992-40993, 40995, 41000-41003, 41005-41009, 41011, 41013, 41016-41020, 41022, 41024-41026, 41028, 41030, 41035-41036, 41039, 41041, 41043, 41046, 41048, 41050, 41053-41061, 41063, 41065-41069, 41074-41075, 41077, 41080-41083, 41085-41086, 41089, 41091-41092, 41096-41097, 41099-41101, 41104-41109, 41112, 41115, 41117, 41119, 41121-41123, 41125-41126, 41128, 41130-41137, 41139-41140, 41143-41144, 41146, 41148-41149, 41152-41157, 41161-41169, 41171-41173, 41176, 41178-41185, 41188-41189, 41191-41198, 41201-41208, 41210-41213, 41215, 41218, 41220-41222, 41224-41226, 41229, 41231, 41233-41238, 41241, 41246-41249, 41252-41255, 41257-41259, 41262-41263, 41265-41268, 41270-41271, 41275, 41277-41278, 41280-41285, 41289-41290, 41292-41295, 41299-41303, 41306-41314, 41316-41319, 41321, 41323-41324, 41327, 41329, 41332-41344, 41346-41351, 41353-41365, 41367-41375, 41377-41378, 41380-41384, 41389, 41393-41395, 41397-41402, 41404, 41406, 41409, 41411-41413, 41415-41416, 41418-41419, 41422, 41424-41425, 41427, 41429-41430, 41433-41437, 41439-41440, 41442-41445, 41448-41451, 41454-41458, 41460-41463, 41465-41466, 41468-41470, 41474, 41478-41483, 41486-41495, 41499-41500, 41502, 41504-41506, 41508-41509, 41511-41515, 41517, 41519-41521, 41523, 41526-41531, 41533-41534, 41539-41541, 41544, 41546, 41548, 41552-41566, 41569-41571, 41573-41575, 41578, 41580-41586, 41588-41592, 41594-41600, 41602, 41604-41608, 41610, 41614-41617, 41619, 41622, 41624, 41626, 41628-41630, 41634-41635, 41637, 41641, 41643, 41646, 41650, 41652-41653, 41656, 41660-41663, 41667, 41673, 41675-41677, 41679, 41685-41687, 41689-41691, 41693-41694, 41699, 41702, 41705-41710, 41713-41716, 41718-41719, 41721-41725, 41727-41729, 41731-41736, 41743, 41747, 41749, 41751-41759, 41762, 41764, 41766-41768, 41770-41776, 41779-41784, 41788-41792, 41794, 41796, 41798-41802, 41805-41806, 41809-41810, 41812, 41815, 41817, 41820-41821, 41823-41825, 41828-41829, 41831, 41833-41834, 41836-41838, 41840-41843, 41845, 41847-41849, 41857, 41859, 41861-41862, 41864-41866, 41868-41872, 41875-41878, 41880-41882, 41884, 41886-41897, 41902, 41911, 41915, 41918-41920, 41922-41926, 41933-41937, 41939, 41943-41945, 41952-41955, 41957, 41965-41966, 41969, 41971-41972, 41974, 41976-41979, 41985-41991, 41993-41994, 41997-42003, 42005-42025, 42030-42034, 42038-42040, 42042-42044, 42047, 42053, 42055, 42058, 42066-42069, 42073, 42075-42079, 42081-42082, 42084, 42086-42087, 42089, 42093, 42096, 42098-42101, 42103, 42105-42106, 42108-42109, 42112-42115, 42117, 42120, 42122-42125, 42130-42131, 42133-42135, 42137, 42140, 42142-42143, 42146-42147, 42151-42152, 42154, 42156-42157, 42159-42161, 42163-42165, 42167-42173, 42176-42177, 42179, 42185-42186, 42190, 42193-42195, 42198-42199, 42201-42206, 42209-42210, 42212-42214, 42218-42226, 42228-42229, 42231-42232, 42234, 42237-42245, 42247-42249, 42251, 42255, 42259-42260, 42262-42263, 42267-42268, 42270, 42274, 42276, 42279-42282, 42284, 42286-42287, 42289-42291, 42293-42297, 42299-42300, 42302-42306, 42309-42311, 42313-42316, 42319-42320, 42322-42326, 42329-42330, 42333-42334, 42337-42350, 42353-42358, 42362, 42364-42365, 42367, 42370, 42373-42376, 42381, 42383-42384, 42392-42393, 42395, 42398-42403, 42405-42406, 42408, 42410, 42415, 42417, 42424, 42426, 42428-42430, 42432-42433, 42435-42436, 42438, 42445, 42448, 42455, 42457, 42459-42460, 42463-42466, 42476, 42483-42484, 42486, 42488, 42490-42492, 42494-42501, 42503-42504, 42506-42508, 42510-42515, 42518-42522, 42524-42525, 42528-42532, 42534-42535, 42538-42541, 42543-42544, 42547-42550, 42552, 42554, 42556-42557, 42560, 42562-42567, 42570, 42572, 42574-42578, 42580-42581, 42583-42585, 42589, 42591-42596, 42598-42600, 42602-42603, 42605-42607, 42611, 42614-42616, 42619-42620, 42622, 42625, 42629, 42632, 42634, 42639, 42642, 42644-42645, 42648, 42650-42658, 42661, 42665-42668, 42672-42673, 42676, 42678-42680, 42682-42683, 42685-42693, 42696-42697, 42699, 42701, 42703-42705, 42709-42710, 42712-42714, 42716, 42718, 42720, 42724, 42727-42731, 42733, 42736-42739, 42743-42745, 42747-42748, 42750, 42753, 42756, 42758-42759, 42762-42768, 42770-42772, 42775-42780, 42782, 42784-42785, 42789, 42791-42793, 42795-42799, 42801, 42803-42804, 42806-42808, 42811-42817, 42821-42825, 42833, 42835-42839, 42841, 42843, 42845-42846, 42848, 42850-42852, 42854-42857, 42859-42860, 42862, 42865-42868, 42871-42872, 42875, 42877-42881, 42886-42889, 42891-42895, 42897-42904, 42907, 42909-42911, 42913-42926, 42928-42929, 42931, 42935-42940, 42942-42943, 42945, 42954-42966, 42968-42970, 42972-42980, 42985, 42988-42990, 42992, 42995-42998, 43000-43008, 43010-43016, 43019, 43021-43022, 43024, 43027-43029, 43031-43033, 43035, 43038, 43040-43049, 43053, 43055-43056, 43058, 43060, 43062-43066, 43069, 43072, 43075, 43077, 43080-43083, 43085-43088, 43090, 43093-43094, 43096-43097, 43100-43103, 43105, 43107-43108, 43114, 43118-43122, 43124-43127, 43129-43138, 43141-43143, 43145-43146, 43149, 43153-43159, 43161, 43163-43165, 43170-43171, 43177-43179, 43181, 43183-43184, 43186-43187, 43190-43199, 43202-43203, 43205-43207, 43209-43211, 43213-43223, 43225, 43227, 43229-43232, 43234-43235, 43237-43238, 43240-43241, 43243, 43246-43247, 43249-43251, 43255-43261, 43266-43269, 43271, 43274-43281, 43284-43296, 43298-43300, 43302-43305, 43307, 43310-43312, 43314-43317, 43319-43320, 43324-43327, 43329, 43332-43339, 43341-43346, 43352-43359, 43362-43364, 43366, 43368-43374, 43376-43381, 43383, 43385-43388, 43390-43394, 43396-43397, 43399-43402, 43404-43410, 43412-43414, 43416-43418, 43420, 43422-43425, 43427-43428, 43430-43432, 43435, 43438, 43440-43445, 43447-43451, 43455-43457, 43459, 43461-43462, 43467-43469, 43471-43475, 43477-43482, 43484-43485, 43489, 43492, 43494-43495, 43497-43505, 43507-43508, 43510, 43512-43515, 43517-43520, 43523-43524, 43528, 43531-43533, 43535-43536, 43539, 43541-43543, 43546-43547, 43550-43551, 43554, 43558-43560, 43564, 43566-43568, 43571-43572, 43574, 43577, 43579-43580, 43582, 43584-43587, 43589-43590, 43592-43596, 43601-43604, 43606, 43608-43611, 43614-43615, 43617-43620, 43622-43623, 43625, 43628-43630, 43632-43635, 43637-43638, 43640-43645, 43648, 43650-43651, 43654, 43660, 43664, 43667-43673, 43677, 43680-43691, 43695, 43697, 43699-43706, 43708-43710, 43712-43714, 43716, 43718, 43726-43728, 43734, 43736, 43740-43743, 43746-43749, 43754-43756, 43759, 43761, 43764-43765, 43772, 43774-43777, 43779, 43785-43786, 43791, 43796-43799, 43803-43806, 43808, 43810-43812, 43818, 43820-43821, 43824, 43827-43838, 43845-43847, 43850, 43853-43854, 43858-43862, 43864, 43866, 43868-43872, 43876-43877, 43879-43880, 43884-43887, 43891, 43896-43897, 43900-43902, 43904, 43907, 43909-43915, 43917-43918, 43920-43921, 43925, 43927, 43929-43930, 43936-43937, 43939-43941, 43943-43944, 43946-43947, 43952-43953, 43955, 43957-43960, 43962, 43964-43967, 43969-43971, 43973-43978, 43982-43986, 43988-43989, 43992-43994, 43997-44003, 44005-44011, 44013-44022, 44025-44028, 44032-44033, 44036-44040, 44042, 44045, 44047, 44052-44053, 44055-44059, 44061, 44064-44065, 44067, 44073, 44075-44080, 44084-44085, 44091-44092, 44094-44095, 44098, 44101-44105, 44108, 44113, 44115, 44118, 44121, 44124-44128, 44136-44146, 44154-44155, 44157-44158, 44160-44162, 44164-44166, 44169, 44171, 44173-44174, 44179-44181, 44184-44188, 44191, 44196-44197, 44199, 44206-44213, 44215, 44218, 44220, 44222, 44227-44231, 44234-44239, 44241-44243, 44245-44246, 44248-44251, 44253-44256, 44259, 44261-44263, 44266, 44268, 44271-44275, 44277-44283, 44285-44287, 44290-44291, 44297-44298, 44305-44314, 44316-44326, 44328-44330, 44333, 44336-44337, 44339-44340, 44342-44345, 44349-44353, 44355-44357, 44359, 44362-44365, 44367-44371, 44374-44375, 44379-44382, 44385, 44387-44388, 44391-44395, 44397-44400, 44402-44404, 44406, 44408-44411, 44413, 44415, 44417-44419, 44423, 44425, 44427-44428, 44430-44433, 44437-44438, 44441-44445, 44447-44449, 44453-44454, 44457-44458, 44460, 44464, 44466-44470, 44473, 44475-44477, 44481-44484, 44487-44491, 44494-44495, 44497-44498, 44500-44501, 44504-44506, 44509-44512, 44515-44520, 44522-44525, 44527-44532, 44535, 44537-44544, 44550, 44553-44555, 44558-44561, 44563-44564, 44567, 44569, 44571, 44573-44574, 44576, 44578-44581, 44584-44587, 44590-44593, 44595-44596, 44598-44601, 44604-44606, 44608-44614, 44618, 44621, 44624, 44626, 44628-44633, 44635-44638, 44640-44645, 44647-44649, 44652-44653, 44657-44659, 44666, 44669-44671, 44673, 44675, 44679-44681, 44683-44686, 44689-44699, 44702-44705, 44707, 44709-44714, 44723-44726, 44728, 44732, 44736-44741, 44743, 44745-44747, 44749-44751, 44755-44756, 44758-44763, 44766, 44768-44769, 44772-44773, 44776-44782, 44785, 44788-44790, 44792-44793, 44796-44799, 44801-44803, 44806, 44808-

44811, 44815, 44819, 44826-44827, 44833, 44838, 44840, 44842-44843, 44845-44848, 44851-44852, 44854-44855, 44857, 44859, 44862-44867, 44869, 44871-44875, 44877-44878, 44880-44882, 44885, 44887, 44889-44890, 44892-44897, 44899, 44901-44910, 44912-44914, 44919, 44922, 44924, 44927-44928, 44931-44936, 44938-44945, 44948-44950, 44952, 44954-44956, 44958-44960, 44963, 44965-44966, 44968-44972, 44974, 44976-44977, 44979-44980, 44984-44986, 44988-44999, 45004, 45006-45011, 45013-45015, 45018-45024, 45026, 45028-45031, 45033-45034, 45036, 45038, 45040-45042, 45044, 45047-45049, 45052, 45054-45055, 45057, 45063, 45068, 45080, 45089, 45091-45093, 45096-45099, 45101-45104, 45107, 45109, 45113, 45115-45116, 45118-45121, 45123-45126, 45128-45130, 45133, 45135-45136, 45138-45147, 45150-45151, 45153, 45156-45167, 45170, 45177, 45180-45182, 45184, 45189-45190, 45194-45196, 45201-45202, 45205-45207, 45210-45213, 45215, 45217-45218, 45220-45224, 45226-45231, 45233-45236, 45238, 45240-45242, 45245, 45247-45252, 45255-45258, 45261-45262, 45264, 45266-45268, 45270-45271, 45273-45274, 45277-45279, 45281, 45283-45287, 45289, 45291, 45294, 45296, 45304-45308, 45314-45315, 45317, 45322, 45324, 45326, 45331, 45334-45335, 45337, 45340-45341, 45343, 45345, 45348-45349, 45351-45355, 45357-45359, 45362, 45365, 45367-45371, 45373-45374, 45376, 45378, 45380-45381, 45388-45393, 45395-45397, 45399, 45401-45404, 45406-45409, 45411, 45415-45416, 45418-45422, 45427, 45429-45435, 45437-45439, 45442-45444, 45446-45451, 45453-45455, 45457, 45460-45461, 45464-45468, 45470-45474, 45476-45478, 45480, 45482, 45485-45487, 45489-45490, 45492, 45496-45498, 45502-45508, 45510-45515, 45517-45523, 45525-45531, 45535-45536, 45538, 45540, 45542-45543, 45546, 45548, 45550-45557, 45559-45566, 45569-45571, 45573-45586, 45589-45594, 45597-45599, 45601, 45603-45607, 45610, 45612-45613, 45615, 45617-45626, 45630, 45632-45637, 45639, 45641-45642, 45644-45645, 45647-45649, 45652, 45658-45659, 45664, 45666, 45668-45671, 45674-45675, 45678-45684, 45686, 45688-45689, 45692-45694, 45697, 45701, 45704-45711, 45717, 45719, 45722-45729, 45732, 45735-45736, 45738, 45740-45747, 45751-45752, 45756-45758, 45761-45762, 45764-45765, 45768, 45770-45782, 45785, 45787-45792, 45794-45795, 45797-45798, 45800, 45802-45803, 45805-45807, 45809, 45811-45821, 45825-45832, 45837-45840, 45842, 45844-45845, 45847, 45849, 45851-45852, 45855, 45857, 45859-45862, 45867-45872, 45874-45876, 45879, 45882-45887, 45891, 45893-45894, 45896-45899, 45903, 45905-45907, 45909, 45915, 45917, 45920-45923, 45926-45928, 45931-45935, 45938, 45941-45942, 45944-45945, 45947-45954, 45958, 45960, 45962, 45965, 45968-45969, 45971-45972, 45974-45975, 45977, 45979-45993, 45996-45998, 46000, 46005-46011, 46014-46019, 46022, 46024-46025, 46027-46028, 46031, 46033-46038, 46041-46047, 46050-46052, 46054, 46057, 46059-46061, 46063-46067, 46069-46079, 46083-46086, 46088, 46091-46092, 46096-46099, 46101, 46105-46106, 46109, 46111-46113, 46115-46117, 46119-46125, 46128-46133, 46135-46137, 46142-46145, 46147-46149, 46151, 46153-46154, 46156-46160, 46162-46166, 46170-46172, 46174-46176, 46178, 46180, 46182, 46184-46190, 46194-46197, 46199-46201, 46204-46209, 46211, 46213, 46215-46216, 46220-46226, 46230-46233, 46235-46238, 46240-46242, 46244, 46246-46248, 46250-46251, 46255-46256, 46259-46260, 46264-46265, 46267, 46269-46270, 46272-46280, 46283, 46285-46286, 46290, 46292-46294, 46296-46298, 46300, 46302, 46304-46311, 46314-46315, 46317, 46319, 46322, 46325-46329, 46331, 46333, 46335-46338, 46340-46341, 46344-46347, 46349-46362, 46364, 46366-46367, 46370, 46374-46376, 46378-46381, 46383, 46385, 46387, 46391, 46393, 46395, 46398, 46401-46403, 46405, 46407-46409, 46412, 46414-46415, 46417-46419, 46422-46424, 46426, 46428-46434, 46436-46438, 46441, 46444, 46447-46448, 46450, 46456-46459, 46461, 46463-46464, 46466, 46469-46471, 46475-46476, 46478, 46480-46481, 46484-46485, 46487, 46491-46492, 46496, 46498-46500, 46503-46505, 46507, 46512-46513, 46515, 46518-46522, 46524-46528, 46530-46533, 46535-46541, 46543, 46545-46547, 46550-46551, 46553, 46558-46559, 46563-46567, 46569-46571, 46573-46575, 46578-46579, 46582-46584, 46586, 46589, 46591-46594, 46597, 46599, 46601, 46603-46605, 46611-46612, 46616, 46618, 46620-46622, 46624-46626, 46628, 46630-46632, 46635-46647, 46649, 46651-46657, 46659-46660, 46662-46665, 46667-46668, 46670-46671, 46674-46678, 46680-46689, 46693-46694, 46699, 46702-46703, 46705-46709, 46711-46712, 46715-46716, 46718-46719, 46721, 46723-46727, 46731, 46733-46735, 46737-46739, 46741-46742, 46750, 46754, 46756-46760, 46762, 46765-46768, 46770-46773, 46777-46783, 46785-46786, 46788-46790, 46792-46797, 46803, 46808, 46810, 46813-46818, 46820, 46822-46826, 46828, 46833-46842, 46844, 46846-46855, 46860-46861, 46865, 46867, 46869-46881, 46884-46885, 46890-46895, 46897-46905, 46908-46914, 46916, 46918-46919, 46922-46926, 46928-46933, 46935-46939, 46941-46954, 46956, 46959-46969, 46973-46977, 46979-46984, 46987-46990, 46992-46994, 46997, 47001-47006, 47008-47009, 47011, 47013-47017, 47019-47020, 47022, 47024-47029, 47031-47032, 47034-47039, 47041-47042, 47044-47046, 47048, 47051, 47053-47054, 47056, 47059-47063, 47067-47070, 47073-47077, 47079, 47082-47083, 47086, 47088, 47090-47095, 47097-47099, 47103-47106, 47113-47114, 47117, 47121, 47123, 47126-47127, 47131-47132, 47134-47135, 47137-47138, 47140-47144, 47146-47150, 47152, 47158-47162, 47165-47174, 47177-47181, 47183-47184, 47186, 47189-47190, 47192, 47194, 47196-47200, 47202-47205, 47207-47208, 47211, 47213-47219, 47221-47233, 47236, 47239-47240, 47242, 47246-47252, 47254-47255, 47257, 47260-47262, 47264-47265, 47268, 47270-47271, 47273-47281, 47283-47287, 47289-47292, 47294-47299, 47304-47305, 47307-47312, 47314-47316, 47318-47324, 47326-47328, 47330-47338, 47341-47342, 47344-47345, 47349, 47351, 47353-47359, 47361, 47364, 47368-47371, 47373, 47375-47384, 47386-47388, 47390-47391, 47393, 47395-47400, 47402-47404, 47406, 47408-47409, 47411-47421, 47423-47429, 47431-47432, 47434-47439, 47441-47442, 47445-47446, 47450-47451, 47454, 47457-47459, 47461, 47469-47474, 47477-47480, 47483-47485, 47487-47490, 47492-47497, 47499-47500, 47504-47508, 47511-47515, 47517-47522, 47525-47526, 47528, 47530, 47532-47536, 47539-47540, 47543, 47545-47546, 47550, 47552, 47554-47557, 47560-

47562, 47564, 47566-47570, 47574-47575, 47579, 47581, 47583-47585, 47587-47588, 47590, 47593, 47595-47597, 47599, 47601-47603, 47605-47606, 47609-47611, 47621-47625, 47628-47631, 47633-47634, 47636-47637, 47640, 47644-47646, 47649-47652, 47657, 47663-47665, 47667, 47670-47672, 47674, 47678-47680, 47682-47684, 47686, 47688-47692, 47694, 47696-47697, 47699, 47701-47704, 47706, 47710-47711, 47715, 47717-47720, 47722, 47724, 47726, 47728, 47730, 47732-47735, 47737-47738, 47747, 47753-47754, 47758-47759, 47761, 47765, 47769-47770, 47774-47776, 47778-47779, 47781-47785, 47787, 47793, 47795, 47797-47803, 47810-47814, 47816, 47818-47832, 47836, 47838, 47840-47841, 47847-47849, 47853, 47855-47857, 47859, 47861-47864, 47866, 47868-47871, 47873, 47875, 47877, 47880, 47882-47883, 47885-47889, 47891-47895, 47897-47899, 47903-47904, 47907-47908, 47910-47912, 47917-47918, 47923-47926, 47928-47932, 47939, 47941, 47946-47948, 47952-47955, 47960-47963, 47965-47968, 47970, 47972-47974, 47976-47980, 47983-47984, 47986-47987, 47992-47993, 47995-48000, 48002, 48004, 48011, 48014, 48016, 48018-48019, 48022-48026, 48028, 48030, 48033-48034, 48036-48037, 48039-48040, 48049-48051, 48054, 48056-48057, 48062-48063, 48068, 48070-48072, 48074-48077, 48079-48082, 48085-48087, 48090, 48094, 48096, 48099-48104, 48107, 48110-48111, 48113-48115, 48118-48120, 48122-48123, 48125-48132, 48135, 48137, 48143, 48145, 48148-48152, 48154-48171, 48178, 48180-48184, 48187, 48189-48206, 48208, 48210-48211, 48213-48229, 48231-48233, 48235-48241, 48243-48247, 48250, 48253-48254, 48256-48259, 48261-48264, 48267-48273, 48275-48279, 48283-48287, 48290-48291, 48293-48301, 48303-48308, 48310-48313, 48316-48322, 48325, 48327-48329, 48331-48333, 48340-48341, 48345-48349, 48351, 48353-48356, 48358-48363, 48368-48374, 48376, 48379-48384, 48386-48388, 48392-48394, 48396, 48398-48399, 48402-48405, 48408-48417, 48419-48421, 48423, 48427, 48429-48431, 48433, 48435-48439, 48443, 48446-48453, 48459-48460, 48462-48466, 48469-48470, 48472-48476, 48480-48481, 48484, 48488-48494, 48496, 48498-48502, 48504, 48506, 48508-48509, 48511-48517, 48522, 48524, 48526-48528, 48530-48531, 48534-48539, 48542-48547, 48551, 48553, 48556-48561, 48563-48565, 48567-48568, 48573-48577, 48579-48581, 48583-48588, 48591-48593, 48597-48600, 48603, 48606, 48608-48609, 48612-48614, 48616-48618, 48621, 48624-48628, 48631-48640, 48642-48643, 48645, 48648, 48650, 48653, 48655-48657, 48659-48661, 48665-48666, 48674-48675, 48681-48682, 48684, 48686, 48690, 48695, 48697-48698, 48706, 48708, 48710-48712, 48714, 48716-48718, 48720-48724, 48729, 48731, 48736-48737, 48739, 48741-48743, 48745, 48748, 48750, 48752-48757, 48760, 48762-48767, 48771-48775, 48777, 48780-48788, 48790-48792, 48794, 48797-48798, 48800-48803, 48808, 48810, 48812, 48815, 48817-48818, 48825, 48827, 48829-48839, 48843-48852, 48857-48862, 48866-48867, 48869, 48871-48875, 48877, 48879-48885, 48888-48891, 48894-48895, 48898-48899, 48902-48903, 48905-48906, 48909-48911, 48913, 48920, 48923-48924, 48927-48933, 48935-48937, 48940, 48942, 48945, 48947-48948, 48950-48951, 48953-48954, 48957, 48959, 48962-48963, 48965-48966, 48968-48969, 48971-48972, 48974-48978, 48980-48985, 48987, 48989-48994, 48996, 48998, 49000-49001, 49004-49006, 49008-49013, 49016-49018, 49021, 49023-49024, 49026-49028, 49030-49031, 49035, 49038-49041, 49043, 49045-49048, 49050-49051, 49054-49058, 49061, 49064-49067, 49073-49074, 49078-49080, 49087-49088, 49090-49091, 49094-49097, 49099-49102, 49104, 49106, 49109-49111, 49113-49114, 49116-49118, 49121, 49124-49131, 49133, 49137-49139, 49142, 49148-49150, 49155, 49157-49160, 49163-49164, 49167, 49170, 49173-49174, 49177, 49183-49184, 49188, 49190-49194, 49196-49198, 49200-49202, 49206, 49210-49211, 49213, 49216, 49218, 49222-49226, 49228-49229, 49231-49235, 49237-49239, 49241, 49243, 49245-49252, 49254, 49260-49262, 49264-49267, 49269-49270, 49272, 49276, 49280-49286, 49288-49290, 49293, 49295-49298, 49301-49303, 49305-49308, 49310-49311, 49313-49314, 49316, 49318, 49320-49329, 49331-49333, 49335-49336, 49338, 49341-49342, 49344-49345, 49349-49351, 49354-49355, 49357-49359, 49362, 49364-49366, 49369-49372, 49375-49377, 49380, 49383-49387, 49394-49402, 49405, 49407, 49410-49411, 49413, 49417-49421, 49423-49428, 49430-49435, 49437-49438, 49440, 49444-49447, 49450-49453, 49455, 49457-49461, 49464-49472, 49474, 49478-49481, 49483-49484, 49486, 49489-49503, 49507, 49514-49515, 49517, 49519-49520, 49522-49523, 49526-49530, 49532-49537, 49539, 49544-49548, 49550-49552, 49556-49560, 49564, 49568, 49570-49573, 49575-49579, 49582, 49586, 49588, 49590-49591, 49593, 49596-49598, 49600-49611, 49613-49616, 49618-49620, 49623-49625, 49627-49628, 49631-49637, 49641, 49643-49644, 49646-49647, 49652-49675, 49677, 49679-49682, 49684-49687, 49690-49691, 49694-49695, 49698-49700, 49702, 49704-49705, 49707-49711, 49713-49715, 49717-49719, 49722, 49724, 49726, 49728-49729, 49733-49740, 49745-49747, 49750, 49752-49753, 49755-49760, 49762-49764, 49766-49768, 49770-49771, 49773, 49777-49778, 49781-49786, 49788, 49790-49791, 49793, 49795-49800, 49802-49803, 49805-49807, 49809-49810, 49812-49813, 49816-49825, 49827-49828, 49830, 49832-49833, 49835-49836, 49841-49842, 49844-49849, 49851-49852, 49854-49855, 49857-49860, 49862, 49864, 49867, 49869-49870, 49872, 49874, 49876-49878, 49880-49883, 49885, 49887-49889, 49892-49893, 49896, 49899-49900, 49902, 49907-49911, 49913-49916, 49920-49923, 49926, 49929-49931, 49934, 49936, 49939-49950, 49952, 49954-49957, 49959, 49961-49964, 49967-49969, 49971, 49973, 49977, 49981-49991, 49993, 49995-49998, 50000-50001, 50004-50005, 50009-50010, 50013-50015, 50017-50018, 50021-50023, 50033-50036, 50038, 50040-50044, 50046, 50049-50050, 50052, 50054-50058, 50060-50064, 50066-50069, 50071-50075, 50078, 50081, 50083, 50085-50086, 50089, 50092-50093, 50096, 50098-50103, 50105-50106, 50108-50120, 50122, 50128-50131, 50134-50138, 50140-50142, 50145-50150, 50152-50154, 50157-50168, 50170, 50172-50176, 50178-50188, 50190-50192, 50194, 50197, 50200-50202, 50205, 50208-50214, 50218-50224, 50226-50236, 50240, 50242-50245, 50249, 50251, 50253, 50255-50256, 50258, 50260-50263, 50265, 50267-50268, 50270-50275, 50277, 50279-50285, 50287, 50289-50295, 50298-50301, 50303-50307, 50309, 50311, 50313, 50315, 50317-50320, 50322-50323, 50325, 50329-50331, 50333-

50334, 50336, 50339-50341, 50343-50344, 50348-50351, 50354-50364, 50370-50371, 50374, 50378-50390, 50392, 50394, 50396, 50398, 50400-50405, 50407-50419, 50421-50428, 50430, 50432-50434, 50438-50443, 50445, 50450-50451, 50455, 50459, 50461-50463, 50466, 50469, 50471-50473, 50477-50481, 50484, 50486-50488, 50492-50493, 50495-50498, 50500-50502, 50504-50505, 50507-50510, 50512-50517, 50519-50525, 50529-50533, 50535-50536, 50538-50540, 50542-50543, 50545-50549, 50551-50555, 50558-50561, 50563-50568, 50570-50583, 50585-50590, 50594-50598, 50600-50601, 50603-50604, 50606, 50610, 50612-50615, 50619-50622, 50625, 50628-50629, 50631-50632, 50638-50641, 50650-50652, 50655, 50657-50659, 50661, 50663-50664, 50668-50670, 50673-50677, 50679-50680, 50682-50683, 50685, 50693, 50695, 50698-50700, 50702, 50704-50705, 50707-50718, 50721-50724, 50727-50733, 50735-50736, 50742, 50744-50746, 50748-50749, 50751-50754, 50756, 50758-50760, 50762-50763, 50765-50771, 50773-50777, 50779, 50781, 50783, 50785, 50787-50794, 50797, 50799-50804, 50806-50808, 50810-50821, 50826-50830, 50832-50834, 50837, 50839-50842, 50844-50845, 50849, 50851, 50853, 50855-50859, 50861, 50868-50869, 50874, 50876-50877, 50879-50882, 50886-50888, 50890-50891, 50893-50895, 50897, 50899, 50903, 50905-50910, 50914-50917, 50919-50922, 50924-50925, 50928-50933, 50935-50936, 50940, 50942-50943, 50945-50951, 50954, 50956, 50958, 50963, 50965-50966, 50969, 50971-50973, 50976-50980, 50985-50991, 50994, 50996-51000, 51003, 51005-51006, 51008, 51010-51011, 51015, 51018-51027, 51029-51032, 51039-51041, 51043-51053, 51055, 51058-51059, 51062-51068, 51070-51075, 51078, 51085, 51087, 51090, 51092-51098, 51100-51109, 51111-51112, 51114-51115, 51117-51119, 51121-51123, 51125-51127, 51129-51134, 51136, 51139-51141, 51143-51144, 51146-51148, 51150, 51152-51154, 51156-51162, 51166, 51168-51178, 51180-51182, 51184-51185, 51187, 51189, 51191, 51196, 51201-51203, 51207, 51209, 51211, 51213-51215, 51223-51227, 51229, 51231, 51241, 51243, 51245-51247, 51250-51254, 51260, 51262-51274, 51277-51278, 51280-51281, 51283-51285, 51287-51288, 51292, 51294-51303, 51305-51308, 51312, 51316-51317, 51323, 51327, 51329, 51331-51332, 51334-51335, 51339-51343, 51345, 51348-51351, 51353-51354, 51356-51359, 51362-51364, 51368-51370, 51372, 51375-51377, 51381-51383, 51385, 51388, 51390, 51393-51394, 51397-51403, 51405, 51407, 51410, 51412-51415, 51418, 51420-51421, 51423-51424, 51426-51427, 51429-51438, 51441, 51443-51445, 51447-51448, 51450-51453, 51456, 51462, 51465-51466, 51470-51473, 51475, 51477-51481, 51483-51485, 51487, 51495-51499, 51504-51506, 51510, 51512-51517, 51519-51533, 51536, 51539, 51541-51550, 51552-51554, 51556-51560, 51562-51563, 51567, 51570, 51573-51574, 51576, 51578-51582, 51584-51585, 51587-51588, 51591-51593, 51597-51600, 51602, 51605, 51607-51611, 51618-51620, 51623-51624, 51626-51628, 51632, 51636-51637, 51639-51641, 51645-51648, 51650-51653, 51655, 51657-51660, 51664, 51666-51668, 51671, 51673-51675, 51677-51684, 51686, 51688-51691, 51693-51695, 51697-51702, 51704-51707, 51711-51715, 51717-51721, 51724, 51726-51727, 51729, 51731-51736, 51742-51744, 51746, 51748, 51750, 51752-51756, 51758, 51760, 51762, 51768-51769, 51773, 51775, 51777-51778, 51780-51783, 51785-51786, 51793-51796, 51803-51806, 51808-51813, 51816-51818, 51820-51824, 51826-51832, 51835-51838, 51840, 51844-51845, 51847, 51849-51853, 51855, 51858-51859, 51861-51862, 51865-51867, 51871, 51874-51877, 51879-51880, 51884-51885, 51891-51894, 51897, 51900-51901, 51903, 51905-51910, 51913-51918, 51920-51930, 51933-51935, 51940, 51942-51949, 51952, 51954-51959, 51962-51965, 51967-51973, 51975, 51977-51979, 51982-51987, 51991, 51993-51996, 52000-52002, 52004-52007, 52009-52011, 52013-52016, 52018-52020, 52023-52024, 52026, 52029-52030, 52032, 52034-52041, 52043, 52046-52047, 52050, 52052-52053, 52055-52059, 52061, 52063-52067, 52071, 52073-52074, 52076-52078, 52081-52083, 52086-52090, 52093-52100, 52103, 52106, 52109-52112, 52114-52115, 52117-52118, 52120-52125, 52128, 52131-52136, 52138-52141, 52143-52144, 52146, 52148-52149, 52154, 52156-52157, 52159, 52164, 52166, 52172-52174, 52176, 52178-52181, 52184-52186, 52188, 52191-52196, 52200-52202, 52206-52209, 52211, 52213, 52215-52219, 52221-52222, 52224, 52227-52230, 52232-52234, 52236, 52239, 52241-52245, 52248-52251, 52253-52254, 52256, 52258-52259, 52265, 52268, 52271, 52273, 52275-52279, 52281-52285, 52288, 52290-52300, 52302-52303, 52305, 52308-52312, 52314-52317, 52320, 52323-52325, 52328, 52331, 52333-52340, 52342-52345, 52347, 52349, 52351-52360, 52362-52363, 52365-52366, 52368-52375, 52379, 52382-52386, 52389-52392, 52394-52397, 52399-52402, 52405, 52408-52415, 52417-52419, 52421-52422, 52426, 52428-52431, 52434-52435, 52438, 52443, 52445-52447, 52449-52451, 52455, 52461-52464, 52466, 52468, 52470, 52472, 52474, 52476, 52478-52481, 52485, 52487-52490, 52492, 52494-52499, 52501-52508, 52510, 52512-52517, 52519-52523, 52525, 52527-52529, 52531, 52533-52535, 52538, 52540-52542, 52544-52546, 52548-52551, 52554-52556, 52558, 52560-52562, 52564-52571, 52575-52576, 52579-52595, 52599, 52601-52602, 52606, 52615-52619, 52622-52626, 52628-52632, 52634, 52636, 52638-52639, 52642-52644, 52648, 52650-52655, 52657, 52661-52663, 52665-52667, 52669-52675, 52679-52683, 52687-52693, 52695-52701, 52704, 52707-52708, 52710-52720, 52722-52731, 52735-52740, 52742, 52750, 52753-52754, 52756-52757, 52759-52765, 52767-52772, 52776, 52778-52787, 52789-52791, 52794, 52799-52801, 52805-52815, 52817, 52819-52827, 52829-52830, 52836, 52839, 52841, 52844, 52846-52852, 52854-52855, 52857, 52859-52860, 52862, 52864, 52866-52867, 52873, 52877-52883, 52886, 52888-52889, 52892-52895, 52897, 52901, 52903-52904, 52909-52912, 52915-52919, 52923-52935, 52939, 52941-52943, 52945-52946, 52948-52949, 52951-52955, 52958-52961, 52965-52969, 52971-52973, 52979-52981, 52983-52987, 52989-52994, 52998-53000, 53002, 53004-53005, 53007-53011, 53024, 53026-53030, 53033-53038, 53041-53043, 53045-53049, 53051, 53053-53054, 53057, 53059-53068, 53070, 53073, 53075, 53077-53078, 53080-53083, 53085-53091, 53093, 53095, 53098, 53101-53104, 53107-53109, 53112, 53114, 53116-53121, 53124-53126, 53128-53129, 53131-53138, 53141-53142, 53145-53147, 53152-53155, 53157-53159, 53161-53162, 53164-53167, 53169-53171, 53173-53178, 53182, 53184-53186, 53190-53193, 53195, 53197-53198, 53200-53201, 53203, 53206, 53208-53209, 53211, 53214, 53218-53232, 53234-53237, 53239-53240, 53242-53244, 53247-53252, 53254-53255, 53257-53259, 53261, 53263-53266, 53268, 53276-53279, 53282, 53287, 53289, 53293-53298, 53300-53307, 53309, 53311, 53313-53321, 53323, 53325, 53327-53328, 53330-53336, 53341-53347, 53349-53355, 53357-53366, 53372-53373, 53375-53379, 53382-53389, 53391-53396, 53398-53402, 53404, 53406-53409, 53411, 53413, 53415-53420, 53422, 53425, 53428-53430, 53432-53434, 53436-53449, 53451, 53453-53458, 53462-53468, 53470, 53472-53479, 53481, 53483-53484, 53486, 53488-53489, 53493, 53495-53496, 53498, 53500-53503, 53505-53514, 53517-53522, 53524-53529, 53531, 53534, 53537, 53540, 53544-53549, 53551-53553, 53555-53560, 53562-53563, 53566, 53571-53579, 53581-53589, 53592, 53595, 53597, 53599, 53601, 53603-53611, 53613-53618, 53620, 53623-53624, 53627-53631, 53633, 53635, 53638-53639, 53641, 53643-53647, 53649-53650, 53652-53655, 53658, 53661-53662, 53664, 53667-53669, 53671-53675, 53680-53682, 53684-53686, 53688-53690, 53692-53694, 53701, 53704, 53706-53714, 53716, 53718, 53720-53721, 53723-53724, 53726, 53728-53736, 53738-53745, 53748-53749, 53751, 53753-53756, 53758-53760, 53762, 53764-53766, 53769-53770, 53772-53773, 53776, 53784-53785, 53787-53789, 53791, 53793-53795, 53797-53803, 53805-53807, 53809, 53812-53814, 53816, 53818, 53820, 53822-53824, 53826-53828, 53832, 53835, 53839-53841, 53843, 53845, 53847-53848, 53850-53854, 53856-53857, 53859, 53861-53864, 53866, 53868, 53874-53878, 53881-53890, 53892-53893, 53896-53898, 53900-53904, 53906-53909, 53911, 53914-53915, 53917-53918, 53920, 53922-53924, 53928-53930, 53932-53933, 53936, 53938-53945, 53948-53949, 53951, 53954-53955, 53957, 53959-53962, 53964, 53966, 53968, 53970-53974, 53977, 53980, 53982-53987, 53989, 53992, 53994-53996, 53998-54003, 54005-54008, 54011-54012, 54014, 54016-54019, 54021, 54023-54024, 54026-54028, 54033-54034, 54036-54037, 54040-54041, 54045-54047, 54050-54054, 54056-54057, 54059-54064, 54066-54069, 54072-54073, 54075-54077, 54079-54086, 54088-54089, 54091, 54093, 54095-54096, 54100, 54102-54104, 54106, 54108, 54111-54114, 54116-54117, 54120-54121, 54123, 54125-54131, 54133-54135, 54137, 54140-54141, 54145, 54147-54152, 54154, 54158, 54160-54170, 54172-54180, 54182-54183, 54186-54197, 54199-54212, 54215-54221, 54224-54226, 54231-54238, 54241, 54245, 54247-54248, 54250-54255, 54258-54259, 54261-54262, 54265-54267, 54269-54270, 54273-54277, 54280, 54282, 54286, 54289-54292, 54294-54296, 54299-54300, 54302, 54304-54306, 54309-54310, 54313-54314, 54317-54322, 54324, 54328, 54330-54331, 54333-54336, 54339-54341, 54343, 54345-54354, 54359-54364, 54366, 54368-54373, 54376, 54378, 54380-54381, 54385-54390, 54392, 54394-54398, 54400-54402, 54405, 54407-54415, 54417, 54419-54420, 54423, 54425, 54427-54429, 54432-54435, 54438-54440, 54442-54444, 54446, 54448-54452, 54455-54456, 54458, 54460-54468, 54470, 54473-54476, 54479-54480, 54482-54485, 54489-54494, 54496-54500, 54502-54504, 54508-54511, 54515, 54519-54521, 54524, 54526, 54528-54536, 54538-54540, 54542-54548, 54550, 54552-54556, 54558-54561, 54563-54565, 54567, 54570-54574, 54576-54579, 54581, 54583-54587, 54590-54596, 54598, 54600, 54602-54604, 54607-54608, 54611, 54613-54614, 54616-54618, 54620, 54626-54629, 54631, 54633-54636, 54638-54640, 54643-54645, 54648, 54654-54655, 54657-54659, 54661-54671, 54673-54674, 54677-54683, 54685-54691, 54693-54694, 54697-54698, 54700-54704, 54706-54710, 54712, 54715-54716, 54718-54720, 54723, 54725-54726, 54730-54732, 54734, 54737, 54739-54740, 54743-54744, 54746-54747, 54749-54750, 54752-54753, 54759, 54761-54762, 54764-54765, 54770-54776, 54778, 54780-54781, 54784, 54788-54790, 54792-54794, 54796-54811, 54813, 54816-54817, 54819-54831, 54833-54834, 54836-54837, 54839, 54842, 54846-54850, 54854-54861, 54865-54870, 54872, 54876-54877, 54879-54892, 54894-54895, 54897, 54899, 54901-54905, 54907-54908, 54910, 54912, 54915-54916, 54919, 54922-54923, 54933, 54937, 54942-54946, 54948-54949, 54951, 54953-54958, 54961-54962, 54965-54971, 54974-54975, 54978-54983, 54985, 54987-54992, 54995, 54999-55001, 55004-55005, 55009, 55011-55012, 55016-55017, 55019, 55021-55022, 55024-55025, 55027-55037, 55040-55041, 55043-55046, 55049-55054, 55057-55060, 55062-55064, 55075-55080, 55082-55091, 55093-55100, 55103-55104, 55106-55109, 55111-55114, 55118, 55122-55123, 55126, 55128-55131, 55133-55136, 55140-55146, 55148, 55150-55153, 55156, 55158, 55161-55166, 55168-55169, 55172, 55176, 55179-55184, 55186-55187, 55190, 55192-55193, 55195-55201, 55203, 55207-55208, 55210, 55213-55217, 55219-55220, 55222-55225, 55227-55231, 55233-55234, 55236-55240, 55244-55248, 55250-55251, 55253, 55256-55257, 55263-55265, 55267-55268, 55271, 55275-55282, 55285-55286, 55288-55292, 55295-55301, 55303-55311, 55313-55314, 55316-55319, 55321-55323, 55325, 55328, 55330-55331, 55334, 55336, 55339-55341, 55344-55350, 55352-55353, 55355, 55358-55359, 55361-55362, 55364-55384, 55386-55392, 55395, 55397, 55405-55412, 55414, 55416-55418, 55420-55421, 55423, 55427, 55431-55433, 55437-55441, 55445-55446, 55448-55449, 55451-55452, 55455-55457, 55459-55464, 55468, 55472-55473, 55475-55476, 55479-55490, 55492-55494, 55497, 55499, 55502, 55505-55518, 55520-55537, 55540-55544, 55546, 55549, 55551-55555, 55561-55562, 55565-55569, 55572-55575, 55579, 55581-55586, 55589-55592, 55594, 55598, 55600-55602, 55605-55608, 55611, 55614-55615, 55617-55619, 55621-55622, 55625-55626, 55628-55632, 55638, 55644-55646, 55648-55649, 55651, 55660, 55663, 55666, 55668, 55670-55679, 55681-55684, 55687, 55689, 55693-55694, 55696, 55699, 55701, 55703-55704, 55706-55707, 55710, 55715, 55719-55723, 55725-55727, 55729-55731, 55734, 55738, 55741, 55745, 55748, 55756-55757, 55759-55760, 55762-55766, 55768, 55773-55778, 55781-55782, 55784-55788, 55790-55792, 55794-55796, 55799-55803, 55806, 55809-55810, 55812-55813, 55815-55817, 55819, 55821-55827, 55829, 55831-55833, 55835, 55837, 55839-55843, 55845, 55850-55855, 55858, 55860, 55865, 55871, 55874-55876, 55879, 55881-55887, 55889-55893, 55895-55908, 55911-55913, 55915, 55921-55924, 55927-55928, 55930-55933, 55935, 55938-55939, 55941-55950, 55952-55954, 55958, 55961-55975, 55977-55984, 55986-55988, 55991-55994, 55997-55998, 56000, 56004-56007, 56009-56011, 56013, 56015, 56017-56018, 56020-56022, 56024-56026, 56030-56032, 56035-56038, 56042, 56044-56045, 56047-56048, 56050-56052, 56054-56055, 56065-56073, 56076-56078, 56080, 56082, 56084-56088, 56090-56091, 56095-56100, 56105-56106, 56112, 56114-56115, 56119, 56122-56126, 56129-56130, 56132-56136, 56138, 56141-56142, 56144-56145, 56147, 56152, 56158, 56162-56163, 56166-56167, 56169, 56171, 56174-56175, 56177, 56180, 56182-56186, 56192, 56196, 56201-56202, 56204-56205, 56213-56217, 56219, 56222, 56224, 56226-56227, 56229, 56231-56235, 56239-56241, 56243, 56245-56249, 56251-56255, 56258, 56265-56266, 56269-56279, 56281-56284, 56286-56287, 56289, 56291-56297, 56299-56302, 56304, 56310, 56315-56318, 56321-56322, 56326, 56328-56334, 56336-56338, 56341, 56346, 56348-56351, 56354-56363, 56365-56371, 56374-56379, 56382-56383, 56385, 56387, 56389-56393, 56395-56396, 56398-56402, 56404, 56406, 56408, 56410, 56412-56416, 56418, 56420-56428, 56430-56431, 56435-56442, 56444-56445, 56448, 56450-56452, 56454, 56456-56462, 56466, 56469-56471, 56473, 56475-56479, 56481, 56483, 56486-56490, 56492, 56495-56497, 56499-56508, 56511-56520, 56522, 56525-56526, 56528-56530, 56532-56536, 56538-56540, 56543-56544, 56546, 56549, 56551-56555, 56558-56560, 56562-56564, 56566, 56569-56570, 56572, 56576, 56578, 56580-56583, 56586-56590, 56593, 56595-56596, 56600, 56602-56604, 56606, 56608, 56610, 56612, 56614, 56617-56618, 56620, 56622-56624, 56627, 56633, 56636-56644, 56646-56655, 56657, 56660-56663, 56667-56670, 56672-56673, 56678, 56680-56686, 56689, 56691-56694, 56697-56699, 56701-56702, 56708, 56713-56715, 56717-56723, 56726, 56729-56737, 56740-56741, 56745-56746, 56748-56751, 56753, 56755-56757, 56760-56764, 56766-56767, 56769, 56773, 56776-56778, 56780, 56782, 56784-56789, 56791-56793, 56795, 56798, 56800, 56803, 56805, 56807-56814, 56816, 56818-56827, 56829, 56831, 56833-56835, 56838-56839, 56841, 56844-56851, 56853-56855, 56858, 56861-56868, 56872, 56874, 56876-56879, 56884-56886, 56890-56894, 56897-56898, 56900-56908, 56910-56912, 56914, 56916-56917, 56921, 56923, 56925-56926, 56931-56932, 56934, 56936-56937, 56941, 56943-56944, 56946-56947, 56951-56956, 56959-56963, 56966-56967, 56974, 56976-56977, 56981, 56985-56990, 56992-56995, 56999-57002, 57007-57009, 57012-57017, 57022-57024, 57026-57027, 57029-57030, 57032, 57034-57039, 57041-57044, 57046-57048, 57052-57059, 57061-57064, 57068-57072, 57074-57079, 57081-57082, 57084-57085, 57088-57091, 57093-57094, 57097-57099, 57101, 57103-57108, 57110, 57112-57116, 57120-57121, 57123-57125, 57127-57131, 57134-57136, 57138, 57140-57141, 57144-57145, 57148-57149, 57153, 57155, 57157-57159, 57161-57169, 57172, 57175-57177, 57179-57189, 57192-57194, 57196, 57198-57202, 57204, 57206, 57209-57210, 57212-57214, 57218-57219, 57221-57222, 57224-57227, 57229-57237, 57239-57248, 57253-57256, 57258-57263, 57265, 57267-57271, 57273-57277, 57280-57281, 57285-57287, 57289-57293, 57296, 57298, 57300-57301, 57304, 57306, 57308-57315, 57317-57319, 57321, 57323-57331, 57334, 57336-57343, 57346-57351, 57354, 57356-57360, 57364-57365, 57368, 57370-57372, 57374-57375, 57377-57378, 57381, 57385-57393, 57395-57399, 57403-57405, 57407, 57412, 57414-57415, 57417-57420, 57422, 57424, 57426-57427, 57429-57430, 57436-57439, 57441-57445, 57449-57450, 57452-57453, 57455, 57457, 57459-57460, 57462-57463, 57467, 57473-57476, 57479, 57482, 57486, 57488, 57490-57491, 57493-57503, 57505-57509, 57512, 57520-57528, 57530-57531, 57534-57538, 57540, 57543, 57545, 57548, 57550-57551, 57553-57554, 57556-57557, 57559, 57562-57564, 57568, 57570, 57572, 57574, 57576, 57578, 57580-57582, 57584-57587, 57590-57591, 57594, 57597, 57600-57601, 57605, 57607-57608, 57611, 57615, 57617-57620, 57623-57624, 57626, 57630-57634, 57637, 57640-57643, 57646-57647, 57649-57650, 57653, 57656-57658, 57663-57664, 57666-57668, 57671, 57673-57675, 57679-57680, 57683, 57687-57707, 57709, 57711, 57713-57714, 57717-57723, 57727-57728, 57731, 57733, 57735-57738, 57740-57742, 57744-57745, 57747-57748, 57752, 57754-57756, 57759, 57761-57767, 57772-57775, 57777-57778, 57780-57782, 57784-57785, 57788-57791, 57793, 57795-57802, 57804, 57806-57807, 57809-57810, 57816-57817, 57819-57828, 57830-57837, 57839, 57841, 57843, 57847, 57849-57853, 57855-57857, 57860-57861, 57863-57869, 57871-57874, 57876-57877, 57880-57885, 57887-57889, 57891-57895, 57899-57901, 57904, 57906-57907, 57909, 57914-57915, 57917-57919, 57921, 57923-57925, 57927-57933, 57937-57939, 57943-57960, 57962, 57964-57966, 57970-57978, 57980, 57983, 57985-57995, 57997, 58000, 58002, 58004, 58006, 58008, 58010, 58012-58013, 58016-58027, 58030-58031, 58033-58035, 58037-58038, 58040, 58042-58048, 58054, 58056, 58058, 58060-58061, 58063-58069, 58071-58072, 58074-58082, 58085, 58087-58092, 58094, 58096-58097, 58099-58102, 58104-58106, 58109-58114, 58116, 58119-58124, 58129-58131, 58134, 58137, 58139, 58146-58150, 58153-58154, 58156-58161, 58164, 58167, 58169-58171, 58173, 58179, 58181, 58183-58185, 58187, 58191, 58193-58199, 58201, 58203, 58205-58207, 58209-58214, 58217-58221, 58223-58226, 58228, 58230, 58233-58234, 58236-58237, 58239-58240, 58244-58247, 58249, 58251-58253, 58255, 58257, 58259-58260, 58263-58266, 58268, 58270, 58272-58274, 58276, 58278-58280, 58282, 58284-58285, 58292-58293, 58296-58297, 58299-58307, 58310, 58312, 58314-58320, 58322, 58324, 58326-58336, 58339-58340, 58343-58344, 58349-58350, 58352, 58354-58356, 58359, 58361, 58363, 58366, 58368-58370, 58372-58375, 58378, 58380, 58382, 58386, 58388, 58390-58392, 58395-58401, 58405, 58407-58408, 58410, 58413, 58415-58416, 58418-58421, 58423, 58425, 58427-58431, 58433-58435, 58437-58438, 58440-58444, 58446, 58449-58451, 58453-58455, 58464, 58466, 58468-58469, 58471-58472, 58475, 58478-58481, 58483-58493, 58496-58497, 58502-58507, 58511-58513, 58515, 58517-58520, 58522, 58524-58526, 58529-58530, 58532-58537, 58539-58542, 58544-58551, 58553, 58555, 58557-58565, 58568-58572, 58576, 58581-58583, 58588-58594, 58597-58598, 58600, 58602-58605, 58607-58608, 58610, 58612, 58616-58619, 58621-58625, 58627-58632, 58634, 58639, 58642, 58644-58646, 58648, 58651-58660, 58662-58664, 58667, 58669, 58671-58672, 58674, 58676, 58678-58684, 58688-58690, 58693-58695, 58699, 58701-58702, 58705, 58707-58708, 58711, 58713-58714, 58716-58718, 58722, 58724-58729, 58731-58733, 58735-58740, 58742-58744, 58746-58748, 58751, 58753, 58755-58762, 58764-58766, 58768-58773, 58776-58777, 58779, 58781, 58785, 58787-58791, 58793, 58796-58797, 58799-58803, 58805, 58815, 58819, 58821, 58827-58828, 58830, 58833-58834, 58836-58837, 58839, 58842-58845, 58847-58849, 58851-58852, 58854-58859, 58861-58862, 58864-58869, 58872-58875, 58877, 58879-58880, 58883-58885, 58887-58888, 58890, 58892-58894, 58896, 58898, 58900-58902, 58905-58906, 58908, 58910, 58913-58915, 58917-58920, 58922-58923, 58925-58926, 58928, 58930-58932, 58934-58935, 58940, 58943, 58946, 58948-58949, 58951, 58954-58955, 58957, 58959-58960, 58962, 58964, 58968-58974, 58976, 58978-58979, 58981, 58985, 58988-58991, 58995, 58999, 59001-59002, 59006, 59008, 59010-59012, 59015-59016, 59020, 59023-59024, 59028, 59034, 59039, 59041-59046, 59048-59050, 59053-59055, 59059, 59062, 59070-59072, 59074-59076, 59082, 59084-59085, 59087-59091, 59093, 59096-59097, 59099-59100, 59102, 59105, 59107-59111, 59113, 59117, 59120-59125, 59127-59128, 59130-59131, 59133-59134, 59136-59138, 59140, 59145, 59147-59148, 59150, 59152, 59154-59156, 59158, 59160, 59162, 59165-59167, 59171-59173, 59175-59176, 59178, 59186-59192, 59196-59197, 59199-59213, 59215-59216, 59218-59219, 59223, 59225, 59228, 59230-59231, 59233-59235, 59237, 59240-59241, 59243, 59245-59246, 59253-59255, 59257, 59259-59260, 59262, 59264, 59267-59269, 59271-59278, 59280-59281, 59284-59285, 59288-59291, 59293-59294, 59296, 59301-59304, 59306, 59308-59310, 59312-59321, 59323-59329, 59331-59332, 59336-59337, 59339-59346, 59352, 59354-59355, 59362, 59364-59365, 59367, 59370-59373, 59375-59378, 59380-59381, 59386-59387, 59389-59391, 59395-59396, 59400-59407, 59409-59414, 59416-59417, 59419, 59422, 59424-59425, 59427-59430, 59432-59433, 59435, 59437-59438, 59440-59441, 59443-59445, 59447-59452, 59454-59455, 59457, 59461-59464, 59469-59470, 59473-59474, 59476-59478, 59481, 59483-59484, 59486, 59490-59491, 59493, 59495-59496, 59498-59502, 59504-59505, 59507-59508, 59511, 59513-59514, 59516, 59518-59522, 59524, 59529, 59532-59543, 59545, 59548-59560, 59562-59564, 59566, 59568-59570, 59572, 59575-59582, 59586-59587, 59589-59601, 59603, 59605-59607, 59609-59610, 59614-59616, 59618-59619, 59621, 59627-59628, 59630-59634, 59636-59639, 59641-59643, 59645-59653, 59657-59673, 59675, 59677-59687, 59689, 59691-59702, 59705-59712, 59714-59716, 59719-59720, 59723-59724, 59726-59733, 59735-59736, 59739, 59742-59744, 59746, 59748-59749, 59751-59752, 59755-59757, 59760-59762, 59764-59765, 59768-59770, 59776, 59778, 59780-59783, 59785-59795, 59799, 59802-59804, 59810, 59813-59817, 59819, 59821-59827, 59829-59830, 59832, 59834-59835, 59840, 59842-59846, 59851-59854, 59858, 59861-59862, 59865-59866, 59869-59871, 59873-59874, 59877, 59879, 59881-59883, 59885-59887, 59890, 59893, 59895, 59897-59898, 59904, 59907-59909, 59911, 59913, 59916-59919, 59921-59922, 59924-59928, 59930-59931, 59934-59944, 59946, 59949, 59951, 59954-59955, 59957-59961, 59963-59969, 59973, 59976-59982, 59985-59987, 59991, 59993-59999, 60002-60003, 60005-60006, 60008, 60010-60012, 60014, 60016, 60020, 60022-60025, 60028-60029, 60031-60032, 60034-60041, 60043-60047, 60050-60051, 60053-60054, 60058-60064, 60067-60069, 60071, 60073-60075, 60078-60080, 60082-60088, 60090-60106, 60108-60109, 60111-60112, 60118, 60120-60121, 60124-60130, 60132-60136, 60138-60145, 60147-60155, 60159-60165, 60168, 60171-60172, 60174, 60176, 60178-60187, 60189, 60192, 60194, 60196-60200, 60203-60205, 60207, 60209-60213, 60215-60218, 60220, 60226, 60229, 60231-60232, 60235-60238, 60241-60242, 60244-60245, 60247, 60249-60260, 60262, 60264, 60267-60274, 60276-60282, 60287-60289, 60291-60294, 60296-60300, 60302, 60305, 60309-60315, 60317, 60319-60320, 60322, 60326, 60328, 60330-60331, 60333-60338, 60340, 60343, 60345-60346, 60348-60350, 60352-60358, 60362, 60364-60366, 60368-60371, 60373-60374, 60376-60388, 60390-60397, 60399-60403, 60405, 60407-60417, 60419, 60422-60427, 60430-60431, 60434-60436, 60438, 60442-60443, 60445-60447, 60449-60453, 60456-60461, 60463-60464, 60469-60471, 60474, 60480, 60482-60483, 60485-60489, 60494-60495, 60497-60499, 60501, 60503-60513, 60515, 60518-60520, 60523-60524, 60526, 60528, 60532-60534, 60537-60540, 60542-60543, 60545-60555, 60558-60560, 60563-60573, 60576, 60579-60580, 60586-60596, 60599, 60606, 60609, 60611-60616, 60618, 60620, 60622, 60624, 60627-60629, 60631, 60634-60637, 60639-60640, 60643, 60646-60647, 60649, 60653, 60658, 60661-60670, 60673-60676, 60678-60679, 60682-60686, 60689-60690, 60692-60702, 60706-60710, 60713-60714, 60717-60721, 60723-60724, 60726, 60729, 60731-60737, 60739-60747, 60749, 60751-60753, 60755-60761, 60763-60765, 60767-60768, 60770-60771, 60773-60774, 60776-60780, 60782-60788, 60791-60793, 60795-60796, 60798-60801, 60803-60804, 60806-60807, 60809-60810, 60812-60818, 60820, 60822-60827, 60830, 60837-60841, 60843-60845, 60848, 60850, 60852-60861, 60863, 60865-60866, 60868, 60871-60874, 60878-60881, 60885-60886, 60888-60889, 60891-60892, 60894, 60896-60897, 60903-60909, 60911-60912, 60914-60916, 60920-60925, 60927-60929, 60931, 60934-60935, 60937, 60939, 60941-60945, 60947, 60949-60952, 60954-60958, 60960, 60962, 60964-60968, 60970, 60972-60973, 60977-60978, 60981-60983, 60985, 60988-60989, 60991-60998, 61001, 61006, 61008-61009, 61012-61015, 61018-61023, 61025-61029, 61033, 61035-61036, 61038, 61041, 61045-61054, 61058-61059, 61063-61067, 61074, 61076, 61078-61079, 61081, 61085-61086, 61088, 61091, 61093-61095, 61097-61099, 61101, 61103-61104, 61106, 61108, 61110, 61114, 61120-61121, 61123-61131, 61135-61136, 61140-61143, 61145, 61148, 61153-61166, 61169-61173, 61178, 61183, 61185-61195, 61198-61199, 61201-61207, 61209-61212, 61214-61218, 61220-61223, 61225-61231, 61233-61237, 61240, 61243-61244, 61247-61250, 61252-61254, 61259, 61261-61263, 61268-61270, 61274-61277, 61287, 61289-61292, 61300, 61302, 61304, 61306-61307, 61311, 61314-61316, 61319, 61321-61324, 61326, 61328-61329, 61331-61342, 61344-61347, 61350-61351, 61353-61357, 61359, 61362-61364, 61366-61367, 61369, 61372, 61374, 61376, 61379-61380, 61382-61390, 61392, 61397, 61400-61401, 61404, 61406, 61409-61414, 61416, 61419, 61423-61425, 61427-61432, 61436-61445, 61447-61448, 61451, 61457-

61460, 61462-61463, 61465, 61469, 61472-61475, 61477, 61479, 61483-61484, 61486, 61490, 61493-61494, 61496, 61499-61500, 61502-61503, 61505-61507, 61509-61514, 61516-61519, 61524-61527, 61529-61530, 61532-61536, 61538-61541, 61544-61546, 61549, 61551-61554, 61558, 61561, 61563-61571, 61573-61577, 61579-61583, 61586-61597, 61600-61602, 61604-61614, 61617, 61619-61628, 61632, 61634, 61636-61637, 61639-61641, 61644-61646, 61648, 61650-61653, 61655-61656, 61658-61659, 61661-61663, 61665-61666, 61668, 61670, 61673-61676, 61678-61679, 61681-61683, 61685-61690, 61693-61694, 61696-61699, 61701-61704, 61706-61708, 61711-61717, 61719, 61721-61723, 61727-61728, 61730-61739, 61742-61743, 61745-61750, 61752-61753, 61755-61759, 61763-61764, 61766-61767, 61769-61779, 61784-61785, 61787-61788, 61794-61797, 61799-61804, 61806-61807, 61809-61810, 61812-61823, 61825-61826, 61828-61833, 61836-61839, 61842-61843, 61847-61851, 61853, 61855, 61857-61859, 61861-61863, 61865, 61867-61871, 61877-61895, 61898, 61900-61903, 61905-61908, 61911, 61914-61917, 61919-61927, 61930, 61932-61933, 61935, 61937-61942, 61944-61948, 61950-61953, 61955-61959, 61962-61966, 61969, 61971-61981, 61984-61986, 61988-61990, 61992, 61995-61996, 61998-61999, 62003, 62005-62008, 62010, 62014, 62017-62018, 62020-62022, 62025-62026, 62028-62030, 62033-62035, 62037-62038, 62040, 62043-62045, 62050-62054, 62057-62058, 62061-62064, 62066, 62068-62070, 62072, 62078, 62081-62082, 62084-62085, 62092-62093, 62095-62096, 62098-62100, 62102-62103, 62105, 62108-62109, 62111, 62115-62119, 62121-62123, 62125-62126, 62128-62130, 62134-62142, 62144-62147, 62150-62155, 62158-62162, 62164-62170, 62172-62174, 62176-62180, 62182-62191, 62193, 62195, 62198, 62201, 62203-62206, 62208-62209, 62211-62212, 62215-62218, 62220-62223, 62225-62226, 62229-62231, 62233, 62235, 62237, 62240-62244, 62246-62247, 62249-62251, 62253, 62255, 62259, 62261-62262, 62264-62266, 62271-62272, 62274, 62277-62280, 62282, 62285, 62287, 62289-62290, 62297-62300, 62302-62307, 62309-62310, 62320, 62324, 62327-62328, 62330, 62332-62339, 62341-62343, 62345-62349, 62352-62357, 62360-62365, 62368-62372, 62376, 62380-62381, 62383-62385, 62387-62391, 62397-62398, 62400-62402, 62404, 62406-62408, 62410-62412, 62414, 62417, 62419, 62422-62426, 62429-62431, 62433-62441, 62444, 62447, 62449, 62451-62452, 62455-62457, 62459, 62462-62464, 62468-62480, 62482, 62487, 62489-62499, 62501-62503, 62505-62507, 62509-62520, 62522-62524, 62529-62530, 62532-62534, 62536, 62538-62541, 62544, 62548-62549, 62551, 62555, 62558, 62564-62565, 62567-62569, 62573-62574, 62576-62582, 62584-62585, 62587-62594, 62596-62599, 62601-62606, 62608-62612, 62615-62617, 62619, 62622-62623, 62625, 62628-62634, 62638-62646, 62648-62653, 62656-62657, 62659, 62663-62664, 62666-62674, 62676, 62678-62679, 62681, 62683-62685, 62689-62692, 62694-62695, 62703-62710, 62712, 62716-62717, 62722, 62726, 62729-62732, 62735-62736, 62740-62747, 62749-62750, 62753-62754, 62756, 62759, 62766, 62768, 62770-62773, 62777, 62779-62782, 62785-62786, 62791, 62794-62796, 62798-62800, 62802-62804, 62806-62811, 62813-62815, 62820-62821, 62825-62826, 62829-62838, 62841-62843, 62845-62846, 62849-62865, 62867-62868, 62870, 62874-62875, 62878-62882, 62889-62902, 62904-62907, 62909-62911, 62913-62914, 62916-62918, 62921, 62925-62930, 62932-62934, 62936-62941, 62944-62945, 62948, 62951, 62953, 62955-62960, 62962, 62964, 62967-62972, 62975, 62980-62984, 62986-62989, 62991, 62993-62994, 62998-63000, 63002-63003, 63007-63013, 63015-63021, 63024, 63027-63028, 63032, 63035-63042, 63045-63050, 63052-63053, 63055, 63057, 63060-63063, 63066-63069, 63072, 63074-63081, 63083-63086, 63088, 63091, 63094-63096, 63098-63103, 63107-63117, 63119, 63122-63124, 63128, 63130, 63134-63136, 63138-63139, 63141, 63143-63149, 63151, 63155-63165, 63167-63169, 63171-63172, 63174-63176, 63178-63179, 63181, 63184-63194, 63199-63202, 63204-63205, 63208-63212, 63215, 63218-63219, 63221-63223, 63225-63226, 63228-63229, 63231-63232, 63235-63236, 63239-63243, 63247-63248, 63251-63252, 63256-63257, 63260-63264, 63266-63268, 63270-63273, 63275-63278, 63283-63284, 63286-63295, 63298, 63300, 63303-63308, 63310-63312, 63316, 63318, 63320-63323, 63325-63330, 63332-63334, 63337-63338, 63340-63345, 63347, 63349-63358, 63360-63362, 63364-63367, 63369-63370, 63372, 63374-63376, 63378-63391, 63393-63396, 63399, 63401, 63404-63412, 63414-63415, 63418-63431, 63433-63438, 63440-63444, 63446, 63448, 63450-63451, 63455, 63457, 63464-63465, 63467-63468, 63470-63472, 63476-63479, 63481, 63483, 63485, 63487, 63489-63490, 63492-63496, 63500, 63502-63503, 63505-63508, 63511-63514, 63516-63518, 63521-63522, 63524-63531, 63533, 63535-63540, 63543-63550, 63552-63553, 63555, 63557, 63560-63564, 63566, 63570-63571, 63573-63574, 63579-63587, 63589-63590, 63592-63593, 63595-63598, 63601, 63603-63612, 63614-63617, 63619, 63622-63623, 63625-63626, 63630-63631, 63633-63639, 63644, 63648-63649, 63655, 63658-63659, 63662, 63668, 63670-63671, 63673-63674, 63678, 63680-63684, 63686, 63688-63689, 63691-63694, 63696-63705, 63707, 63710-63717, 63719, 63723, 63727-63728, 63730-63731, 63734-63737, 63739-63740, 63743-63745, 63747-63758, 63761, 63763-63766, 63770, 63772, 63774-63779, 63781-63783, 63786-63787, 63789-63794, 63796-63798, 63800-63801, 63803-63804, 63807-63808, 63810-63813, 63815-63822, 63824-63827, 63829, 63832-63833, 63839, 63841, 63843-63850, 63853-63854, 63857-63861, 63863-63865, 63868-63869, 63871-63873, 63875-63876, 63878-63886, 63888-63899, 63901, 63905-63909, 63911-63914, 63916, 63920-63927, 63931, 63934, 63936-63938, 63941, 63943-63945, 63947, 63949-63952, 63955-63956, 63958-63964, 63967, 63969, 63971-63976, 63978, 63980-63982, 63984-63986, 63988-63990, 63993-63995, 63998-63999, 64001-64003, 64005-64014, 64016, 64018-64024, 64026-64030, 64032-64033, 64035, 64038, 64040-64041, 64043, 64045-64062, 64065-64069, 64071-64072, 64076, 64078, 64080-64088, 64090-64091, 64093-64096, 64099-64106, 64108-64109, 64111-64113, 64116-64118, 64120-64121, 64123-64134, 64136-64138, 64141, 64144-64147, 64151-64153, 64158-64164, 64168, 64170-64173, 64176-64181, 64183, 64185-64190, 64193, 64197-64200, 64202-64203, 64205-64211, 64214, 64216-64221, 64223-64224, 64227-64228, 64230-64231, 64235-64237, 64239-64240, 64242, 64244-64246, 64248-64249, 64256-64257, 64259-64260, 64262-64265, 64267-64269, 64271-64275, 64279, 64282-64284, 64287-64288, 64291-64292, 64299, 64302-64303, 64305-64310, 64312, 64315, 64318-64319, 64321, 64325-64328, 64330, 64332-64334, 64336, 64338-64340, 64342-64352, 64354-64355, 64358-64360, 64362-64363, 64366-64367, 64369, 64372-64373, 64376, 64380-64384, 64386-64388, 64390-64391, 64393-64396, 64398, 64401-64406, 64408-64410, 64413, 64415, 64418, 64424-64429, 64431-64439, 64441, 64443, 64445, 64448, 64452, 64454, 64456-64458, 64461-64462, 64466-64470, 64472-64477, 64479, 64481, 64483-64487, 64489-64499, 64501, 64503-64504, 64506-64508, 64510-64511, 64513, 64516, 64518-64522, 64524, 64526-64535, 64540-64541, 64543-64546, 64548, 64551-64559, 64561, 64563-64564, 64567-64568, 64571-64574, 64576-64577, 64582, 64584-64586, 64588-64589, 64591, 64593-64594, 64596-64598, 64600-64602, 64605-64606, 64608-64610, 64612-64617, 64620-64626, 64628, 64631, 64634, 64637, 64640-64641, 64643, 64647-64648, 64650-64651, 64654-64655, 64657-64662, 64664, 64666-64671, 64674-64682, 64684, 64686, 64688, 64690-64692, 64694, 64696-64699, 64701, 64703-64706, 64708-64709, 64711-64714, 64716, 64718, 64725-64733, 64736-64738, 64741, 64743-64744, 64747-64748, 64750-64751, 64754-64755, 64758, 64761-64764, 64766, 64769, 64772-64773, 64775, 64777, 64779-64782, 64784-64785, 64788, 64791-64796, 64798, 64802-64803, 64807-64808, 64810-64813, 64815, 64817, 64819, 64822-64829, 64831-64832, 64834-64837, 64839-64841, 64844-64846, 64848-64851, 64855, 64858-64860, 64862-64869, 64872-64875, 64879-64881, 64884, 64886-64891, 64894, 64898, 64900-64909, 64911-64917, 64919-64920, 64925, 64927, 64929-64931, 64934-64935, 64938-64943, 64945-64955, 64961-64962, 64965-64966, 64969-64973, 64975-64976, 64978, 64981-64985, 64987-64988, 64990, 64992, 64994-65000, 65002, 65004-65007, 65009-65010, 65013, 65019-65020, 65022, 65025-65026, 65028-65040, 65042-65045, 65047-65050, 65054-65055, 65057, 65059-65060, 65062, 65067-65068, 65072-65078, 65080-65081, 65083-65088, 65090, 65092-65104, 65107, 65109, 65112, 65115-65116, 65118-65119, 65121-65122, 65124-65128, 65130, 65132-65135, 65137-65141, 65143-65146, 65148-65153, 65155, 65157, 65159-65160, 65162, 65164-65165, 65168-65173, 65177-65179, 65182-65183, 65185, 65188-65189, 65191-65194, 65196-65197, 65201, 65204-65206, 65208-65213, 65215-65218, 65221, 65223-65226, 65229, 65231, 65233-65235, 65238, 65241-65242, 65244-65249, 65251, 65253-65254, 65258, 65261-65266, 65268, 65270-65271, 65273, 65275-65276, 65279, 65281, 65283-65284, 65286-65287, 65290-65293, 65295, 65297, 65299-65302, 65305-65312, 65314-65315, 65317-65320, 65323, 65327-65329, 65333, 65335-65340, 65342-65348, 65352-65354, 65359-65368, 65370-65371, 65374, 65376-65384, 65386-65389, 65392-65397, 65399-65403, 65407-65408, 65410-65412, 65414-65415, 65418-65429, 65431, 65433-65434, 65438-65440, 65443-65447, 65450, 65452-65453, 65455-65456, 65458, 65460-65462, 65465, 65467-65469, 65471-65476, 65478, 65480-65489, 65492, 65494-65499, 65501-65502, 65504, 65508-65509, 65511-65514, 65517-65518, 65520-65521, 65525-65531, 65533, 65535-65536, 65538-65544, 65554, 65556, 65559-65560, 65562, 65566, 65569-65577, 65580-65584, 65588-65590, 65592-65593, 65595, 65597-65598, 65603-65606, 65608-65609, 65613-65615, 65617, 65619, 65625-65626, 65628-65632, 65634-65635, 65637-65638, 65640, 65642, 65645-65646, 65648-65649, 65651-65660, 65663-65665, 65668, 65671-65677, 65680-65682, 65684-65687, 65689, 65691, 65695-65696, 65699-65700, 65702-65704, 65707, 65713-65716, 65718-65720, 65723, 65725-65728, 65731-65735, 65738, 65740, 65743-65745, 65747-65749, 65751-65754, 65757-65766, 65769-65770, 65773-65778, 65780-65782, 65785-65786, 65788, 65790-65792, 65794, 65796, 65799-65801, 65803-65805, 65808-65812, 65814-65819, 65821-65826, 65828, 65830-65833, 65836-65840, 65842-65848, 65851, 65854, 65859-65860, 65863-65866, 65868, 65870, 65876, 65878-65879, 65881-65886, 65888, 65891-65896, 65898, 65900, 65903, 65905-65907, 65909, 65911-65912, 65915, 65917-65923, 65925, 65927-65929, 65931-65932, 65935-65937, 65939-65944, 65953-65956, 65958-65965, 65967-65968, 65970-65971, 65973, 65975-65976, 65978-65981, 65984-65987, 65990, 65992, 65995-66004, 66006-66008, 66010, 66012-66018, 66020, 66024-66025, 66027-66031, 66033-66035, 66037, 66039-66041, 66047-66048, 66050-66053, 66056, 66058, 66061-66062, 66064, 66066-66073, 66075-66077, 66079-66082, 66084, 66089, 66091-66093, 66095-66096, 66099, 66101-66102, 66107, 66109-66114, 66117, 66120-66123, 66125-66126, 66128, 66131-66139, 66141-66142, 66145-66154, 66156-66163, 66165-66170, 66172, 66174-66176, 66178-66183, 66185-66188, 66190, 66192-66193, 66195-66196, 66198-66201, 66204, 66207-66212, 66215-66216, 66218-66220, 66223, 66225, 66229-66231, 66235-66239, 66241-66243, 66245, 66247-66250, 66254-66262, 66264-66265, 66268-66270, 66274, 66276-66277, 66281, 66283-66288, 66291-66295, 66297-66300, 66302-66305, 66311-66313, 66316-66325, 66327, 66329-66331, 66333-66334, 66336-66338, 66340, 66342, 66345-66348, 66350-66356, 66362, 66366-66369, 66371-66375, 66377-66378, 66380, 66390-66393, 66395-66396, 66399-66400, 66403-66406, 66408, 66410-66413, 66416-66418, 66420-66421, 66426-66428, 66431-66432, 66434-66439, 66442-66444, 66446, 66448-66450, 66452-66474, 66476-66479, 66481-66485, 66488-66490, 66492, 66495, 66497-66506, 66508-66509, 66511-66514, 66519-66523, 66525-66526, 66528, 66531, 66534-66540, 66542, 66546-66547, 66552-66554, 66559-66561, 66563-66571, 66573-66574, 66576, 66579-66581, 66583, 66586, 66588-66591, 66593-66604, 66607-66608, 66611-66612, 66614-66622, 66625, 66628, 66632, 66635-66636, 66639, 66645-66649, 66653, 66655-66659, 66661, 66663-66664, 66666, 66668, 66671-66672, 66675-66676, 66679-66683, 66686-66687, 66689-66693, 66695, 66700, 66702-66703, 66705-66706, 66708, 66710-66714, 66716, 66718-66720, 66723-66729, 66731, 66733, 66736-66740, 66742-66746, 66748-66752, 66754, 66757, 66759-66760, 66762-66769, 66772, 66776-66778, 66780-66781, 66788-66798, 66800-66802, 66804-66807, 66809-66810, 66812, 66814-66815, 66817-66818, 66820-66823, 66827-66828, 66830-66831, 66835, 66838, 66846, 66848, 66852, 66858-66861, 66863-66864, 66866, 66868, 66870-66871, 66874, 66876, 66878-66879, 66881-66883, 66890-66893, 66898, 66900, 66902, 66904-66906, 66911, 66913-66914, 66919-66923, 66925-66935, 66938, 66941, 66944-66949, 66951-66952, 66954-66956, 66960-66962, 66965, 66967, 66969, 66972-66977, 66980-66981, 66984-66986, 66988, 66991-66992, 66994-66996, 67000-67002, 67004-67007, 67009-67014, 67017, 67020-67021, 67024, 67026-67034, 67038-67042, 67046-67050, 67052, 67054-67057, 67059-67065, 67067-67068, 67071-67075, 67078, 67082, 67085-67087, 67096, 67099-67104, 67106, 67108-67109, 67111-67113, 67116-67120, 67123, 67125-67127, 67129, 67131-67146, 67148, 67151, 67158, 67161-67163, 67167, 67170, 67172-67174, 67177, 67182-67184, 67186, 67188, 67190, 67195, 67197, 67201-67205, 67208-67211, 67214, 67216, 67218-67223, 67225-67228, 67230, 67232, 67235-67239, 67241-67242, 67244-67248, 67251-67254, 67256-67257, 67259-67260, 67263, 67265-67268, 67270-67274, 67278, 67280-67281, 67285-67286, 67288-67292, 67295-67296, 67298-67303, 67305-67307, 67310-67313, 67316, 67320-67322, 67325, 67327, 67331-67334, 67336, 67338-67341, 67343-67346, 67348-67350, 67353-67355, 67358-67366, 67369-67371, 67373-67378, 67380-67382, 67384, 67387, 67389-67398, 67400-67401, 67404-67406, 67409, 67411-67415, 67417-67436, 67438, 67441-67442, 67444-67446, 67449-67452, 67454-67460, 67462-67466, 67468-67476, 67478-67482, 67484-67485, 67489, 67494, 67496-67498, 67503, 67505, 67507-67509, 67511-67516, 67519-67520, 67522-67524, 67527, 67529, 67532-67533, 67535-67536, 67540, 67542-67553, 67555-67557, 67563-67565, 67568-67581, 67585-67590, 67592-67595, 67597-67600, 67602-67603, 67606, 67608, 67611, 67613-67615, 67617, 67619-67622, 67624, 67626, 67630-67635, 67638, 67641, 67644-67646, 67650, 67652-67656, 67659-67663, 67666-67667, 67669-67683, 67686-67688, 67690, 67692-67697, 67699-67701, 67703-67707, 67709, 67711-67715, 67717-67718, 67721-67723, 67726, 67729-67733, 67735-67737, 67739-67743, 67747-67749, 67755-67764, 67766, 67768-67771, 67775, 67777-67778, 67781, 67783-67785, 67789-67799, 67801, 67803, 67805-67809, 67811, 67813, 67818-67822, 67825, 67830-67834, 67837-67844, 67846, 67849, 67851, 67853-67857, 67861-67862, 67865, 67867-67870, 67872-67874, 67876-67880, 67883-67886, 67888-67891, 67893-67894, 67899-67901, 67903, 67905, 67909-67910, 67912-67917, 67920, 67925-67930, 67933, 67935, 67938-67942, 67945, 67953-67956, 67958-67959, 67961-67962, 67966-67974, 67976-67977, 67981-67982, 67984-67990, 67992-67994, 67997, 68001, 68003-68005, 68008-68012, 68014, 68016-68020, 68023-68031, 68033-68035, 68040-68044, 68046-68050, 68052, 68055-68057, 68061-68064, 68066-68068, 68070-68071, 68076-68079, 68083-68087, 68090-68091, 68093-68095, 68098, 68100, 68102, 68104-68107, 68112, 68114-68115, 68117-68120, 68123-68125, 68129, 68131-68132, 68135-68136, 68138-68139, 68141-68142, 68145-68146, 68148-68153, 68155, 68158-68163, 68165-68166, 68168-68174, 68176-68184, 68187-68193, 68197-68200, 68204, 68206-68208, 68210-68220, 68223-68225, 68229-68230, 68233, 68235-68236, 68238, 68240, 68242, 68245, 68247, 68249-68253, 68255-68256, 68261-68262, 68266-68269, 68272-68274, 68277, 68279-68280, 68283, 68286-68289, 68291-68295, 68297-68300, 68302, 68305-68309, 68311-68313, 68315, 68317-68318, 68320-68322, 68325, 68327-68330, 68332-68335, 68337, 68339-68341, 68344, 68346-68353, 68355, 68359-68360, 68362-68365, 68367-68369, 68371, 68375-68376, 68379, 68381, 68383, 68387-68388, 68391, 68393-68395, 68398-68401, 68405-68406, 68408-68414, 68416-68420, 68422-68424, 68426, 68429-68433, 68436-68440, 68442-68446, 68448-68450, 68452, 68455-68457, 68461, 68464-68465, 68472, 68475-68476, 68478, 68480, 68482-68484, 68486-68487, 68489-68490, 68492, 68494-68495, 68497, 68499, 68502, 68504-68511, 68513, 68516-68517, 68519, 68521-68522, 68524-68529, 68531-68532, 68534-68535, 68537-68538, 68540, 68542, 68544, 68546-68547, 68549-68550, 68552, 68554, 68557, 68561-68562, 68567, 68569-68570, 68573-68575, 68579-68581, 68583-68585, 68587, 68590, 68592, 68594, 68597-68598, 68601, 68603-68604, 68606-68607, 68609-68611, 68613, 68618, 68621-68626, 68630-68634, 68636-68638, 68640-68643, 68645, 68647-68649, 68651, 68658, 68660, 68663-68664, 68666-68672, 68674-68678, 68681-68683, 68685, 68688-68689, 68691-68698, 68700-68702, 68704-68708, 68710, 68712-68713, 68716, 68720, 68722-68725, 68727-68728, 68730-68732, 68734-68738, 68741, 68743, 68747, 68749-68751, 68753-68754, 68757-68758, 68760-68761, 68766-68769, 68771-68777, 68779-68784, 68786-68787, 68790-68795, 68797, 68799-68802, 68806-68811, 68814-68815, 68817-68820, 68822-68825, 68827-68828, 68830-68834, 68837-68840, 68842-68845, 68847-68852, 68854, 68856-68857, 68862-68863, 68865-68866, 68870-68871, 68874-68876, 68879-68884, 68887-68892, 68894, 68896-68898, 68900-68903, 68905-68911, 68914-68916, 68919, 68924-68925, 68930-68933, 68935-68940, 68942-68948, 68950-68951, 68962-68964, 68966-68967, 68970-68971, 68973-68977, 68980, 68983-68984, 68986-68992, 68995, 68997-68998, 69000-69005, 69008, 69010-69011, 69013, 69015-69023, 69028-69030, 69032-69034, 69040-69045, 69047-69048, 69050-69058, 69060-69062, 69064-69065, 69069-69071, 69073-69078, 69080-69084, 69088, 69090-69093, 69095-69097, 69101-69105, 69107-69110, 69112-69114, 69118, 69120-69124, 69127-69137, 69139, 69141-69142, 69146, 69148, 69150, 69153-69156, 69158, 69160, 69162-69170, 69172, 69175, 69177, 69179-69193, 69195-69198, 69200, 69202-69203, 69205, 69207-69215, 69217, 69219-69225, 69227-69232, 69234, 69238, 69240, 69242-69244, 69246-69247, 69249-69250, 69253, 69260, 69262, 69264-69265, 69267-69268, 69270-69271, 69273-69274, 69276, 69278, 69282, 69284, 69286, 69289-69296, 69298-69300, 69303, 69306-69309, 69312-69313, 69315-69316, 69319-69320, 69322-69325, 69327-69329, 69338, 69341, 69343, 69345, 69349, 69352-69354, 69356-69357, 69366-69367, 69369-69370, 69372-69373, 69376-69377, 69379-69382, 69385-69387, 69389-69391, 69393-69396, 69399, 69402-69406, 69410, 69414, 69419, 69421, 69427-69434, 69437, 69440-69441, 69443-69445, 69448, 69450-69451, 69453, 69455-69456, 69458, 69460-69462, 69464-69465, 69468, 69470-69471, 69476-69480, 69483, 69485-69487, 69489-69493, 69496-69500, 69502, 69505-69510, 69512-69516, 69518-69519, 69523-69525, 69528, 69530-69531, 69533-69535, 69537-69538, 69540-69542, 69544-69546, 69548, 69551, 69553-69557, 69559, 69563, 69565-69575, 69579, 69581, 69583-69592, 69594-69596, 69598, 69603-69613, 69615-69625, 69627-69628, 69630, 69632-69636, 69638-69639, 69642, 69644, 69646-69649, 69653-69657, 69660-69663, 69668-69673, 69675-69681, 69685-69686, 69688-69689, 69691-69693, 69695-69696, 69702, 69705-69713, 69722-69725, 69727-69729, 69732-69733, 69735, 69737-69741, 69743-69747, 69749, 69751-69752, 69754, 69756-69760, 69762-69763, 69765-69767, 69769-69770, 69772, 69774, 69776-69777, 69779-69780, 69782, 69784, 69789-69796, 69798-69803, 69808, 69811, 69817-69818, 69820, 69822-69823, 69827-69828, 69830, 69833, 69835, 69837-69839, 69842-69843, 69846-69851, 69854, 69856, 69859, 69865-69866, 69872, 69874-69876, 69878-69880, 69882, 69887, 69889-69890, 69892-69899, 69901-69903, 69905-69911, 69913-69915, 69917-69928, 69931-69932, 69935-69936, 69938-69939, 69942-69943, 69946, 69950-69953, 69955-69958, 69960, 69963-69968, 69972, 69976-69977, 69979, 69982, 69985, 69988-69993, 69995-69997, 69999-70004, 70006, 70010-70014, 70016-70017, 70019, 70021, 70025-70028, 70031-70033, 70038, 70041-70042, 70044, 70047-70052, 70054-70055, 70057, 70059, 70062, 70064-70071, 70073-70075, 70078, 70080, 70086-70090, 70093-70095, 70097, 70100-70102, 70104, 70109, 70111-70115, 70117, 70119-70125, 70129-70140, 70142-70148, 70150, 70157-70159, 70161-70163, 70165-70173, 70176-70179, 70181-70182, 70184-70189, 70194-70195, 70197-70198, 70200-70201, 70203-70205, 70207-70212, 70214, 70216, 70219-70220, 70222-70226, 70228-70232, 70234-70235, 70237-70240, 70242, 70245-70247, 70249, 70253, 70255-70256, 70258-70264, 70267-70270, 70273, 70275, 70277-70285, 70287, 70289-70290, 70295-70296, 70298-70299, 70303-70304, 70308, 70311-70313, 70315-70316, 70318-70319, 70321, 70325, 70330-70332, 70335-70336, 70338, 70344-70346, 70348-70358, 70361-70363, 70365-70368, 70370, 70372, 70374-70377, 70379-70382, 70384-70385, 70387, 70390, 70394-70395, 70397-70406, 70409-70410, 70412-70414, 70416-70418, 70421, 70423-70424, 70428-70430, 70432-70435, 70438-70439, 70441-70444, 70446, 70452, 70456, 70460, 70463-70464, 70468, 70470, 70472-70475, 70477-70478, 70481-70482, 70486-70489, 70491-70493, 70495-70496, 70498, 70500, 70502-70504, 70506-70508, 70510, 70513, 70517-70520, 70522-70526, 70528-70530, 70532-70539, 70542, 70544, 70548-70551, 70553-70555, 70557-70561, 70563, 70565-70569, 70571-70572, 70575-70576, 70578, 70580-70584, 70586, 70588, 70590-70592, 70596, 70598, 70600, 70602-70608, 70613, 70615-70616, 70620, 70622-70623, 70626-70629, 70633, 70635-70641, 70644, 70648, 70650-70651, 70653-70654, 70657-70664, 70666-70668, 70670-70671, 70673-70674, 70680, 70682-70686, 70688-70691, 70693-70695, 70697-70699, 70701, 70703-70705, 70712, 70715-70717, 70719-70721, 70723, 70725, 70727-70729, 70731, 70736, 70739, 70742, 70744-70747, 70751-70753, 70755-70756, 70759, 70761, 70763-70764, 70766, 70768-70769, 70771-70772, 70776, 70778, 70780, 70782, 70786-70789, 70791-70794, 70796, 70799-70801, 70804, 70808-70812, 70817, 70819-70822, 70826-70827, 70832-70835, 70837, 70841-70843, 70845-70846, 70848-70849, 70851, 70854, 70859-70866, 70868, 70871-70872, 70877, 70881-70884, 70890-70891, 70893-70897, 70899-70901, 70903-70905, 70907, 70910, 70912-70914, 70916-70921, 70923, 70927, 70929, 70931-70932, 70934-70935, 70937, 70939-70941, 70943-70945, 70947-70948, 70950, 70952-70954, 70956-70957, 70961-70965, 70969-70977, 70979-70980, 70983, 70988-70989, 70991-70992, 70994, 70996-71001, 71004-71006, 71008-71012, 71015-71018, 71020, 71023-71025, 71028-71030, 71033-71034, 71036, 71040, 71042-71043, 71046-71050, 71053-71061, 71063-71073, 71075, 71077, 71080-71081, 71084, 71089-71090, 71092, 71094, 71096-71097, 71099-71101, 71103-71104, 71107-71109, 71115-71116, 71118-71126, 71129, 71131-71134, 71138-71141, 71145, 71151-71157, 71160-71161, 71163-71166, 71168, 71172, 71176, 71178, 71180-71181, 71183, 71185, 71188, 71192-71193, 71195-71197, 71200-71205, 71207, 71209-71210, 71212, 71214-71216, 71220-71222, 71229-71230, 71232-71233, 71236-71239, 71244, 71247, 71249-71250, 71254-71257, 71262, 71264, 71266-71273, 71276, 71278, 71283-71285, 71288-71294, 71296, 71298, 71300-71305, 71308-71314, 71317, 71319, 71324, 71328-71333, 71338-71345, 71348, 71351-71353, 71355-71360, 71362-71365, 71367-71379, 71382-71384, 71387, 71389, 71391-71397, 71400-71409, 71411-71418, 71420-71424, 71426-71433, 71435-71437, 71439-71440, 71443-71445, 71448-71450, 71452-71454, 71458, 71460-71468, 71470, 71472-71473, 71476-71480, 71482-71488, 71492-71494, 71496-71498, 71500, 71503, 71505-71506, 71508-71517, 71519-71520, 71522, 71524, 71526-71527, 71531-71533, 71538, 71543-71553, 71555-71563, 71567-71569, 71571-71573, 71577, 71581-71582, 71584-71585, 71588-71592, 71594, 71597, 71599-71600, 71602, 71604-71608, 71611, 71621, 71623, 71625-71629, 71631-71634, 71636, 71638, 71641-71646, 71648, 71652-71659, 71663-71665, 71667-71668, 71670, 71672, 71674-71677, 71680, 71682-71685, 71689-71694, 71697-71698, 71700, 71702-71704, 71707-71709, 71711-71717, 71719-71720, 71723-71726, 71729-71737, 71739, 71741-71743, 71746-71752, 71754-71758, 71760-71761, 71763-71766, 71768, 71770, 71774-71775, 71777-71778, 71780-71787, 71789, 71792-71796, 71799-71811, 71815-71819, 71822-71824, 71826-71828, 71830, 71833-71834, 71838, 71841, 71843, 71845, 71847-71854, 71857, 71859-71860, 71862-71864, 71866, 71868-71869, 71871-71873, 71875-71876, 71881, 71883, 71886-71887, 71890-71891, 71895, 71898-71900, 71903, 71905-71908, 71910-71911, 71915, 71918, 71920-71935, 71937, 71940-71942, 71945, 71947-71948, 71950-71958, 71960-71963, 71965-71967, 71969, 71975-71977, 71980, 71984-71988, 71990-71991, 71993, 71995-71996, 71999-72000, 72004, 72007, 72014-72021, 72026-72029, 72034-72036, 72038, 72043-72044, 72048-72049, 72051, 72054, 72056-72057, 72059-72068, 72070-72071, 72073-72074, 72076, 72078-72080, 72082, 72084-72094, 72098-72108, 72110, 72112-72117, 72119-72124, 72128, 72130-72131, 72133-72137, 72139, 72141, 72143, 72145-72146, 72148-72164, 72167-72168, 72172, 72174-72178, 72180-72184, 72187-72188, 72190, 72192-72194, 72196-72201, 72206, 72208-72210, 72213, 72215-72217, 72220-72223, 72226-72227, 72232-72234, 72236, 72238-72241, 72243, 72246-72252, 72254-72256, 72258-72259, 72261-72262, 72264-72268, 72271, 72274, 72277-72278, 72280-72282, 72286-72296, 72299-72303, 72305-72307, 72312, 72316-72317, 72319-72320, 72322-72323, 72326-72329, 72331-72340, 72342, 72344-72346, 72349-72355, 72357-72358, 72361-72375, 72377-72378, 72380-72383, 72385-72386, 72388-72389, 72391, 72393-72394, 72396-72398, 72400-72405, 72409, 72412-72414, 72416-72417, 72419-72420, 72425-72429, 72431-72432, 72434, 72438-72440, 72443, 72445-72446, 72450, 72453-72463, 72465-72467, 72471-72474, 72476-72480, 72482, 72486-72495, 72497-72498, 72502-72503, 72505-72512, 72515, 72517-72521, 72523, 72526, 72528-72532, 72534-72541, 72544-72546, 72548-72549, 72551-72566, 72570, 72572-72575, 72585, 72587, 72590-72591, 72594-72595, 72597, 72599, 72601, 72603-72604, 72606-72609, 72611-72614, 72621-72624, 72626-72628, 72630-72631, 72636-72637, 72639, 72649-72652, 72655, 72657, 72659-72660, 72662-72664, 72666-72671, 72673-72677, 72680, 72682-72684, 72686-72687, 72689, 72691-72694, 72697-72700, 72705-72706, 72709-72711, 72713, 72715-72719, 72721, 72723, 72725-72732, 72734, 72736, 72739, 72741-72742, 72745, 72747-72749, 72751-72753, 72756-72757, 72759, 72763-72768, 72770-72772, 72779-72781, 72784, 72786-72787, 72789-72790, 72792-72793, 72795-72796, 72798-72799, 72803-72805, 72807, 72809-72819, 72822-72823, 72825-72826, 72828-72834, 72836-72837, 72839-72844, 72847-72849, 72851, 72854, 72859-72864, 72866-72869, 72871-72873, 72875-72876, 72880-72883, 72885-72893, 72899, 72902, 72905-72906, 72912-72922, 72924, 72926-72931, 72934-72935, 72937-72941, 72944, 72947-72948, 72950-72953, 72955, 72957-72962, 72964-72965, 72970, 72972-72974, 72979, 72981-72984, 72991-72992, 72995, 72998-72999, 73001, 73004, 73006-73014, 73019, 73021-73023, 73025, 73028, 73030, 73032, 73034-73036, 73038-73039, 73041-73042, 73044, 73047, 73051-73055, 73058, 73060-73062, 73066-73067, 73069-73071, 73073, 73076, 73079, 73081, 73083, 73085-73089, 73091-73092, 73096, 73098, 73102, 73104-73106, 73110-73111, 73115-73118, 73120, 73122, 73124-73127, 73129, 73134, 73136-73137, 73139, 73141-73142, 73144, 73146, 73148, 73150-73157, 73159-73165, 73168-73169, 73171, 73173, 73175-73181, 73183, 73185-73187, 73190-73191, 73198-73200, 73202-73205, 73207-73210, 73215-73220, 73222-73225, 73229-73231, 73233-73235, 73237-73239, 73241-73247, 73250-73252, 73255, 73263-73264, 73266-73271, 73273-73274, 73276-73280, 73283-73295, 73297, 73299-73300, 73302, 73304-73308, 73311, 73313, 73315, 73317-73321, 73323, 73325-73329, 73331-73332, 73335, 73343-73346, 73348, 73350-73351, 73353-73356, 73358, 73360-73365, 73367-73371, 73375-73379, 73381-73384, 73390, 73393-73395, 73397-73398, 73400-73405, 73407-73408, 73410-73411, 73417, 73424, 73426, 73428, 73430-73433, 73435-73436, 73439-73440, 73442, 73444, 73446-73447, 73449, 73452-73459, 73466, 73469-73473, 73475-73476, 73479-73480, 73482, 73485, 73489-73491, 73494, 73498-73499, 73502-73507, 73510, 73514-73515, 73519-73522, 73524-73525, 73529-73530, 73532-73533, 73536-73537, 73541-73546, 73549, 73552, 73555-73556, 73558-73559, 73561, 73565-73568, 73570, 73576-73578, 73585, 73596-73597, 73599, 73601-73603, 73605-73606, 73612-73616, 73623, 73625, 73630-73636, 73638-73639, 73641, 73645, 73647-73648, 73653-73658, 73663-73664, 73666, 73673, 73677-73678, 73680-73685, 73687-73691, 73693, 73695-73696, 73700, 73703, 73705, 73707-73710, 73712-73717, 73719-73722, 73724, 73730-73732, 73734, 73736-73738, 73744, 73746-73747, 73750, 73752, 73756-73758, 73760-73761, 73763-73766, 73768-73769, 73772-73773, 73775, 73777-73779, 73783, 73786-73792, 73795-73796, 73798, 73802-73813, 73815, 73818-73819, 73821, 73825-73826, 73828, 73830, 73832-73833, 73836-73840, 73842-73845, 73847-73848, 73850-73851, 73853, 73855, 73857, 73859, 73861-73864, 73866, 73868, 73882, 73884, 73886, 73889, 73893-73894, 73901-73902, 73904, 73907, 73909-73915, 73918-73922, 73924, 73926, 73932, 73934, 73936, 73938-73943, 73945-73950, 73952, 73955, 73958-73963, 73966-73967, 73969-73974, 73976-73979, 73981, 73983-73984, 73986-73987, 73990, 73993, 73995-73996, 73998-73999, 74001, 74004-74008, 74010, 74012-74013, 74015, 74017, 74021, 74026, 74028-74029, 74034, 74038, 74044-74047, 74049-74050, 74053, 74055-74057, 74059-74066, 74068, 74070-74073, 74075-74076, 74078-74079, 74081, 74083-74084, 74086, 74090-74094, 74097, 74099-74100, 74102, 74104, 74106-74107, 74111-74113, 74116-74120, 74122-74123, 74125-74126, 74128, 74131-74133, 74135-74138, 74140, 74142, 74145-74149, 74152, 74154-74155, 74157-74158, 74160, 74163, 74168-74171, 74173-74175, 74177, 74179, 74185, 74187-74193, 74195-74196, 74200, 74203, 74207-74208, 74211-74215, 74218, 74220, 74223-74224, 74227, 74229-74230, 74233-74234, 74236-74237, 74239, 74243-74244, 74246, 74248, 74251, 74255-74256, 74258-74259, 74261-74263, 74265-74268, 74270-74272, 74274-74275, 74277-74280, 74282-74283, 74285-74286, 74288-74293, 74295-74300, 74303-74305, 74307, 74311, 74314, 74319-74323, 74325, 74327-74334, 74337-74339, 74342-74343, 74346-74349, 74351, 74360-74364, 74366, 74368, 74370-74371, 74373-74377, 74379-74385, 74388-74390, 74394-74401, 74403-74405, 74409, 74411, 74413, 74415-74419, 74426, 74429, 74431-74432, 74434-74437, 74439-74446, 74448-74449, 74452-74457, 74463-74469, 74471-74472, 74474-74475, 74477, 74479, 74482-74485, 74487-74488, 74490-74491, 74494-74495, 74497, 74499-74506, 74508-74509, 74511-74514, 74517, 74519-74522, 74524-74527, 74531-74532, 74534-74538, 74541-74547, 74553-74557, 74559-74565, 74571-74573, 74575-74577, 74581-74585, 74587-74591, 74595, 74599, 74601, 74603-74605, 74607-74611, 74613, 74615-74619, 74621-74622, 74625, 74627-74632, 74635-74636, 74639, 74644-74645, 74650, 74652, 74654-74655, 74657, 74659, 74662-74664, 74669-74677, 74679-74681, 74687, 74689-74691, 74707-74710, 74712, 74714-74717, 74719-74734, 74736, 74738-74739, 74744-74745, 74748, 74752-74755, 74757-74761, 74763-74765, 74767, 74769, 74771, 74773, 74776, 74778-74779, 74782-74783, 74785, 74788-74790, 74792-74802, 74805, 74807-74817, 74821-74822, 74825, 74827-74835, 74837, 74839-74844, 74846-74848, 74850-74852, 74854-74855, 74857-74867, 74872, 74874-74875, 74878, 74880-74881, 74883-74885, 74888, 74892-74897, 74904-74906, 74908-74909, 74911-74914, 74916-74917, 74922-74923, 74925, 74927-74928, 74930, 74932-74934, 74936-74939, 74941-74945, 74947-74949, 74952-74954, 74956-74962, 74965-74968, 74970-74975, 74977-74978, 74983-74984, 74986, 74988-74990, 74993-74995, 74998-75006, 75008-75011, 75014, 75016-75021, 75023-75028, 75032-75036, 75038-75040, 75042-75045, 75047-75049, 75051, 75053, 75055-75057, 75059-75070, 75072-75076, 75079, 75081-75083, 75086-75087, 75089-75093, 75095-75097, 75099-75100, 75103, 75105-75106, 75108-75109, 75111-75113, 75115, 75117-75119, 75121, 75126-75128, 75130-75131, 75134-75137, 75140-75142, 75144-75145, 75147-75153, 75155-75156, 75158, 75160-75161, 75164, 75168-75172, 75174-75176, 75178-75181, 75183-75186, 75188, 75192, 75195-75196, 75198, 75200, 75202, 75204-75208, 75210-75211, 75218, 75220, 75223-75228, 75230, 75232-75234, 75236-75239, 75241-75242, 75244-75245, 75247, 75250-75253, 75255, 75258-75261, 75263-75265, 75269-75271, 75273-75276, 75278-75281, 75284, 75287, 75292-75294, 75296-75300, 75302-75303, 75305, 75307, 75309-75314, 75317-75318, 75321-75332, 75334-75339, 75344, 75347-75352, 75355-75356, 75358-75363, 75367, 75369, 75371-75373, 75375-75380, 75382-75386, 75390-75392, 75394, 75396, 75398, 75400, 75402-75409, 75411-75412, 75414-75415, 75417, 75419-75422, 75425-75429, 75432, 75436, 75438, 75442-75446, 75448-75451, 75453-75455, 75457, 75459, 75465-75466, 75469-75470, 75472-75474, 75476-75479, 75482-75484, 75486-75490, 75492-75493, 75499-75501, 75504-75505, 75507, 75509-75516, 75520-75537, 75541, 75545-75547, 75549-75553, 75555-75556, 75558-75560, 75563-75569, 75571, 75574-75579, 75583-75584, 75588-75590, 75592-75593, 75595-75596, 75600-75605, 75607-75609, 75611-75615, 75617-75619, 75621-75624, 75626, 75628, 75631-75639, 75642, 75645-75650, 75652, 75655-75659, 75662-75666, 75668-75669, 75671, 75675-75679, 75682-75684, 75686-75687, 75689-75690, 75693-75694, 75697-75703, 75705, 75707-75711, 75714-75716, 75720, 75724-75735, 75738, 75743, 75746, 75750, 75754, 75756-75758, 75760, 75762-75766, 75769-75771, 75773-75775, 75777, 75779, 75781-75784, 75786, 75792-75794, 75796-75800, 75803-75804, 75806-75808, 75811-75817, 75820-75822, 75824-75826, 75828, 75830, 75832-75834, 75836, 75840, 75842, 75844-75845, 75848-75857, 75859, 75861-75864, 75866, 75869-75871, 75873-75874, 75877-75878, 75881, 75884, 75886-75887, 75889-75892, 75895, 75897, 75900-75903, 75906, 75908-75912, 75914-75919, 75921-75923, 75926, 75928, 75931-75934, 75938-75941, 75943-75946, 75948, 75950, 75952, 75956-75958, 75960-75964, 75966-75969, 75971-75974, 75976, 75979, 75982-75990, 75993-75994, 75997-76012, 76014-76018, 76022, 76024-76025, 76027-76032, 76034, 76038, 76040, 76043, 76045, 76049-76051, 76053-76054, 76056, 76059, 76061-76065, 76067-76069, 76071-76076, 76079-76082, 76084, 76087, 76089, 76091-76092, 76095, 76097-76102, 76105-76110, 76112-76113, 76116-76120, 76124-76125, 76127, 76129-76132, 76134, 76138-76142, 76144-76147, 76150-76153, 76157-76158, 76160-76166, 76168, 76170-76178, 76183-76185, 76189, 76191-76196, 76198-76201, 76206-76208, 76210, 76212-76215, 76217, 76219-76220, 76225-76229, 76232-76240, 76242, 76244, 76246, 76249, 76251-76253, 76255, 76257-76259, 76261-76263, 76265-76266, 76268, 76270-76271, 76274, 76278-76285, 76288, 76292-76294, 76296-76297, 76300-76302, 76304-76305, 76308-76317, 76319, 76321-76322, 76325-76327, 76329-76332, 76334-76341, 76343, 76345-76347, 76354-76355, 76357-76358, 76361, 76364-76366, 76368-76371, 76373-76376, 76381-76382, 76386-76388, 76391, 76393, 76396-76399, 76401, 76403-76409, 76411-76414, 76416-76418, 76420-76426, 76429-76432, 76436, 76438-76439, 76441-76444, 76446-76447, 76449-76456, 76458-76462, 76465, 76468, 76470-76471, 76473-76475, 76477, 76479-76490, 76493, 76496, 76499-76507, 76509-76513, 76519-76520, 76523-76526, 76528-76529, 76531, 76533, 76535, 76538, 76541-76543, 76545, 76547-76549, 76551-76552, 76554-76559, 76561-76562, 76565-76573, 76575, 76577, 76582-76583, 76585-76587, 76590, 76593-76594, 76598-76603, 76607-76611, 76614-76621, 76625-76627, 76629-76633, 76635-76637, 76640, 76642-76654, 76657, 76659-76663, 76665-76666, 76668, 76671-76674, 76676-76678, 76686-76690, 76692, 76694-76696, 76698-76699, 76701-76702, 76709, 76711-76712, 76714-76716, 76719, 76721-76726, 76728, 76730-76731, 76734, 76737-76738, 76740-76745, 76748, 76750-76751, 76753, 76755-76757, 76760-76766, 76768-76769, 76771-76772, 76774-76775, 76777-76779, 76781-76782, 76784, 76787-76788, 76794, 76798-76799, 76803-76806, 76808-76812, 76814-76817, 76819-76827, 76829-76838, 76840-76841, 76844-76845, 76848, 76852, 76854-76855, 76859-76862, 76864-76866, 76868, 76870, 76872-76883, 76885-76889, 76892-76898, 76901, 76904-76905, 76907-76912, 76914-76915, 76917, 76919, 76924, 76926, 76928, 76931-76932, 76935, 76937, 76940, 76943-76945, 76947-76950, 76952-76955, 76957-76961, 76965-76971, 76973-76979, 76984, 76986-76992, 76994-76996, 77002, 77004, 77010-77011, 77014, 77019-77022, 77024, 77026-77028, 77033, 77035-77036, 77038-77046, 77049, 77052-77060, 77062-77063, 77065-77067, 77069, 77073, 77076-77078, 77080-77082, 77084, 77086, 77090-77092, 77094, 77097-77100, 77102, 77106-77107, 77109-77110, 77112, 77117-77124, 77128-77134, 77136-77138, 77140-77141, 77143, 77147, 77150-77159, 77161-77162, 77164, 77166-77167, 77169-77171, 77173, 77175-77176, 77178-77187, 77189-77193, 77198-77202, 77204, 77206, 77211-77214, 77217, 77219-77221, 77223-77224, 77226-77229, 77231-77233, 77235-77237, 77241, 77251, 77257-77258, 77261-77262, 77264-77265, 77269-77270, 77273-77275, 77277-77282, 77284, 77286-77288, 77291-77294, 77296, 77298-77301, 77304-77306, 77310-77315, 77317-77318, 77320-77321, 77323, 77325-77327, 77329-77332, 77335-77345, 77347-77349, 77351-77353, 77355, 77358-77368, 77370-77374, 77376, 77378-77382, 77385, 77387-77390, 77392-77397, 77399, 77401-77402, 77409, 77411-77417, 77421-77424, 77427-77430, 77433, 77435-77437, 77439-77445, 77447-77452, 77454-77457, 77459, 77461-77469, 77472, 77474, 77477-77479, 77482, 77484, 77486-77487, 77489-77492, 77494, 77496-77497, 77499, 77501, 77504-77505, 77508-77511, 77513, 77515, 77517-77518, 77522-77524, 77526, 77529, 77533, 77536-77540, 77547, 77556-77558, 77561-77562, 77564-77567, 77569, 77573-77574, 77577, 77579-77580, 77584-77585, 77587, 77589-77593, 77596-77598, 77602, 77606, 77608, 77611-77612, 77614-77629, 77632-77636, 77638-77642, 77644, 77648, 77652-77658, 77662-77667, 77670-77671, 77675-77678, 77681-77684, 77686-77687, 77690-77693, 77695-77697, 77702-77710, 77712, 77714, 77716-77717, 77719-77726, 77729, 77731-77736, 77738-77740, 77742, 77744-77750, 77752, 77754-77760, 77762-77763, 77766-77767, 77769, 77771-77772, 77774-77775, 77782-77783, 77785-77788, 77792, 77794, 77797-77799, 77801-77805, 77807, 77809-77810, 77815-77822, 77825-77828, 77830, 77832, 77834, 77836-77840, 77842-77850, 77854-77856, 77859, 77861, 77863, 77866-77868, 77872-

77874, 77876-77879, 77882-77883, 77886, 77888-77890, 77892-77894, 77896-77899, 77901-77905, 77907, 77909-77910, 77912, 77914-77917, 77923, 77928-77930, 77932, 77934-77935, 77938-77939, 77941-77943, 77946-77950, 77952, 77954-77956, 77959-77965, 77967, 77969, 77972-77974, 77976-77981, 77983-77993, 77995-78004, 78006-78007, 78011-78018, 78020-78023, 78025, 78027, 78029, 78031-78032, 78034-78037, 78041, 78045, 78047-78052, 78061-78067, 78069, 78071-78076, 78078-78079, 78085-78086, 78088-78089, 78091, 78093-78095, 78097-78098, 78101, 78103, 78107-78109, 78111-78112, 78115, 78117, 78119-78121, 78123-78128, 78130-78134, 78142, 78146, 78149, 78152, 78154-78156, 78158-78162, 78164, 78166-78169, 78171-78172, 78174, 78178, 78183-78187, 78189-78195, 78197-78201, 78205, 78208-78217, 78220-78226, 78230-78232, 78234-78236, 78238, 78240-78242, 78246-78247, 78249-78252, 78255, 78258, 78261-78270, 78273, 78277, 78280-78284, 78289-78290, 78292-78293, 78295, 78297-78299, 78301, 78303, 78306-78307, 78310-78311, 78313, 78315, 78318-78319, 78322-78326, 78330-78331, 78335, 78337-78340, 78342-78346, 78348, 78350, 78352-78355, 78357, 78359, 78362-78363, 78366-78367, 78369-78372, 78379, 78381, 78383, 78385-78386, 78388-78391, 78393-78397, 78399-78400, 78402-78403, 78406, 78408-78409, 78411, 78415-78416, 78418-78424, 78426, 78428-78429, 78433-78435, 78437, 78440, 78443-78444, 78446, 78450, 78453, 78455-78458, 78460-78461, 78463, 78466, 78468-78469, 78472-78478, 78480, 78482-78483, 78485-78493, 78496-78497, 78499-78511, 78514, 78519-78521, 78526, 78528, 78530-78535, 78537, 78539, 78541, 78543-78544, 78546, 78548-78554, 78556-78557, 78561-78564, 78566, 78568, 78570-78575, 78577-78578, 78580, 78584-78586, 78589-78591, 78593-78598, 78602-78603, 78606, 78608-78610, 78613-78618, 78620-78625, 78628-78629, 78631-78636, 78638-78641, 78644, 78646-78647, 78650, 78653-78654, 78656-78661, 78663-78664, 78670, 78675, 78677-78680, 78684, 78687, 78689-78691, 78693-78694, 78696-78698, 78700, 78703-78713, 78715-78718, 78720-78722, 78724-78728, 78730, 78732-78733, 78735, 78737-78740, 78742-78743, 78746-78751, 78753, 78756, 78763, 78765-78771, 78773-78775, 78779-78780, 78782-78788, 78790-78791, 78793, 78795-78800, 78803, 78805, 78807, 78809-78825, 78827, 78831-78833, 78835-78844, 78848, 78850, 78852, 78854-78856, 78860-78866, 78868-78873, 78875-78878, 78880-78881, 78883, 78886-78887, 78889-78899, 78902-78904, 78906-78908, 78910-78917, 78919, 78921, 78924-78925, 78928-78931, 78933-78934, 78936-78939, 78941, 78944, 78947, 78949, 78951-78952, 78955-78957, 78960-78966, 78969-78971, 78973-78977, 78980-78988, 78991, 78993-78995, 78999, 79001, 79003-79007, 79009-79010, 79013, 79015-79018, 79020, 79028, 79030-79034, 79036, 79041-79042, 79045, 79047, 79049-79050, 79053-79055, 79058-79061, 79064-79070, 79073-79075, 79077-79082, 79084, 79086-79088, 79090-79114, 79120-79122, 79124-79126, 79130, 79132, 79134-79137, 79139-79144, 79148-79149, 79151-79155, 79157, 79159-79163, 79165-79171, 79173-79174, 79179-79182, 79184-79187, 79190, 79194-79198, 79201, 79205-79207, 79209-79219, 79222-79226, 79228-79230, 79232-79233, 79235-79236, 79241-79243, 79249, 79251-79254, 79257, 79259-79264, 79267-79268, 79270, 79272-79273, 79275, 79279, 79281-79283, 79285-79287, 79289, 79291-79294, 79301, 79307-79308, 79311, 79313, 79315, 79318-79326, 79328-79330, 79333-79338, 79340, 79344, 79347-79350, 79352-79355, 79359-79360, 79362, 79364, 79366-79367, 79369, 79372, 79374-79376, 79379-79382, 79384-79387, 79390, 79393-79395, 79397-79401, 79403-79406, 79409-79414, 79417-79420, 79422, 79424-79425, 79428, 79430-79431, 79434, 79436-79442, 79445, 79447-79448, 79450-79460, 79462-79466, 79470-79476, 79478-79483, 79485-79486, 79488-79494, 79497, 79500-79505, 79509, 79511, 79515-79522, 79524-79526, 79528-79530, 79532-79538, 79541, 79543, 79548-79553, 79555-79562, 79564, 79566-79569, 79571, 79574-79575, 79577-79592, 79594-79597, 79599, 79601-79602, 79605, 79607-79612, 79614-79631, 79633-79647, 79650, 79652-79658, 79660-79665, 79668-79671, 79674, 79677, 79679, 79681-79687, 79690-79691, 79693-79695, 79697, 79699-79700, 79702-79703, 79705-79706, 79708-79715, 79718-79719, 79721-79722, 79724-79729, 79734-79735, 79738-79742, 79744, 79746-79762, 79764-79768, 79772-79773, 79776, 79778-79779, 79782, 79784, 79789, 79791-79792, 79794-79798, 79800-79804, 79806, 79808-79811, 79814, 79816-79820, 79823, 79825-79829, 79831, 79833-79835, 79841-79843, 79845-79850, 79852, 79854-79860, 79863-79866, 79868-79877, 79880-79886, 79890, 79892, 79895, 79897-79901, 79904-79909, 79913, 79915, 79918, 79921-79923, 79925, 79928-79930, 79933-79935, 79937-79942, 79945, 79948-79953, 79955, 79960, 79962, 79966, 79968, 79974-79977, 79979-79980, 79982, 79984-79987, 79989-79994, 79998-80000, 80002, 80004, 80006, 80008-80009, 80011, 80013-80018, 80020-80024, 80026, 80029, 80033-80034, 80036-80038, 80040, 80044-80046, 80048, 80050-80052, 80054, 80058-80060, 80062, 80064-80066, 80068-80069, 80071, 80074-80079, 80081-80085, 80087-80089, 80092-80095, 80097-80106, 80110, 80113-80115, 80117-80118, 80121-80122, 80124-80125, 80131-80132, 80134-80149, 80152-80154, 80157, 80161-80171, 80173, 80175, 80179, 80181-80183, 80188, 80190-80192, 80196-80201, 80203-80204, 80206-80208, 80210, 80216-80219, 80227-80230, 80233-80236, 80239-80240, 80242, 80244-80250, 80252-80253, 80259-80260, 80262-80263, 80265-80266, 80268-80270, 80272-80276, 80279-80282, 80284, 80287, 80289, 80306, 80308-80309, 80311, 80315, 80317-80321, 80326-80327, 80329-80331, 80333-80334, 80336-80337, 80339-80346, 80348-80349, 80352, 80354, 80358-80361, 80364-80375, 80377, 80379-80382, 80384, 80387, 80389, 80391-80395, 80397-80402, 80407-80408, 80414, 80416, 80418, 80420-80439, 80441-80444, 80446, 80448-80449, 80451-80453, 80455-80459, 80463-80464, 80466-80467, 80469-80472, 80474, 80476-80481, 80486-80488, 80494, 80502-80504, 80507, 80509-80510, 80513, 80515-80519, 80530-80539, 80542, 80544, 80547-80555, 80557, 80560, 80562, 80564-80569, 80571-80582, 80591, 80594-80601, 80604-80606, 80608-80610, 80614-80615, 80617, 80619-80620, 80622-80627, 80629, 80631-80635, 80637, 80639-80641, 80644, 80646-80648, 80650, 80652-80654, 80656, 80661-80663, 80665-80667, 80670-80672, 80674, 80676-80677, 80679, 80681, 80683, 80685-80686, 80688, 80690-80693, 80697-80699, 80705, 80710-80711, 80714, 80716-80721, 80727, 80732, 80734-80735, 80737-80738, 80742-80746, 80749-80750, 80752-80755, 80758, 80760-80762, 80764, 80767-80770, 80772, 80775, 80777-80778, 80780, 80785, 80789-80792, 80796-80797, 80801-80803, 80807, 80810-80811, 80813-80816, 80821-80823, 80825-80826, 80829, 80831, 80833, 80835-80842, 80844-80845, 80847, 80850-80852, 80854-80858, 80864, 80866-80867, 80871, 80873, 80875-80876, 80878-80880, 80884-80886, 80890, 80892-80900, 80902-80906, 80908-80915, 80918, 80921, 80923, 80925, 80930, 80932, 80935-80936, 80940-80941, 80952-80953, 80955-80961, 80965-80968, 80971, 80973-80981, 80986-80990, 80992-80993, 80995, 80998-81003, 81005-81007, 81009, 81011-81012, 81015-81017, 81021, 81023-81026, 81028-81036, 81038-81041, 81047-81049, 81051, 81054-81055, 81057-81058, 81063-81065, 81068-81069, 81071, 81074-81075, 81079, 81083, 81085-81101, 81104-81105, 81107-81110, 81112-81114, 81116-81119, 81124, 81128-81130, 81132-81135, 81137, 81139-81140, 81142-81143, 81148-81149, 81151-81152, 81154, 81156-81158, 81160, 81166-81169, 81172-81173, 81175-81178, 81181, 81183-81184, 81186, 81192-81194, 81200-81206, 81208-81209, 81214-81218, 81221-81223, 81225-81226, 81230, 81232-81233, 81235-81237, 81244-81247, 81255-81259, 81261-81272, 81274-81279, 81281-81283, 81285-81290, 81294-81295, 81298-81304, 81306, 81309-81310, 81313, 81315-81317, 81319, 81321-81322, 81324-81332, 81334-81336, 81342-81343, 81345-81346, 81348-81353, 81355, 81358, 81360, 81363-81365, 81368-81369, 81371-81373, 81375, 81379-81383, 81385-81386, 81389-81390, 81393-81396, 81402, 81404, 81411, 81414-81419, 81421-81425, 81428, 81431-81434, 81436-81437, 81439-81444, 81448, 81451-81452, 81455, 81458, 81461-81462, 81464-81470, 81474-81476, 81478-81479, 81481-81484, 81486-81490, 81492, 81495-81497, 81499-81500, 81502-81504, 81507-81509, 81511-81512, 81514, 81522-81524, 81526-81530, 81532, 81534, 81536-81537, 81539, 81542-81543, 81545, 81547-81553, 81556-81558, 81560-81563, 81566, 81568-81569, 81571-81575, 81578-81579, 81582-81586, 81588-81589, 81592-81598, 81601, 81604, 81606-81609, 81615, 81620-81621, 81623, 81627-81629, 81632, 81634-81635, 81640-81641, 81643, 81645, 81647-81652, 81655, 81657-81658, 81660-81661, 81663-81668, 81671, 81675, 81677, 81679, 81681, 81684-81687, 81689-81691, 81693-81694, 81697-81698, 81701-81702, 81704-81705, 81707-81708, 81710, 81712, 81715, 81720-81721, 81724-81727, 81729-81737, 81739-81743, 81745, 81751, 81755-81756, 81758-81760, 81763, 81765-81768, 81770-81774, 81776, 81778-81784, 81788-81791, 81794, 81797-81799, 81801, 81803-81804, 81807, 81810-81811, 81813-81822, 81827-81828, 81830, 81832-81837, 81840-81843, 81845, 81847, 81849, 81854-81855, 81861-81862, 81869-81872, 81875, 81879, 81882, 81887, 81890, 81892-81893, 81900-81913, 81915, 81919, 81925, 81930-81931, 81934-81941, 81945, 81949-81950, 81952-81953, 81955-81962, 81964-81965, 81968, 81970-81971, 81973, 81975-81979, 81981-81982, 81990, 81992, 81997-81998, 82000-82001, 82005-82006, 82010, 82016-82018, 82020, 82024-82028, 82030-82031, 82035, 82038-82039, 82043, 82045-82046, 82049, 82051, 82053-82054, 82056, 82061, 82067-82076, 82078, 82080-82082, 82086, 82089, 82091-82092, 82094-82096, 82099, 82101-82103, 82105, 82107, 82109-82112, 82114-82119, 82122-82124, 82126-82132, 82135-82136, 82139, 82141-82142, 82145-82147, 82149-82153, 82155-82157, 82160-82162, 82164, 82169-82172, 82174-82179, 82182, 82184, 82187-82189, 82191-82197, 82199, 82201-82203, 82205-82207, 82209-82210, 82220-82223, 82226-82236, 82238-82239, 82242-82243, 82245-82250, 82254, 82257-82260, 82262-82266, 82268, 82270-82272, 82275-82277, 82279, 82281-82285, 82287-82288, 82290-82294, 82296-82298, 82302-82303, 82309-82311, 82313, 82315-82317, 82319, 82322, 82324-82326, 82330, 82332-82333, 82335, 82337-82348, 82350-82357, 82360, 82362, 82366-82379, 82382, 82384-82391, 82396-82402, 82404-82409, 82414, 82416, 82418-82419, 82421-82424, 82430-82434, 82436-82440, 82442-82443, 82445, 82447, 82449-82452, 82454-82456, 82461, 82463, 82468-82472, 82474, 82476-82477, 82480-82481, 82486, 82488-82491, 82494, 82497-82498, 82501-82502, 82504-82507, 82509-82514, 82516-82518, 82522-82524, 82527-82528, 82533-82534, 82536, 82538-82539, 82541-82544, 82546, 82549-82550, 82556-82560, 82565-82569, 82574-82578, 82584, 82586-82589, 82591-82607, 82609-82610, 82612-82617, 82619-82622, 82625-82636, 82638-82639, 82641, 82643-82645, 82648, 82651-82657, 82659-82666, 82669-82671, 82673-82677, 82679-82681, 82683, 82686, 82688-82689, 82691, 82697-82704, 82706-82707, 82709, 82711, 82713-82715, 82718-82720, 82723-82725, 82728, 82730, 82732-82734, 82736, 82738, 82740-82745, 82748-82749, 82751-82753, 82755-82760, 82762-82764, 82769-82770, 82772-82773, 82775, 82777-82780, 82784-82791, 82793-82795, 82798-82801, 82803-82807, 82809-82817, 82820-82823, 82825, 82827, 82830-82832, 82835-82841, 82843, 82846-82847, 82849-82857, 82860-82861, 82863-82866, 82869-82870, 82873, 82876, 82880, 82884-82886, 82888-82891, 82893, 82895, 82899, 82901-82902, 82904-82909, 82912-82917, 82919-82924, 82926-82928, 82930-82935, 82939, 82942, 82944-82948, 82950-82951, 82953-82956, 82958-82962, 82965, 82967-82968, 82970-82973, 82975-82978, 82982, 82984-82986, 82988, 82990-82995, 82998, 83000-83003, 83005-83007, 83009-83011, 83013, 83015, 83020, 83023-83025, 83027, 83032, 83035-83038, 83041-83046, 83048-83050, 83052-83055, 83058, 83065-83066, 83068-83072, 83074-83077, 83079-83080, 83085, 83087-83090, 83092-83103, 83105, 83107-83109, 83114, 83117, 83119, 83121, 83123-83125, 83127-83129, 83131, 83133, 83135, 83137-83138, 83140, 83142-83143, 83145, 83148, 83150-83152, 83154, 83157-83160, 83163-83174, 83176-83180, 83186, 83190, 83192-83195, 83197, 83202-83203, 83205-83206, 83208-83209, 83211-83212, 83214-83218, 83220-83223, 83227-83228, 83230-83231, 83233-83234, 83236-83237, 83242-83245, 83247-83248, 83251-83253, 83255-83263, 83265-83267, 83270-83275, 83277-83279, 83282-83288, 83291, 83293-83294, 83297, 83300, 83302-83306, 83309-83311, 83313-83317, 83321, 83324, 83326-83329, 83331, 83334-83341, 83343-83352, 83354, 83356-83361, 83363-83367, 83370-83374, 83376, 83379, 83382-83386, 83388-83397, 83399-83409, 83411-83412, 83415-83416, 83418-83421, 83427-83430, 83432-83433, 83437-83444, 83446, 83448-83449, 83451-83453, 83455-83456, 83458, 83460-83461, 83463-83468, 83470, 83472-83474, 83476-83477, 83479, 83482-83484, 83486-83488, 83494-83495, 83498, 83500-83506, 83508, 83510, 83512-83518, 83520-83522, 83525, 83527-83530, 83532-83533, 83535-83539, 83541, 83545-83547, 83550-83552, 83554-83556, 83558-83559, 83563-83564, 83567, 83571, 83573-83574, 83576, 83578-83580, 83582, 83584-83585, 83587-83589, 83591-83597, 83599-83601, 83603-83604, 83606, 83608-83612, 83615-83617, 83620-83623, 83627, 83630-83634, 83637, 83639-83640, 83644-83646, 83648-83652, 83655-83656, 83658, 83660-83677, 83679, 83681-83682, 83684-83686, 83689, 83691-83699, 83701-83706, 83708-83709, 83712-83723, 83726-83727, 83729-83731, 83734, 83738-83741, 83743, 83747-83751, 83754, 83757, 83760-83767, 83769, 83771-83775, 83777-83778, 83782-83784, 83786, 83788-83793, 83796-83798, 83800-83801, 83803-83812, 83815, 83817-83820, 83822-83824, 83831, 83834-83838, 83840-83845, 83847, 83849-83850, 83854-83855, 83858-83863, 83867-83870, 83873, 83876-83877, 83879-83883, 83885-83889, 83891-83894, 83896, 83900, 83902-83907, 83909-83912, 83915, 83917-83918, 83922, 83924, 83926-83929, 83931-83938, 83940-83943, 83945, 83948-83949, 83951-83954, 83956-83958, 83960, 83962-83966, 83968, 83970-83974, 83977-83981, 83983-83986, 83988-83990, 83993-83995, 83998, 84001, 84004, 84006, 84008-84010, 84012, 84015-84018, 84020, 84022-84023, 84025-84028, 84031-84033, 84037-84038, 84040, 84043, 84045-84047, 84052-84054, 84056-84059, 84061-84075, 84078-84088, 84091-84093, 84095, 84098-84100, 84102-84103, 84108, 84112, 84115-84120, 84124-84132, 84134-84141, 84143, 84145-84160, 84162-84163, 84167-84168, 84170, 84172, 84174-84175, 84177, 84181, 84183-84186, 84188-84189, 84191, 84194-84195, 84198, 84200-84201, 84203-84205, 84207, 84209-84210, 84212, 84214-84216, 84218-84221, 84224-84225, 84227-84228, 84231-84237, 84239-84241, 84246-84250, 84254-84255, 84257, 84260-84262, 84264-84269, 84271-84272, 84275, 84278-84280, 84283-84285, 84287, 84296, 84299-84305, 84309, 84312, 84314-84315, 84317, 84319-84323, 84328-84329, 84340-84342, 84344-84346, 84348-84349, 84354, 84356-84372, 84374, 84376-84380, 84382, 84385-84387, 84390, 84392, 84394-84395, 84397-84404, 84406-84412, 84414-84421, 84423-84428, 84431-84436, 84438-84439, 84441-84442, 84446, 84448-84454, 84457-84461, 84463, 84465-84469, 84472-84476, 84478-84480, 84483, 84485-84487, 84489-84497, 84500-84501, 84507, 84509, 84511-84518, 84520-84522, 84526, 84530-84537, 84539-84540, 84542-84547, 84551-84554, 84556-84558, 84563, 84567, 84569, 84578, 84580-84581, 84583-84584, 84587, 84590, 84592-84596, 84601, 84606, 84610-84611, 84613-84615, 84619-84629, 84631, 84633-84636, 84640, 84643-84654, 84656-84658, 84660-84662, 84666-84671, 84673, 84675-84676, 84678-84680, 84685, 84692, 84694, 84698-84699, 84701-84703, 84705-84707, 84709, 84711, 84713-84724, 84727-84731, 84735, 84737-84740, 84742-84744, 84747-84751, 84753-84756, 84758-84765, 84767, 84770-84774, 84777-84779, 84783-84786, 84788, 84790, 84792-84794, 84796-84800, 84802-84804, 84806, 84811-84819, 84821-84823, 84825-84828, 84831-84832, 84834, 84836-84838, 84840-84843, 84845-84847, 84849, 84851-84857, 84859, 84862, 84865-84870, 84872, 84874, 84876-84880, 84882-84886, 84888, 84890-84894, 84897-84902, 84904-84914, 84917-84919, 84921, 84923-84927, 84929, 84931, 84933, 84937-84944, 84950-84953, 84956-84958, 84960, 84962-84973, 84975-84977, 84979, 84985, 84988-84991, 84993-84997, 85000-85011, 85015-85016, 85021-85022, 85024, 85026, 85028-85034, 85036, 85039-85042, 85045-85047, 85049-85052, 85055-85056, 85058-85059, 85062, 85065, 85071-85072, 85074-85079, 85083-85084, 85086-85087, 85089-85094, 85096, 85107, 85109, 85112-85115, 85119-85121, 85123, 85126, 85128-85130, 85134, 85137-85149, 85151-85154, 85156-85158, 85160-85161, 85164, 85166-85167, 85171-85173, 85177, 85180-85181, 85183-85184, 85186-85187, 85189, 85191-85192, 85194-85196, 85198-85205, 85209, 85211, 85215, 85217-85218, 85220, 85224, 85226-85233, 85237, 85240-85241, 85243-85244, 85246, 85248-85250, 85255, 85257-85261, 85263-85269, 85271, 85273, 85277-85281, 85283-85284, 85286-85287, 85289-85293, 85298-85308, 85310-85311, 85313, 85316, 85318-85322, 85324-85328, 85332-85335, 85337-85339, 85341-85342, 85345-85349, 85351-85360, 85363, 85368, 85372-85377, 85379-85382, 85385, 85388, 85390, 85392-85393, 85395, 85397-85399, 85401, 85404, 85408-85414, 85417-85418, 85421, 85424-85430, 85432-85439, 85441, 85443-85446, 85448-85450, 85452, 85454-85455, 85458, 85463-85465, 85467, 85469-85470, 85472-85474, 85477-85478, 85481-85485, 85487-85497, 85499-85502, 85512, 85514, 85516-85517, 85519-85534, 85536, 85538-85550, 85552-85553, 85558-85560, 85562, 85564, 85567-85571, 85576, 85580-85583, 85585-85590, 85594, 85596-85597, 85599, 85602, 85604-85611, 85613-85614, 85616-85620, 85622, 85625-85628, 85630, 85632, 85634-85635, 85637, 85641-85644, 85646, 85648, 85654, 85656, 85660-85665, 85669, 85672, 85678-85679, 85682, 85689-85692, 85695-85703, 85706-85708, 85710-85713, 85715, 85717, 85720, 85726-85729, 85731, 85733-85734, 85736-85739, 85741-85742, 85744, 85752-85755, 85757, 85759, 85761-85763, 85766-85768, 85770-85771, 85773, 85783-85790, 85793-85796, 85801-85805, 85811-85814, 85818-85819, 85823, 85826, 85828-85829, 85831, 85833, 85835-85836, 85838-85839, 85843, 85845, 85847-85850, 85853-85855, 85862, 85864-85865, 85867-85868, 85870, 85872-85873, 85875-85876, 85878-85880, 85882, 85884-85888, 85890-85898, 85901-85907, 85910-85911, 85913-85914, 85916-85918, 85920-85921, 85925, 85927, 85929-85933, 85935-85940, 85942, 85945, 85947, 85949-85952, 85954-85958, 85960, 85962-85963, 85965-85970, 85972-85973, 85978, 85980-85981, 85983, 85985-85993, 85995-85996, 85998-86005, 86007-86011, 86013-86017, 86019-86020, 86024, 86026-86027, 86031-86033, 86035-86039, 86043-86051, 86057, 86060-86063, 86065-86074, 86076, 86078-86080, 86083, 86087-86094, 86096-86097, 86099, 86102-86108, 86110-86113, 86116-86123, 86125-86128, 86130-86133, 86136-86138, 86140-86146, 86148-86154, 86156, 86158-86159, 86161-86162, 86165-86166, 86168-86170, 86172, 86174, 86176-86179, 86182, 86185-86189, 86192, 86197, 86199-86201, 86205-86208, 86210, 86214, 86216-86218, 86220, 86222-86223, 86225-86226, 86228-86229, 86239, 86241, 86243-86252, 86254-86260, 86262-86264, 86266-86269, 86271, 86273-86278, 86280, 86284, 86288, 86292, 86294-86296, 86298-86302, 86306-86309, 86311-86313, 86315-86323, 86325-86326, 86331-86333, 86335, 86338, 86340, 86343-86344, 86348-86352, 86354, 86356-86358, 86360-86362, 86364-86365, 86368-86369, 86374-86375, 86377-86379, 86381-86387, 86389-86390, 86393-86395, 86399-86400, 86404-86407, 86409-86410, 86412-86413, 86415-86416, 86418-86420, 86422, 86425-86430, 86432-86438, 86440-86441, 86443-86445, 86447, 86449, 86453, 86455-86457, 86459, 86461-86466, 86469, 86471-86475, 86477, 86479-86482, 86484-86487, 86489-86491, 86493, 86497-86500, 86502, 86504-86506, 86508-86515, 86518-86521, 86523, 86525-86526, 86528-86530, 86532-86535, 86538-86543, 86545, 86547-86551, 86553, 86555, 86557-86558, 86560, 86562, 86565-86569, 86572-86573, 86575-86576, 86578, 86580, 86586-86593, 86597-86598, 86601, 86603-86604, 86606-86607, 86609-86611, 86613-86614, 86618-86619, 86621-86625, 86630, 86635-86636, 86642, 86647-86652, 86655, 86657, 86659, 86661, 86665, 86667, 86671-86680, 86682-86683, 86685-86686, 86688, 86692-86699, 86701, 86705-86707, 86709, 86712-86717, 86719, 86721-86727, 86730-86734, 86736-86738, 86742, 86747-86755, 86759-86760, 86764-86766, 86769, 86771, 86773, 86776, 86778, 86780-86782, 86785-86787, 86789-86791, 86793-86794, 86796-86798, 86801-86802, 86805-86806, 86808-86810, 86812, 86816-86821, 86823, 86826, 86828-86831, 86833-86834, 86836, 86839, 86841, 86844-86849, 86856-86862, 86864-86867, 86869-86870, 86872-86873, 86875, 86877-86878, 86880-86884, 86886-86888, 86890-86895, 86897-86901, 86903-86905, 86907, 86909-86911, 86913-86914, 86917-86923, 86930-86932, 86934, 86937-86939, 86941-86947, 86949-86954, 86956, 86959-86960, 86962-86967, 86971, 86973-86974, 86976-86979, 86981-86985, 86988-86990, 86992-86997, 87000-87001, 87003-87004, 87006-87007, 87009-87010, 87012, 87015-87020, 87022, 87025-87028, 87030, 87032-87033, 87035-87044, 87046-87048, 87051-87055, 87057-87060, 87063-87066, 87068-87070, 87072-87077, 87079-87080, 87082-87089, 87091-87100, 87102-87104, 87107-87112, 87114-87117, 87119, 87122-87124, 87126-87127, 87129, 87131, 87134-87136, 87138, 87140, 87143-87145, 87147-87151, 87153-87155, 87157-87160, 87164-87166, 87168-87170, 87172-87179, 87184-87186, 87189-87191, 87193-87194, 87197-87199, 87201-87206, 87209-87210, 87212-87215, 87217-87219, 87221, 87223-87230, 87232-87234, 87241-87248, 87250, 87253-87254, 87256, 87258-87259, 87262-87263, 87265, 87267-87274, 87279, 87281-87282, 87284, 87286-87292, 87294-87296, 87298, 87300, 87302-87303, 87305-87317, 87319, 87322-87323, 87325, 87328-87329, 87334, 87336-87337, 87339, 87341-87342, 87345-87346, 87349, 87353, 87356-87359, 87361-87368, 87370-87375, 87377, 87382-87384, 87387-87388, 87394, 87397-87402, 87405-87406, 87408-87409, 87413-87417, 87420-87421, 87424-87429, 87432-87433, 87435-87437, 87439, 87441-87443, 87447-87453, 87455, 87458-87461, 87463-87465, 87467-87470, 87472-87479, 87481, 87483-87485, 87487-87488, 87490-87491, 87493-87494, 87496, 87499, 87505-87508, 87511-87513, 87515-87519, 87522-87524, 87526-87528, 87532-87540, 87542-87547, 87550, 87552-87553, 87555, 87558-87560, 87562, 87564-87566, 87570, 87572-87575, 87578-87581, 87585, 87587-87588, 87590, 87592-87600, 87602-87605, 87607-87609, 87611, 87615, 87617-87620, 87622, 87624-87632, 87634, 87638-87642, 87645, 87647, 87650-87655, 87658-87675, 87677-87678, 87680-87681, 87684-87685, 87688-87690, 87692, 87694, 87696, 87698-87699, 87701-87702, 87710-87711, 87714-87715, 87717-87721, 87723, 87725-87729, 87731, 87736, 87738, 87742-87744, 87747, 87749, 87751-87754, 87756-87757, 87759-87763, 87765-87767, 87771-87772, 87774-87781, 87783, 87786-87789, 87792-87793, 87795-87801, 87804, 87806-87808, 87811, 87814, 87816, 87819-87828, 87830, 87832, 87837-87840, 87842, 87844-87846, 87849-87852, 87854, 87857, 87860-87868, 87870, 87872-87873, 87877-87885, 87889-87893, 87895-87899, 87901, 87903, 87907, 87909-87910, 87912, 87916-87917, 87919, 87922, 87927-87928, 87931-87932, 87936-87940, 87943-87944, 87946-87952, 87954, 87956-87957, 87960-87963, 87965, 87968, 87970-87976, 87980-87981, 87983-87985, 87987-87993, 87995-87997, 87999-88000, 88002-88005, 88007-88009, 88014-88015, 88019-88020, 88023, 88026-88038, 88041-88047, 88050-88051, 88053, 88055-88056, 88058, 88060-88062, 88067-88068, 88070-88073, 88075, 88078-88079, 88082-88084, 88086, 88089, 88092-88095, 88099-88103, 88107-88114, 88116-88117, 88119-88122, 88124-88127, 88129, 88131-88133, 88135-88139, 88143, 88145, 88147-88148, 88150, 88152-88155, 88158-88159, 88161-88162, 88164-88167, 88169, 88171, 88173, 88176-88178, 88180-88186, 88188, 88190, 88194-88201, 88203, 88206-88208, 88210-88215, 88217-88218, 88220-88225, 88227-88229, 88231, 88233-88234, 88236-88241, 88243-88251, 88253, 88255-88257, 88259, 88263-88270, 88274-88278, 88284-88288, 88290, 88292-88303, 88306, 88308-88310, 88313-88314, 88316-88318, 88321-88331, 88334-88335, 88337-88340, 88348, 88351-88355, 88357-88363, 88366, 88368-88370, 88372-88373, 88376, 88378-88381, 88383-88385, 88388-88389, 88393, 88395, 88397-88398, 88401, 88403-88404, 88406, 88408, 88410-88411, 88413, 88416-88417, 88419-88421, 88423, 88429-88433, 88435-88437, 88439-88443, 88445-88452, 88455, 88457-88458, 88460-88462, 88466-88468, 88470-88476, 88478-88480, 88482, 88484-88488, 88495-88496, 88498, 88500-88501, 88503-88509, 88511-88515, 88517, 88519-88523, 88530, 88532, 88537-88546, 88548-88551, 88553-88557, 88559-88561, 88564-88565, 88569, 88571, 88574-88578, 88583, 88585-88589, 88595, 88601, 88607-88608, 88610, 88613-88616, 88624, 88626, 88628, 88632-88635, 88638, 88641, 88643, 88645-88648, 88650-88651, 88656-88657, 88661-88663, 88667-88672, 88675, 88677-88678, 88680, 88682, 88684-88686, 88689-88698, 88700-88703, 88706-88707, 88715-88716, 88718, 88721-88723, 88725, 88727, 88730, 88733-88735, 88737-88742, 88744-88747, 88750-88751, 88753-88754, 88756, 88758, 88760, 88762-88765, 88767-88768, 88770-88773, 88778-88780, 88782-88788, 88791-88792, 88794-88797, 88800-88802, 88804, 88806-88807, 88810-88813, 88816, 88818-88820, 88822-88827, 88829, 88831, 88833-88837, 88840-88843, 88845-88847, 88849-88852, 88854-88856, 88858-88860, 88865, 88867-88868, 88870-88879, 88885-88890, 88892, 88897, 88899, 88901, 88904-88905, 88907-88913, 88915-88924, 88927-88929, 88932, 88934-88935, 88937-88939, 88941, 88943-88948, 88951-88955, 88957-88958, 88960-88963, 88965, 88967-88968, 88970-88972, 88975-88976, 88978-88980, 88982-88984, 88990, 88994, 88997, 88999, 89001-89006, 89008, 89010-89020, 89022-89030, 89032, 89034-89041, 89043, 89047-89052, 89055-89056, 89058-89060, 89062-89063, 89066-89067, 89069, 89072-89075, 89077, 89079, 89086-89088, 89091, 89093, 89097, 89099-89101, 89103, 89105, 89107-89109, 89111-89116, 89118-89124, 89128-89131, 89133, 89136, 89142-89144, 89147-89149, 89151-89161, 89163, 89166, 89172-89179, 89181, 89184-89186, 89188-89189, 89191-89192, 89194-89201, 89205, 89207-89211, 89213-89216, 89218-89229, 89231-89235, 89238, 89240-89241, 89243-89245, 89247-89248, 89250, 89252-89255, 89257, 89259, 89261, 89263-89264, 89267-89274, 89276-89277, 89281-89284, 89286-89290, 89294-89296, 89298-89299, 89302-89303, 89305, 89307, 89309-89310, 89312-89316, 89320, 89323, 89325, 89327-89328, 89331-89333, 89337-89342, 89346-89347, 89350, 89352-89353, 89356-89357, 89361, 89364-89366, 89369-89370, 89372-89379, 89381-89384, 89386-89391, 89394, 89396-89398, 89400-89401, 89404-89410, 89412, 89414, 89417-89420, 89427-89431, 89436, 89438, 89440-89447, 89449, 89454-89455, 89457-89463, 89472, 89474-89475, 89477-89478, 89480, 89484, 89487-89489, 89491-89497, 89501, 89503, 89507-89509, 89512, 89514-89519, 89521-89524, 89527-89528, 89531-89532, 89534-89539, 89541-89551, 89554-89556, 89563-89565, 89569-89571, 89573-89575, 89578-89589, 89592, 89596, 89598-89600, 89604-89605, 89608, 89613, 89615, 89618, 89620, 89627-89628, 89631-89633, 89637-89641, 89643, 89645-89652, 89654-89659, 89662-89663, 89665-89670, 89672-89675, 89677, 89679-89680, 89683-89686, 89688-89699, 89701-89703, 89705, 89707-89708, 89713-89715, 89717-89720, 89724, 89726-89730, 89732-89738, 89741, 89744, 89749-89750, 89752-89753, 89755, 89757, 89759-89760, 89762-89766, 89768-89771, 89774, 89778, 89781-89783, 89786, 89789, 89791, 89793-89795, 89800, 89802-89804, 89806, 89809, 89812-89815, 89817-89818, 89825, 89828, 89831-89834, 89836-89837, 89842-89844, 89846-89854, 89858, 89860-89862, 89864, 89866-89871, 89874, 89876-89878, 89881-89882, 89888-89890, 89893, 89895, 89898-89899, 89901, 89903-89906, 89908, 89913, 89915-89919, 89921-89922, 89925-89928, 89930, 89932-89934, 89936-89938, 89941, 89944-89946, 89948-89951, 89953, 89955, 89958, 89961, 89964-89968, 89970, 89973-89976, 89979-89985, 89991-89994, 89997-89998, 90001, 90004, 90006-90010, 90012, 90021-90026, 90033-90035, 90038, 90041, 90043-90044, 90047, 90049, 90052, 90056-90058, 90063-90066, 90069-90071, 90073, 90076, 90078, 90082-90083, 90085, 90087, 90089-90094, 90097, 90103, 90106-90109, 90113-90114, 90116-90117, 90119-90122, 90125, 90130-90131, 90133, 90135, 90139-90140, 90145, 90147, 90150-90157, 90159-90161, 90163-90165, 90168-90169, 90171-90176, 90178-90180, 90182, 90184-90187, 90195-90197, 90199-90203, 90205-90217, 90219-90222, 90228-90232, 90234, 90236, 90240-90246, 90248-90250, 90252-90253, 90257-90270, 90272-90274, 90276, 90278, 90280, 90284-90286, 90288-90291, 90294-90299, 90301-90307, 90309, 90311, 90314-90315, 90317, 90321-90332, 90334, 90336, 90339-90342, 90346-90350, 90353-90354, 90356, 90359-90360, 90362-90366, 90368, 90370, 90373-90374, 90376, 90378-90381, 90383-90387, 90394-90397, 90399-90403, 90405-90407, 90410-90411, 90414, 90420-90422, 90429-90443, 90445-90446, 90451, 90453, 90457-90459, 90461, 90463-90466, 90470-90471, 90473, 90477, 90480-90482, 90485-90490, 90492, 90498-90499, 90503-90506, 90508-90513, 90515, 90517, 90519, 90521-90524, 90527, 90530, 90532, 90534, 90536, 90539, 90541, 90544-90545, 90547-90551, 90553-90555, 90557-90560, 90562, 90564-90567, 90571, 90579, 90581-90583, 90586, 90588, 90590-90595, 90597-90601, 90605-90606, 90608, 90610, 90613, 90616-90617, 90621-90624, 90626-90630, 90632, 90634, 90637-90638, 90640, 90642-90643, 90647, 90649-90650, 90652, 90654, 90658-90659, 90661-90662, 90665-90666, 90668-90669, 90671-90673, 90675-90680, 90682, 90684-90688, 90690, 90693-90696, 90698, 90700-90705, 90707-90709, 90711-90716, 90718, 90720-90724, 90727-90730, 90732-90735, 90739-90740, 90743-90744, 90747-90750, 90753-90754, 90759-90760, 90762, 90764-90767, 90770-90771, 90773-90774, 90776-90777, 90782, 90786-90791, 90793, 90796-90797, 90800-90801, 90804-90805, 90807-90813, 90815-90816, 90818-90819, 90823, 90825-90829, 90831-90835, 90837, 90839-90844, 90846, 90848-90850, 90853-90857, 90859, 90862, 90864-90868, 90870-90873, 90875-90879, 90882, 90889, 90892-90895, 90897-90901, 90903-90904, 90906-90907, 90909-90912, 90914, 90917, 90922-90924, 90926, 90928, 90930-90931, 90933, 90936-90941, 90943, 90945, 90948, 90950-90953, 90955-90956, 90958-90960, 90962-90964, 90966-90971, 90973, 90975, 90977-90978, 90980-90981, 90983, 90985, 90987, 90989-90991, 90994, 91000-91003, 91008-91012, 91014, 91022-91027, 91029-91030, 91032-91033, 91035-91040, 91043-91045, 91047-91048, 91052-91054, 91056-91058, 91062, 91067, 91070-91073, 91077, 91079-91094, 91096-91098, 91101-91104, 91106, 91108-91113, 91116, 91119-91120, 91122-91124, 91126-91127, 91129-91130, 91132-91133, 91135-91137, 91140-91141, 91145, 91147, 91149-91151, 91153-91158, 91161-91162, 91164, 91166-91167, 91171-91172, 91174-91178, 91180-91186, 91189-91192, 91195, 91199-91200, 91203-91204, 91206, 91208-91210, 91212-91214, 91216, 91218-91220, 91222-91224, 91226-91228, 91230-91233, 91236, 91238, 91240-91241, 91243, 91245-91246, 91249-91251, 91254-91256, 91258-91260, 91262-91266, 91269, 91272, 91276, 91278-91279, 91281-91283, 91285, 91287, 91289, 91293-91295, 91299, 91303-91306, 91310-91313, 91315-91316, 91319, 91321-91323, 91326, 91328-91329, 91331-91334, 91337-91339, 91342, 91345-91350, 91352-91353, 91355-91367, 91370, 91372-91374, 91376, 91378, 91381-91383, 91385-91389, 91391-91392, 91394-91395, 91397-91401, 91408-91409, 91411-91412, 91415, 91419, 91422-91425, 91427, 91429-91430, 91435, 91439-91454, 91456-91466, 91468, 91471-91473, 91475, 91479-91480, 91482-91485, 91487-91490, 91493-91494, 91496-91497, 91501-91503, 91506-91508, 91511-91513, 91517, 91519-91524, 91526, 91529-91530, 91534, 91536, 91538, 91540-91548, 91555-91557, 91559, 91561, 91564, 91566-91567, 91569-91570, 91572-91574, 91576, 91579, 91582, 91584, 91587-91590, 91596, 91602-91604, 91606-91613, 91615-91621, 91623-91624, 91632, 91634-91635, 91637, 91639-91646, 91648-91650, 91653-91656, 91659-91660, 91662, 91665-91668, 91671, 91673-91674, 91676, 91680-91681, 91683-91684, 91686-91688, 91690, 91695-91700, 91702-91707, 91710, 91714, 91716-91720, 91722-91726, 91729, 91731, 91733-91736, 91738-91743, 91745, 91750-91752, 91754-91755, 91758-91759, 91761-91765, 91767, 91769-91782, 91784-91793, 91798-91804, 91806-91807, 91809-91811, 91813-91816, 91818-91821, 91824, 91828, 91830, 91833, 91835, 91837-91842, 91844-91846, 91848-91850, 91852-91853, 91855-91856, 91858-91868, 91870-91871, 91874-91878, 91880, 91882-91883, 91885-91888, 91890, 91892, 91894, 91896, 91898-91905, 91907, 91909-91912, 91914-91915, 91917-91918, 91920-91922, 91925-91929, 91932-91938, 91940, 91943-91944, 91947, 91950-91951, 91953-91955, 91957-91958, 91960-91962, 91964-91966, 91968-91981, 91984-91986, 91988-91989, 91991-91994, 91996-91997, 91999-92002, 92004-92005, 92008, 92013-92016, 92018, 92022, 92024-92025, 92040, 92043, 92045, 92049-92051, 92055-92058, 92062-92063, 92065-92066, 92068-92070, 92072-92074, 92076, 92080, 92082-92088, 92093, 92096-92097, 92099-92101, 92103-92105, 92107-92110, 92112, 92116-92119, 92122, 92124-92125, 92127-92133, 92136, 92138, 92140-92145, 92147-92150, 92153-92160, 92162, 92164-92165, 92167-92168, 92170, 92172-92174, 92176, 92179-92180, 92185, 92187, 92189-92192, 92199-92200, 92202, 92204, 92206-92207, 92209-92211, 92213-92214, 92216, 92218-92219, 92221, 92223-92224, 92226-92227, 92229-92230, 92233-92240, 92243, 92245-92250, 92252-92254, 92263, 92265-92266, 92269-92270, 92272, 92277, 92279-92280, 92283-92287, 92289-92291, 92293, 92298-92300, 92302-92303, 92305-92306, 92310, 92315-92318, 92326-92328, 92330-92332, 92334-92335, 92341-92344, 92346, 92348-92350, 92352, 92359-92361, 92366-92368, 92370-92372, 92374, 92379-92383, 92386-92387, 92393-92402, 92405-92407, 92410-92418, 92420-92423, 92425, 92429-92430, 92432-92434, 92438, 92440, 92442-92444, 92446-92447, 92449-92454, 92457-92459, 92465, 92468, 92473-92477, 92479, 92482, 92484, 92486-92487, 92489-92491, 92493, 92496-92500, 92502-92506, 92508-92511, 92513, 92516-92521, 92523, 92525-92527, 92530, 92532-92533, 92535-92537, 92539-92540, 92542-92543, 92545-92547, 92549-92559, 92561-92563, 92566, 92568-92571, 92573-92576, 92578-92579, 92581-92582, 92586-92588, 92590, 92592-92593, 92595-92597, 92600, 92603-92604, 92606-92611, 92613-92615, 92617-92619, 92621-92622, 92624-92625, 92628-92632, 92635, 92638, 92641, 92644-92651, 92653, 92655, 92657-92660, 92663-92665, 92671-92672, 92676, 92678-92683, 92685, 92687-92688, 92690-92693, 92696-92697, 92699-92701, 92704-92706, 92708-92713, 92717, 92721, 92726, 92731-92735, 92737-92741, 92745, 92749, 92755-92756, 92758, 92760, 92764-92767, 92769-92777, 92779, 92781-92787, 92791, 92793-92795, 92797-92799, 92801, 92805-92808, 92811, 92815-92818, 92821, 92825-92834, 92836-92838, 92840, 92845-92847, 92851, 92853-92854, 92856-92857, 92859-92860, 92862-92876, 92879-92880, 92885, 92889-92890, 92892-92896, 92898, 92902, 92904, 92906-92909, 92911, 92913-92915, 92917, 92920, 92923, 92927-92934, 92936, 92939, 92941-92946, 92948, 92951, 92953, 92958-92963, 92965-92968, 92971-92974, 92976-92983, 92986, 92989, 92991-92996, 92998, 93001, 93003-93005, 93007, 93009, 93011-93013, 93016-93017, 93019-93021, 93024-93025, 93027-93028, 93031-93037, 93039-93042, 93044, 93047-93048, 93050-93054, 93056, 93058-93059, 93061, 93063-93068, 93070-93074, 93076, 93078-93082, 93090, 93093-93095, 93097-93098, 93100-93101, 93103, 93105, 93109, 93112, 93117-93118, 93120-93124, 93126-93141, 93143, 93145-93152, 93155-93160, 93162-93164, 93166-93169, 93171-93175, 93177, 93179-93193, 93196-93198, 93201-93203, 93210-93213, 93215-93222, 93224-93229, 93232-93235, 93237-93247, 93250-93253, 93255, 93257, 93259-93260, 93263-93264, 93266, 93269-93273, 93275, 93278-93281, 93284, 93287, 93289, 93292-93301, 93303, 93305-93306, 93308-93312, 93314, 93317-93318, 93324, 93326-93330, 93333-93335, 93337-93338, 93340-93341, 93343-93348, 93351-93353, 93358, 93360, 93363, 93366-93367, 93370, 93377-93379, 93381, 93384-93386, 93389-93390, 93392, 93396-93404, 93406, 93408-93416, 93418-93434, 93436-93437, 93443-93451, 93454-93455, 93459, 93461, 93463-93471, 93477, 93482-93483, 93485, 93489-93494, 93499, 93501-93505, 93507-93508, 93514-93515, 93517-93520, 93522-93527, 93529, 93531, 93537, 93540-93541, 93544, 93546-93554, 93559-93565, 93567, 93569, 93572, 93574-93582, 93587-93588, 93591-93594, 93596-93597, 93600-93602, 93604, 93607-93613, 93615-93616, 93618-93619, 93622, 93624-93630, 93632-93633, 93635, 93637, 93639-93640, 93642-93645, 93647-93648, 93651-93653, 93655-93657, 93659-93663, 93665-93668, 93670-93675, 93678-93681, 93683-93684, 93686, 93689-93690, 93692, 93696-93697, 93699-93701, 93703, 93705-93707, 93709, 93713, 93717-93724, 93729, 93731, 93734, 93743-93745, 93747, 93749-93756, 93758-93759, 93762, 93764-93767, 93769-93770, 93772-93775, 93778-93779, 93781, 93783, 93786, 93788-93791, 93796-93797, 93799, 93804-93805, 93809, 93813-93815, 93817, 93821, 93823, 93826, 93829, 93831-93834, 93837-93839, 93843-93850, 93856-93857, 93859, 93863, 93867-93868, 93870-93874, 93877-93883, 93886, 93888, 93890-93892, 93895-93903, 93905, 93908-93915, 93917-93921, 93923-93925, 93929-93930, 93932, 93934, 93942-93943, 93949, 93951-93952, 93955, 93957-93964, 93966-93974, 93976-93977, 93979, 93981-93982, 93984, 93987, 93989-93990, 93992-93993, 93995, 93997, 93999-94001, 94003-94005, 94007-94012, 94014-94017, 94020-94021, 94023-94037, 94039, 94041-94056, 94058, 94060-94063, 94065, 94067-94070, 94072, 94074, 94076-94077, 94080, 94083-94088, 94090, 94092-94098, 94101-94102, 94104, 94107-94109, 94111, 94113, 94116-94117, 94119-94120, 94122-94123, 94126-94129, 94131, 94135-94136, 94138, 94140-94141, 94144-94147, 94149-94150, 94152-94154, 94157-94159, 94161-94166, 94168-94171, 94173, 94176-94178, 94180-94189, 94191, 94193-94195, 94197, 94199-94205, 94207, 94209-94210, 94212, 94214, 94216-94218, 94220, 94223-94224, 94227-94234, 94236, 94240, 94242-94246, 94251-94253, 94255, 94258-94260, 94262-94265, 94267-94271, 94273, 94275-94280, 94282-94285, 94287-94288, 94290-94294, 94296-94302, 94304-94305, 94307-94308, 94310-94315, 94317, 94319-94321, 94326-94327, 94329, 94331-94333, 94336-94342, 94344, 94348-94351, 94353-94355, 94357, 94360-94365, 94367-94373, 94375-94376, 94378, 94382-94390, 94400-94409, 94412-94413, 94415-94416, 94420-94426, 94428, 94430-94436, 94438-94440, 94442, 94444, 94447-94449, 94455, 94457-94460, 94463, 94466-94467, 94469-94472, 94476, 94480-94482, 94484, 94486, 94488-

94489, 94491-94492, 94495-94498, 94506-94510, 94512, 94515-94516, 94518-94525, 94527, 94530-94533, 94539, 94541-94543, 94546-94549, 94551, 94553, 94555-94557, 94560, 94562, 94564, 94566-94567, 94569-94571, 94573-94576, 94578, 94580-94582, 94584-94586, 94588, 94590-94591, 94593, 94596, 94598-94599, 94601, 94604-94605, 94608-94615, 94617-94619, 94623-94625, 94629-94632, 94635, 94637-94639, 94641-94650, 94654-94663, 94666-94667, 94669-94673, 94675-94677, 94679, 94682-94684, 94686-94690, 94693-94694, 94697-94699, 94702-94703, 94705-94708, 94711-94717, 94724-94725, 94729-94731, 94733-94736, 94739, 94741-94749, 94751-94753, 94755, 94759, 94761-94762, 94765-94766, 94768-94772, 94775, 94781-94783, 94785-94786, 94788, 94790-94792, 94796-94797, 94804, 94809-94812, 94814-94824, 94826, 94828, 94830, 94832-94834, 94836-94839, 94841, 94844-94846, 94850-94856, 94858-94860, 94862, 94864-94865, 94869, 94872-94874, 94876, 94878-94881, 94884-94888, 94896-94897, 94899, 94901-94905, 94909-94910, 94913-94918, 94920-94921, 94924-94928, 94930-94936, 94938-94942, 94944-94947, 94949, 94952-94958, 94962-94964, 94966-94968, 94970-94972, 94974-94975, 94977-94981, 94983, 94985, 94987, 94989-94994, 94997-95001, 95003-95007, 95021, 95024, 95026-95030, 95032-95038, 95041, 95043-95047, 95049-95050, 95052-95054, 95060-95067, 95070, 95072-95079, 95081-95085, 95087-95088, 95090-95092, 95094-95096, 95098, 95106, 95108-95109, 95111, 95113-95114, 95116, 95118, 95121, 95124, 95126-95129, 95132-95134, 95136-95137, 95142-95145, 95150-95151, 95153-95156, 95158, 95160-95161, 95163, 95165-95169, 95172-95179, 95181, 95183, 95185, 95188, 95190, 95193-95196, 95198-95200, 95202-95204, 95206, 95211, 95213, 95215, 95218-95221, 95229-95234, 95238, 95243-95244, 95246-95256, 95258-95271, 95273-95274, 95276, 95278-95283, 95289, 95291-95292, 95295, 95299-95302, 95305-95311, 95313-95314, 95316, 95318-95322, 95326-95327, 95329-95331, 95333, 95335-95342, 95345-95347, 95352-95355, 95357-95359, 95361-95365, 95367, 95370, 95372-95374, 95376, 95378-95379, 95381, 95385, 95388-95389, 95391, 95395-95402, 95406, 95409, 95411, 95413-95416, 95419-95420, 95422-95423, 95425-95426, 95428-95433, 95435, 95437, 95440, 95443, 95448, 95452-95454, 95457, 95460-95462, 95467, 95469-95470, 95472-95474, 95479, 95482, 95486-95489, 95492-95497, 95499, 95502, 95504, 95506-95508, 95510, 95513, 95516-95520, 95522-95523, 95526, 95528-95534, 95536, 95538-95540, 95542, 95544-95547, 95549, 95551-95554, 95556, 95558-95562, 95565, 95568-95571, 95573-95577, 95579-95583, 95589-95594, 95596-95599, 95601-95604, 95608-95609, 95611-95613, 95618-95620, 95622-95623, 95628-95634, 95636-95641, 95644-95647, 95652-95653, 95655-95657, 95659, 95661-95662, 95664-95670, 95672, 95675, 95677-95679, 95681, 95683, 95685-95687, 95689-95693, 95695, 95697, 95699-95703, 95705, 95707, 95709, 95711-95712, 95715-95718, 95723, 95725, 95728, 95731-95732, 95736-95737, 95739-95740, 95742-95743, 95745-95747, 95749-95752, 95756, 95761, 95766, 95772-95774, 95778, 95782-95787, 95789-95791, 95796-95799, 95801-95802, 95805-95807, 95809, 95812, 95821, 95824-95826, 95836-95838, 95841-95847, 95850, 95852-95855, 95857-95859, 95861-95865, 95868, 95870, 95872, 95874-95877, 95880-95883, 95885, 95888-95889, 95891-95892, 95894, 95896-95900, 95903, 95909-95912, 95916-95920, 95922, 95925, 95927-95938, 95940-95941, 95943-95944, 95946-95947, 95951, 95955-95960, 95962, 95965-95966, 95968-95969, 95973-95976, 95981-95987, 95989-95991, 95995, 95997-95998, 96000, 96003-96004, 96006-96007, 96009-96018, 96020, 96022-96025, 96029-96032, 96035-96036, 96038, 96042, 96044-96049, 96051, 96053-96055, 96058-96060, 96062-96067, 96069, 96072-96075, 96077, 96080-96082, 96086, 96089-96091, 96093-96099, 96102-96107, 96111-96114, 96116-96120, 96124-96125, 96127, 96134, 96136-96142, 96144-96146, 96149-96152, 96154-96155, 96157-96163, 96167-96175, 96177, 96179-96189, 96192-96194, 96196, 96198-96201, 96203-96205, 96207-96208, 96211-96219, 96227-96230, 96233, 96237, 96239-96242, 96244, 96247, 96251-96252, 96255, 96258, 96261-96262, 96264-96266, 96268, 96270, 96282, 96286-96288, 96291, 96295, 96298, 96300, 96303-96306, 96312-96318, 96320, 96322, 96327, 96330, 96332-96335, 96342, 96344-96347, 96349, 96351, 96353, 96355-96356, 96358, 96360-96361, 96364-96366, 96369, 96371, 96373-96374, 96379, 96381-96383, 96385-96390, 96392-96395, 96398, 96400-96403, 96405, 96407-96408, 96410-96411, 96413-96417, 96420-96423, 96426-96429, 96431, 96433, 96435-96436, 96438-96441, 96445-96461, 96468-96469, 96471-96473, 96477, 96479-96480, 96484-96488, 96492-96495, 96497-96499, 96502, 96504-96505, 96507-96512, 96514-96517, 96519-96527, 96531-96532, 96535, 96537-96540, 96542-96543, 96545-96546, 96548, 96551, 96554-96555, 96560-96561, 96563-96566, 96568-96575, 96577, 96579-96582, 96585-96586, 96590-96597, 96600-96603, 96605-96609, 96611-96612, 96615, 96617, 96619, 96621, 96628-96630, 96632-96636, 96638, 96642-96646, 96648-96649, 96651, 96653-96660, 96664-96665, 96669-96675, 96677-96690, 96692-96700, 96702-96706, 96709, 96711, 96713, 96715-96718, 96720-96721, 96723, 96725, 96728-96735, 96738-96741, 96744-96757, 96759-96760, 96762, 96764-96766, 96768, 96770, 96772, 96775-96780, 96783-96786, 96788-96789, 96791-96801, 96803-96807, 96809, 96815, 96818-96820, 96822-96823, 96825-96836, 96839, 96843-96844, 96846-96847, 96849-96850, 96852-96856, 96858-96864, 96868, 96871-96874, 96876-96878, 96880-96881, 96883-96884, 96886, 96888-96889, 96891-96893, 96895-96896, 96898-96899, 96902-96904, 96906-96907, 96911, 96913-96914, 96916-96918, 96920-96921, 96923, 96925-96932, 96934-96938, 96940-96941, 96943, 96946, 96949-96950, 96953, 96959, 96966-96972, 96976-96977, 96980-96986, 96988, 96991, 96993-96997, 96999-97000, 97002-97005, 97007-97009, 97011, 97013, 97015-97016, 97018, 97022-97023, 97025-97026, 97028, 97033-97037, 97041, 97045-97053, 97055-97060, 97063-97066, 97072, 97074-97076, 97078-97080, 97082, 97084, 97086, 97088-97089, 97091-97092, 97095, 97100-97102, 97107-97108, 97110-97117, 97122-97130, 97132-97133, 97135, 97137-97138, 97140, 97145-97152, 97154, 97157-97159, 97161-97167, 97169, 97172-97173, 97175, 97177-97182, 97185, 97188-97189, 97192, 97194-97200, 97203, 97205-97209, 97211, 97213-97218, 97220, 97222-97223, 97225-97226, 97229-97232, 97236-97243, 97245-97251, 97253-97256, 97258-97259, 97261-97263, 97265-97269, 97271-97272, 97274, 97276-97278, 97281-97282, 97284-97286, 97288-97291, 97293-97294, 97297, 97301, 97304-97306, 97308, 97310, 97312-97317, 97320-97321, 97323, 97326-97329, 97332, 97334-97336, 97340-97341, 97343, 97346-97347, 97349, 97351, 97353, 97355, 97357-97358, 97360, 97363, 97365-97368, 97372-97374, 97381-97383, 97385, 97387, 97389-97390, 97392-97397, 97400-97401, 97403-97404, 97409-97410, 97413-97418, 97425-97427, 97429-97431, 97434-97438, 97441-97443, 97445, 97447, 97453, 97455-97464, 97469-97472, 97475-97476, 97478-97484, 97487-97489, 97492-97500, 97503-97505, 97508-97509, 97511-97517, 97524, 97526-97530, 97536-97545, 97547-97548, 97553, 97555-97561, 97563-97564, 97566-97567, 97573-97574, 97576-97578, 97582, 97584, 97586, 97588-97593, 97597-97603, 97605-97606, 97609, 97611, 97613, 97615, 97617-97620, 97622-97625, 97627, 97629-97633, 97635, 97637-97638, 97642, 97645-97647, 97649-97653, 97656-97657, 97659-97661, 97663-97664, 97666-97667, 97669-97674, 97677-97682, 97688, 97690, 97693, 97695, 97697-97699, 97701-97703, 97708-97712, 97715-97720, 97722, 97724-97736, 97738-97757, 97759-97761, 97764, 97766, 97771-97777, 97779-97782, 97785-97787, 97790, 97792-97800, 97802-97807, 97810, 97812-97815, 97817-97825, 97827-97828, 97831-97833, 97835, 97838-97839, 97841-97843, 97845-97855, 97857-97861, 97864-97867, 97869, 97872-97879, 97881-97882, 97884, 97886-97887, 97889-97890, 97892, 97895-97908, 97910, 97912-97916, 97918-97921, 97924-97932, 97934-97940, 97942, 97944, 97947-97950, 97952-97955, 97959, 97961-97964, 97966-97967, 97970-97972, 97974-97977, 97979-97982, 97984, 97986, 97988-97990, 97992, 97994-97995, 97997-98000, 98002, 98005-98009, 98011-98012, 98014, 98016-98021, 98023-98024, 98027, 98032-98037, 98040, 98042-98052, 98054-98055, 98057-98061, 98066, 98068, 98070, 98072-98074, 98076, 98078, 98080-98082, 98085, 98087-98092, 98097-98109, 98111, 98117-98118, 98121-98128, 98130-98131, 98137, 98139, 98142-98149, 98151-98153, 98155, 98158-98163, 98165-98169, 98172-98174, 98176-98181, 98183, 98187-98190, 98192-98195, 98197, 98199-98201, 98203, 98205-98206, 98209-98217, 98220-98224, 98226-98229, 98231, 98233, 98236-98238, 98240-98242, 98245-98248, 98251, 98255-98258, 98260-98263, 98265, 98267-98268, 98270-98272, 98275, 98279-98280, 98282, 98284, 98289-98296, 98299-98301, 98303, 98308-98318, 98320, 98322-98323, 98326, 98328-98329, 98331-98333, 98335, 98337, 98339, 98343-98346, 98348, 98350, 98352-98356, 98359-98360, 98362-98364, 98366-98369, 98371, 98373, 98378, 98380, 98382-98385, 98388, 98392, 98395, 98398-98401, 98403, 98406-98412, 98414, 98416, 98418-98419, 98422-98423, 98425-98426, 98428, 98436-98438, 98440-98445, 98447-98449, 98451, 98454-98456, 98458-98461, 98463, 98466-98467, 98471, 98474, 98477-98480, 98483-98486, 98489, 98493-98495, 98497-98498, 98500-98501, 98503-98504, 98506, 98510, 98512, 98514, 98517, 98519, 98521-98523, 98525, 98527, 98530, 98533, 98535-98539, 98541-98544, 98549-98556, 98558-98559, 98563, 98567-98571, 98574-98577, 98581-98585, 98587, 98589-98590, 98593-98598, 98600-98608, 98617-98623, 98625, 98627-98628, 98630-98631, 98634, 98636, 98638-98639, 98642-98646, 98648-98657, 98659, 98661-98667, 98670, 98672, 98675, 98680-98681, 98684-98686, 98689-98690, 98692, 98694-98696, 98698-98702, 98704-98711, 98713-98714, 98716-98717, 98723, 98726-98729, 98733-98734, 98736-98738, 98740, 98743, 98747, 98750-98752, 98760-98762, 98764, 98766-98773, 98775-98778, 98780-98792, 98795, 98797-98801, 98803, 98806-98809, 98811-98812, 98814-98816, 98821-98824, 98826-98827, 98829-98830, 98832-98833, 98835-98840, 98844, 98846-98848, 98850, 98853-98855, 98857-98860, 98862-98863, 98865, 98868, 98870-98876, 98878-98882, 98884, 98886, 98888, 98894, 98896-98898, 98903, 98905, 98907, 98909, 98911, 98913-98914, 98917-98920, 98925, 98928-98929, 98931, 98933-98934, 98937-98941, 98943-98946, 98953-98962, 98965-98967, 98969-98974, 98976-98977, 98981-99003, 99008-99013, 99017-99021, 99024-99026, 99028-99030, 99032-99033, 99041, 99043-99050, 99052-99055, 99058-99062, 99065-99066, 99068-99069, 99071-99074, 99076, 99080-99081, 99083, 99085, 99088-99089, 99091-99092, 99094, 99096-99099, 99101-99103, 99105, 99108-99109, 99111-99123, 99127, 99129, 99132-99133, 99135, 99138, 99140-99141, 99143-99145, 99151-99154, 99156, 99158-99161, 99164-99167, 99169, 99172, 99175-99176, 99183, 99185-99190, 99194-99195, 99197-99198, 99200, 99203-99204, 99206, 99208-99213, 99215, 99217-99221, 99225-99230, 99232-99233, 99236, 99238-99241, 99244-99245, 99247-99248, 99250-99251, 99253-99258, 99260-99261, 99263-99265, 99268, 99271, 99273-99277, 99279-99280, 99282, 99285-99286, 99288-99292, 99295-99296, 99298, 99301-99302, 99304-99305, 99308, 99312-99322, 99326-99330, 99332, 99335, 99337-99340, 99342, 99344-99351, 99354-99356, 99358-99368, 99370-99373, 99375-99379, 99381-99382, 99384-99387, 99389-99390, 99392-99396, 99398-99401, 99404-99405, 99407-99417, 99420-99422, 99424-99428, 99431-99434, 99437-99441, 99443-99444, 99448-99451, 99453-99464, 99468, 99472, 99474, 99476-99480, 99482-99485, 99488-99491, 99494-99498, 99500, 99502-99504, 99509, 99512-99515, 99517-99523, 99526, 99528, 99530, 99532, 99539-99541, 99545, 99549-99550, 99552, 99554-99555, 99558-99559, 99562, 99565-99567, 99569, 99571-99573, 99575-99578, 99580-99582, 99584-99585, 99587, 99589, 99593, 99597-99600, 99602-99605, 99607-99609, 99611, 99613, 99615-99619, 99621-99624, 99626-99628, 99631-99632, 99634-99644, 99646, 99649-99650, 99652, 99654-99655, 99657-99659, 99661-99667, 99669, 99671, 99674-99679, 99682, 99684-99688, 99691-99693, 99696, 99698-99699, 99702-99711, 99716-99724, 99726, 99731, 99733, 99735-99736, 99738-99743, 99745-99752, 99754-99757, 99759-99760, 99762-99763, 99765, 99769-99781, 99783, 99785-99786, 99788, 99793-99799, 99801-99802, 99804, 99807, 99809-99814, 99816-99817, 99821-99822, 99824-99828, 99830-99833, 99835-99839, 99841-99844, 99846-99847, 99852-99854, 99856-99863, 99865-99877, 99879-99886, 99888-99889, 99891-99893, 99895-99905, 99908-99909, 99911-99913, 99916-99922, 99926-99927, 99929-99931, 99933-99938, 99942-99946, 99949-99955, 99957, 99959-99960, 99962, 99964-99973, 99976-99989, 99992, 99994-99995, 99998, 100000-100013, 100016-100018, 100022-100024, 100027, 100029-100030, 100033-100034, 100036-100042, 100044, 100046-100055, 100057-100061, 100063-100064, 100066-100069, 100071, 100073-

100074, 100078-100079, 100082, 100084, 100086-100088, 100090, 100094-100106, 100108, 100111, 100113, 100115-100116, 100119-100122, 100126-100129, 100131-100132, 100134-100135, 100137-100144, 100147, 100150, 100152-100160, 100169-100170, 100174-100176, 100178, 100180-100181, 100183-100184, 100188-100190, 100192-100193, 100195-100201, 100203-100204, 100208-100210, 100212, 100214-100215, 100217-100220, 100222-100223, 100225-100232, 100236, 100241, 100244-100246, 100249-100253, 100256-100259, 100264, 100266-100267, 100269-100271, 100275-100276, 100281-100287, 100294, 100299-100301, 100304-100307, 100309-100310, 100312-100313, 100316, 100318-100319, 100323, 100325-100328, 100330, 100332, 100334-100335, 100349-100350, 100354, 100357-100361, 100364-100365, 100369, 100373, 100376-100377, 100380, 100387, 100389, 100393-100396, 100398, 100400-100403, 100408-100410, 100412, 100415-100416, 100419-100420, 100422, 100426, 100430-100431, 100433-100435, 100438-100442, 100444-100445, 100448-100452, 100454-100457, 100459-100464, 100474-100478, 100480-100482, 100487, 100489-100492, 100494-100496, 100500-100504, 100508, 100510-100513, 100515-100516, 100518-100519, 100523-100526, 100528-100534, 100537-100541, 100543, 100545-100549, 100553-100556, 100558, 100560-100561, 100563-100567, 100569, 100571-100574, 100576-100580, 100582, 100584-100587, 100591-100593, 100595, 100597-100600, 100602, 100604-100608, 100610, 100612-100613, 100617, 100619, 100621, 100624, 100626-100628, 100631, 100633-100635, 100639, 100642-100647, 100650, 100657-100658, 100660, 100662, 100664-100673, 100676, 100679, 100681, 100684-100687, 100690-100702, 100708, 100710-100711, 100713, 100715-100725, 100728-100733, 100736-100737, 100739, 100741-100742, 100744-100747, 100749, 100751, 100757-100758, 100761-100762, 100764-100771, 100775-100776, 100778, 100780-100783, 100787, 100791-100794, 100797-100804, 100808-100812, 100814-100815, 100823-100824, 100826-100827, 100831, 100833-100834, 100836, 100838, 100841-100842, 100845, 100848-100855, 100860-100869, 100873-100878, 100880-100883, 100886-100888, 100890-100892, 100895-100896, 100898-100900, 100902, 100904, 100912-100913, 100916-100918, 100920, 100922, 100924-100925, 100929, 100932, 100939, 100942-100944, 100947, 100951-100954, 100957, 100959-100962, 100964-100968, 100970, 100973-100977, 100980, 100982-100983, 100989-100992, 100997, 101003-101007, 101009-101014, 101016-101023, 101027-101034, 101038-101039, 101041, 101045-101046, 101049-101053, 101055-101061, 101065-101067, 101069-101071, 101073, 101075-101077, 101080-101082, 101085, 101087-101092, 101095-101096, 101099-101111, 101115, 101123, 101125-101126, 101128-101131, 101133-101137, 101139-101140, 101142, 101144-101145, 101147, 101149-101155, 101157-101166, 101168-101171, 101173, 101176-101180, 101184, 101186-101190, 101192-101193, 101196-101199, 101202-101208, 101210, 101213, 101222, 101224-101227, 101232-101237, 101241-101242, 101246, 101249, 101255-101256, 101259, 101263, 101265-101266, 101269-101272, 101275, 101281, 101287-101288, 101291-101292, 101296-101298, 101302, 101304-101306, 101310-101311, 101315-101332, 101337, 101339, 101342, 101344, 101347-101349, 101351-101353, 101355-101362, 101365-101366, 101368-101370, 101372-101373, 101375, 101378-101389, 101391, 101393-101397, 101400-101401, 101403-101405, 101407-101410, 101412, 101414, 101416, 101418-101422, 101426-101427, 101431-101432, 101434, 101437, 101439-101440, 101442, 101450-101451, 101454-101458, 101460-101463, 101468-101470, 101473, 101477, 101481-101485, 101487-101488, 101490, 101492, 101494, 101499, 101501, 101503, 101506, 101508-101509, 101511, 101513-101516, 101519-101521, 101528, 101532-101534, 101536-101537, 101539, 101542-101546, 101550-101554, 101556-101558, 101560, 101564, 101566, 101568, 101571-101572, 101574-101582, 101587-101589, 101591-101593, 101595-101596, 101598-101600, 101604-101605, 101609-101610, 101612, 101614, 101616, 101618, 101620-101621, 101623-101624, 101626, 101629-101631, 101633-101636, 101642, 101644-101647, 101649, 101653-101660, 101663-101664, 101666-101668, 101670, 101674, 101676, 101678-101679, 101681, 101683-101694, 101696, 101700-101701, 101703, 101706-101709, 101711, 101713, 101717-101718, 101720, 101722-101724, 101726, 101728, 101731-101738, 101740-101752, 101757-101760, 101762-101763, 101768-101769, 101771-101777, 101780-101782, 101784-101791, 101794, 101796-101797, 101799-101800, 101802-101803, 101805-101810, 101812-101813, 101816-101818, 101820, 101822-101823, 101825-101831, 101836-101840, 101842-101844, 101846-101851, 101853, 101855, 101858-101862, 101864, 101870, 101872-101873, 101875-101877, 101879, 101881, 101883, 101887, 101889-101895, 101900, 101902-101903, 101906-101910, 101913-101917, 101919, 101922-101923, 101925-101927, 101929-101930, 101934, 101936-101937, 101941, 101943-101946, 101948, 101950, 101954-101960, 101962, 101964-101965, 101967-101968, 101970, 101972-101973, 101975-101976, 101978-101979, 101981, 101984-101987, 101993-101996, 102000, 102002, 102004-102005, 102011-102012, 102015, 102019-102024, 102027-102028, 102030-102032, 102034, 102036-102038, 102043-102044, 102046-102047, 102049-102054, 102056-102058, 102060, 102063, 102065-102068, 102072-102076, 102078-102083, 102085-102086, 102088-102092, 102094-102095, 102098-102102, 102105, 102107, 102110-102119, 102121-102124, 102126-102128, 102132-102134, 102136-102137, 102139-102140, 102142-102143, 102145-102148, 102150, 102152, 102158-102159, 102161-102162, 102164, 102174-102176, 102178-102184, 102186, 102191, 102193, 102195-102198, 102200, 102203-102204, 102206-102208, 102212-102218, 102221-102224, 102228-102230, 102232-102234, 102236-102241, 102243-102249, 102251, 102253-102258, 102262-102270, 102275-102278, 102280-102281, 102283-102284, 102286-102292, 102295, 102298-102303, 102307-102308, 102310-102323, 102327, 102331-102335, 102337, 102339-102342, 102344-102345, 102347-102354, 102356, 102358, 102360-102363, 102365, 102367, 102369-102371, 102374, 102376, 102381, 102383, 102385, 102387, 102389-102391, 102393-102396, 102398-102412, 102415, 102417-102422, 102426-102429, 102431, 102434-102435, 102440-102441, 102444, 102447, 102451-102452, 102455-102460, 102462-102467, 102469-102471, 102474-102475, 102478-102479, 102481-102483, 102487, 102489, 102491-102492, 102495-102502, 102504, 102506-102507, 102509, 102511-102513, 102515-102523, 102526, 102528, 102530, 102532-102537, 102539-102552, 102555-102560, 102563, 102566-102567, 102569, 102571, 102573, 102576-102577, 102579-102580, 102582-102585, 102588-102591, 102593-102595, 102600-102602, 102604-102608, 102610-102615, 102620-102622, 102624-102625, 102633-102634, 102636, 102638, 102640-102641, 102645, 102647-102648, 102652-102658, 102662-102663, 102665, 102668-102677, 102679, 102682, 102685-102686, 102688, 102690-102691, 102694-102697, 102699-102700, 102702-102705, 102708-102709, 102711, 102713, 102715, 102717-102719, 102722-102724, 102727, 102729-102730, 102732-102733, 102735-102737, 102739-102742, 102744-102747, 102749-102750, 102753-102754, 102756-102757, 102761-102762, 102764-102765, 102767-102778, 102780-102794, 102796-102797, 102799-102803, 102806, 102808-102814, 102816, 102818-102819, 102822-102826, 102828, 102832, 102834-102839, 102841, 102844, 102846-102850, 102854-102857, 102859-102861, 102863, 102865-102870, 102874-102876, 102878-102880, 102882, 102884-102885, 102887-102888, 102891-102892, 102895-102896, 102898, 102900-102906, 102908-102910, 102913-102916, 102918, 102920, 102925, 102927, 102929-102931, 102935, 102939-102940, 102943-102944, 102946-102948, 102950, 102954-102959, 102963, 102967, 102970, 102972-102973, 102975-102976, 102979, 102982, 102988-102993, 102995, 102997, 103001-103006, 103009, 103013-103018, 103023-103027, 103029-103034, 103036, 103038-103041, 103043, 103045-103046, 103048-103052, 103056-103058, 103060-103062, 103068-103071, 103073, 103075-103076, 103078, 103080-103085, 103087, 103091, 103093, 103095-103100, 103111-103112, 103114-103115, 103118, 103122, 103124-103125, 103131, 103134, 103136, 103138-103143, 103145-103150, 103152-103154, 103156, 103158-103162, 103164, 103166-103167, 103170-103175, 103177, 103179-103189, 103191, 103194-103196, 103199, 103201, 103203-103206, 103208, 103211-103212, 103214, 103217-103221, 103223-103226, 103228-103229, 103231-103233, 103235-103238, 103241, 103243-103252, 103254-103263, 103265-103266, 103268-103271, 103273-103275, 103278, 103280-103281, 103283-103288, 103290, 103292, 103294-103301, 103304-103307, 103312, 103314, 103317-103320, 103323-103325, 103328-103330, 103332, 103334-103339, 103341, 103343, 103345-103347, 103349-103352, 103354-103357, 103361-103363, 103369-103372, 103377-103378, 103380, 103383, 103389, 103393-103394, 103396, 103401, 103405, 103407, 103409-103410, 103412-103415, 103422-103423, 103425, 103427-103429, 103431, 103434-103436, 103438, 103440-103444, 103447-103448, 103450-103451, 103453-103454, 103456-103457, 103459-103461, 103463-103466, 103468-103471, 103473, 103476, 103478-103482, 103484-103488, 103492-103493, 103497, 103500-103502, 103504-103506, 103508, 103510-103511, 103515, 103517, 103520-103522, 103524-103529, 103531, 103536, 103539-103540, 103542, 103544-103545, 103547-103549, 103551, 103554-103559, 103562, 103564-103565, 103567, 103570, 103573, 103576, 103578, 103581-103586, 103588-103589, 103592, 103594, 103596-103597, 103600-103603, 103607, 103609-103610, 103612, 103614-103615, 103619, 103622-103628, 103630-103632, 103634-103642, 103645, 103648-103649, 103651, 103653-103667, 103670-103673, 103675, 103678-103679, 103682-103692, 103695-103696, 103699-103704, 103706, 103708-103711, 103713-103718, 103720-103723, 103725, 103727, 103729-103730, 103733, 103735, 103737-103739, 103742, 103744-103747, 103751-103752, 103755, 103757, 103759-103762, 103765, 103770-103772, 103774, 103776, 103778-103780, 103783-103786, 103791, 103797, 103800, 103802, 103805, 103807, 103810-103811, 103815-103816, 103818-103820, 103822-103826, 103829-103836, 103838, 103840, 103843-103847, 103850-103851, 103853-103854, 103859-103861, 103865, 103869-103874, 103876-103880, 103882, 103884, 103886-103887, 103889, 103891, 103893-103895, 103897-103898, 103902-103905, 103907, 103910-103915, 103917-103918, 103921, 103923-103928, 103930-103932, 103934-103936, 103938, 103940-103941, 103943-103944, 103946, 103948-103953, 103955-103958, 103960-103962, 103965-103966, 103968, 103970-103971, 103973, 103975-103981, 103983-103993, 103995-103998, 104001, 104006-104007, 104011, 104013-104014, 104016-104021, 104023, 104027-104029, 104032-104047, 104050-104056, 104058-104065, 104067, 104069-104071, 104073, 104075-104078, 104082-104083, 104085-104096, 104099-104102, 104105, 104107-104113, 104115-104116, 104118-104122, 104124-104125, 104130, 104132-104133, 104137, 104139, 104142, 104145-104146, 104148-104156, 104159-104160, 104162, 104165, 104170-104173, 104175-104177, 104180-104186, 104189-104194, 104196-104204, 104206, 104208-104211, 104214-104217, 104219-104221, 104223-104224, 104226-104228, 104232-104236, 104238-104245, 104247-104253, 104255-104257, 104259-104261, 104265-104267, 104269, 104271-104273, 104275, 104278-104281, 104283, 104288, 104290, 104292, 104295, 104297-104301, 104303-104307, 104309, 104311-104313, 104322-104328, 104331, 104333, 104335-104341, 104343, 104346-104347, 104350-104351, 104354-104357, 104360, 104362-104363, 104365, 104367-104368, 104371-104372, 104375, 104377-104378, 104380-104382, 104384-104385, 104387, 104389, 104391, 104393-104397, 104399-104400, 104403-104411, 104414-104418, 104421-104422, 104425, 104429-104430, 104432-104434, 104436-104437, 104440-104443, 104445-104454, 104457, 104459-104461, 104463-104466, 104468-104470, 104473-104475, 104477, 104479-104482, 104484-104485, 104487-104488, 104490, 104492-104497, 104500-104506, 104508, 104511-104512, 104514-104517, 104519-104522, 104524-104533, 104537, 104541, 104543, 104545-104548, 104552-104559, 104561, 104563-104564, 104567-104569, 104571-104573, 104575-104577, 104582-104583, 104587-104588, 104590-104591, 104598-104600, 104607-104609, 104611-104616, 104618, 104621-104624, 104627, 104629-104630, 104632-104638, 104640-104643, 104646, 104648, 104653-104661, 104664-104665, 104667-104673, 104675-104676, 104678, 104680-104682, 104684-104685, 104689, 104692-104696, 104700-104701, 104704, 104706-104708, 104710-104713, 104715, 104717-104718, 104720, 104723, 104725-104730, 104733-104734, 104738-104745, 104747-104749, 104751-104752, 104754-104758, 104762-104765, 104767-104770, 104772, 104774-104776, 104778-104790, 104792, 104794-104796, 104798-104799, 104801-104807, 104809, 104811-104816, 104818-104826, 104828, 104831-104832, 104834-104836, 104841-104844, 104846-104849, 104851, 104854-104855, 104857, 104859, 104861, 104863, 104866-104868, 104870, 104872-104873, 104875-104876, 104880-104882, 104885-104891, 104893-104898, 104900, 104902-104907, 104911, 104913-104915, 104917-104918, 104920, 104923, 104925, 104927-104928, 104930-104931, 104934, 104937-104939, 104941, 104943-104949, 104951-104954, 104958, 104962, 104966-104970, 104972-104973, 104975, 104977, 104980, 104982-104986, 104988, 104990-104992, 104994, 104996-105000, 105002-105006, 105008-105012, 105016, 105018-105023, 105025-105026, 105028-105030, 105032, 105034, 105036-105039, 105041, 105043-105044, 105046-105055, 105057-105058, 105060, 105063-105066, 105069, 105071, 105073, 105075, 105077-105078, 105080-105081, 105083-105087, 105089, 105091, 105094, 105098-105099, 105102-105106, 105108-105116, 105119-105121, 105124-105126, 105128, 105130, 105132-105134, 105141-105149, 105156, 105158, 105165, 105168-105170, 105172-105176, 105178, 105180-105187, 105190-105197, 105199-105205, 105212-105213, 105215-105216, 105218, 105220, 105222, 105225-105226, 105229, 105231, 105234, 105238, 105240-105244, 105246, 105250-105251, 105255-105256, 105259-105261, 105263-105264, 105267-105268, 105270-105271, 105273-105277, 105279-105280, 105282, 105284, 105287, 105290, 105292, 105295, 105297-105298, 105300, 105303-105304, 105306, 105310, 105312, 105317, 105323-105327, 105330-105332, 105336-105337, 105340, 105343-105346, 105348-105355, 105359, 105361, 105365-105369, 105371-105372, 105374-105375, 105377-105380, 105382-105384, 105387, 105391, 105394, 105396-105397, 105401-105402, 105408-105409, 105411-105412, 105415-105419, 105421-105423, 105425, 105427, 105429, 105431-105435, 105438, 105445-105448, 105452, 105455, 105457-105458, 105463, 105465, 105467-105472, 105474-105476, 105478, 105480, 105483-105484, 105486-105488, 105490-105491, 105493, 105495-105500, 105502, 105504-105505, 105507-105509, 105513-105526, 105529-105532, 105534-105536, 105538-105548, 105550, 105552-105553, 105557-105558, 105560, 105562, 105564, 105566-105567, 105569-105570, 105572-105573, 105575, 105577-105578, 105580-105588, 105590-105591, 105595, 105598, 105601-105603, 105607-105608, 105610-105611, 105613-105614, 105617-105618, 105620-105624, 105628-105629, 105631-105632, 105634-105637, 105639-105640, 105642, 105644-105647, 105649, 105655, 105659-105661, 105665-105666, 105668-105674, 105676-105679, 105682, 105688, 105690, 105692-105694, 105696, 105698-105700, 105708-105712, 105715-105716, 105718-105725, 105727-105728, 105736-105739, 105742-105749, 105753, 105758-105759, 105762, 105765-105766, 105768-105776, 105778-105779, 105781-105791, 105793-105794, 105798-105804, 105806-105810, 105812-105813, 105815-105818, 105820-105821, 105823, 105825-105826, 105828-105836, 105838, 105843-105844, 105847-105848, 105850-105851, 105853-105854, 105856-105858, 105861-105870, 105872-105881, 105883, 105889, 105891, 105893, 105895, 105897, 105899-105900, 105902, 105904-105905, 105907-105910, 105913-105916, 105918, 105921, 105923, 105925, 105929-105931, 105934, 105937-105947, 105949-105951, 105953-105960, 105962, 105964, 105966-105969, 105971-105973, 105975-105976, 105981, 105985, 105987-105990, 105999-106003, 106005-106006, 106008, 106010, 106012, 106014-106016, 106020-106021, 106023, 106027-106033, 106035, 106037-106038, 106041-106047, 106051-106052, 106058, 106060, 106063-106069, 106072-106076, 106078-106080, 106082-106085, 106087, 106090-106092, 106095-106097, 106099-106101, 106105-106109, 106111-106117, 106120-106124, 106126-106127, 106129-106130, 106133-106135, 106138-106139, 106142-106143, 106145-106148, 106152-106155, 106157-106160, 106162, 106164, 106166-106167, 106169, 106171, 106173-106174, 106176, 106179-106180, 106182-106186, 106188-106191, 106195-106196, 106200-106209, 106211-106215, 106218-106220, 106222-106227, 106230-106231, 106233-106234, 106242-106247, 106249-106251, 106253, 106255-106264, 106266-106267, 106269, 106271, 106273, 106275, 106277-106280, 106283-106290, 106296-106297, 106304-106307, 106309-106313, 106316-106317, 106320, 106322, 106325-106326, 106329-106338, 106343, 106345, 106348-106352, 106356, 106361-106365, 106368-106372, 106374, 106376-106377, 106379-106380, 106382, 106384-106386, 106388-106389, 106392, 106394-106402, 106404, 106406-106413, 106416, 106418-106419, 106423, 106425, 106428-106429, 106432-106436, 106438, 106441, 106443, 106446, 106449, 106451, 106454-106458, 106461-106463, 106465-106468, 106470-106472, 106474, 106476-106485, 106487-106492, 106496, 106499-106501, 106504-106505, 106510, 106512, 106514-106515, 106518, 106520, 106522-106524, 106527, 106529-106530, 106532-106533, 106535-106537, 106539-106541, 106543, 106546-106548, 106550-106551, 106553, 106558-106559, 106561, 106563-106564, 106566-106567, 106571-106573, 106575, 106578-106581, 106584, 106588-106589, 106591-106611, 106618, 106621-106632, 106635-106636, 106638, 106640, 106642, 106644-106649, 106651-106652, 106654-106655, 106662-106666, 106668-106673, 106675, 106677, 106679-106688, 106692-106702, 106704-106711, 106713, 106716-106723, 106725-106730, 106734-106741, 106743-106745, 106747-106749, 106751-106756, 106758, 106760, 106763, 106765-106771, 106773-106776, 106778-106779, 106781, 106784, 106786-106788, 106792, 106794-106799, 106802, 106805-106806, 106811, 106814-106815, 106818-106823, 106825-106829, 106831-106834, 106836-106838, 106843, 106845-106848, 106850-106856, 106861-106864, 106866-106869, 106871-106872, 106875, 106880-106885, 106887, 106890-106892, 106894, 106897-106903, 106908, 106910-106911, 106913-106914, 106916-106917, 106921-106925, 106927, 106929-106930, 106932, 106935, 106937-106943, 106946-106953, 106955-106958, 106961-106962, 106967, 106972, 106976-106981, 106983, 106986, 106989-107001, 107005, 107007-107015, 107017, 107020-107021, 107023, 107026, 107030, 107033-107035, 107040-107041, 107043-107044, 107048-107051, 107054-107056, 107058-107062, 107065-107069, 107071-107073, 107075-107083, 107085-107094, 107096-107100, 107102, 107106-107107, 107111, 107113-107114, 107116-107120, 107123, 107125-107126, 107130-107134, 107136-107137, 107139-107157, 107159, 107161, 107163-107164, 107166, 107168-107169, 107171-107175, 107177-107183, 107185-107186, 107189-107190, 107192-107200, 107203, 107205, 107207-107214, 107218, 107220-107226, 107231, 107234-107235, 107239, 107242-107243, 107245-107260, 107263-107264, 107266, 107269-107272, 107275, 107280, 107282-107289, 107296-107301, 107303-107309, 107311-107315, 107317-107318, 107320-107321, 107324, 107327-107329, 107331, 107334-107342, 107345, 107347-107351, 107353-107355, 107357-107360, 107363-107364, 107366-107367, 107369-107370, 107374, 107376-107377, 107379, 107381-107383, 107386, 107388, 107390, 107392-107395, 107398-107404, 107407-107413, 107415-107416, 107418, 107422, 107425-107426, 107428, 107430-107435, 107437, 107439, 107441-107443, 107445-107451, 107455-107457, 107460-107463, 107465-107467, 107471, 107473-107477, 107479, 107481, 107483-107484, 107487, 107491-107495, 107497-107502, 107504, 107506, 107509-107512, 107514, 107516-107519, 107522, 107524, 107527-107528, 107530, 107532, 107535, 107537, 107542, 107544-107551, 107554-107555, 107557-107559, 107561-107566, 107568-107571, 107573, 107575-107578, 107582-107584, 107587, 107589, 107591, 107593, 107595, 107597, 107599-107603, 107605-107607, 107609-107612, 107614, 107616-107621, 107623, 107625-107630, 107634-107638, 107640, 107644-107649, 107653, 107655-107656, 107658-107659, 107661, 107663-107665, 107668-107671, 107674, 107676-107679, 107686-107691, 107693, 107695-107699, 107701-107705, 107707-107708, 107710-107711, 107713-107716, 107718, 107721, 107724-107725, 107727, 107729-107730, 107733-107738, 107740, 107742, 107747-107753, 107756-107762, 107765-107766, 107768-107770, 107772-107773, 107776-107783, 107786-107787, 107790-107791, 107795, 107797, 107799, 107804, 107806-107810, 107815, 107817, 107819-107820, 107822-107824, 107826, 107828-107832, 107837-107841, 107844-107846, 107848, 107850, 107852, 107855-107859, 107863, 107866-107868, 107872-107873, 107875-107878, 107883-107884, 107886-107890, 107893-107894, 107896-107899, 107901-107906, 107909-107912, 107917, 107919, 107922, 107924, 107927-107929, 107931, 107933, 107935-107937, 107939-107947, 107950-107955, 107957-107958, 107960-107961, 107964-107966, 107968-107975, 107977-107985, 107987, 107990-107991, 107993-107994, 107996-107997, 108001, 108005, 108007, 108018, 108021-108025, 108028-108029, 108032, 108034-108037, 108040-108041, 108043, 108045-108046, 108050, 108052-108053, 108055-108057, 108059, 108061-108062, 108065-108070, 108072-108079, 108082, 108085-108091, 108094, 108096-108101, 108103-108107, 108111-108113, 108115-108116, 108119-108135, 108138, 108144-108147, 108150, 108152-108155, 108157, 108164, 108166, 108168-108169, 108171, 108173, 108175, 108177-108178, 108182-108183, 108185-108186, 108188-108190, 108192-108193, 108197-108211, 108213-108214, 108217-108220, 108223-108224, 108226, 108228-108229, 108232, 108241-108246, 108248-108268, 108271-108272, 108275-108277, 108279, 108281, 108284-108285, 108287, 108289-108290, 108293-108294, 108296-108299, 108301-108305, 108307, 108310-108311, 108315, 108317-108336, 108341-108347, 108349-108351, 108354-108358, 108360-108361, 108363, 108366, 108368-108370, 108373-108374, 108376-108377, 108380, 108383-108387, 108390-108393, 108395-108396, 108399-108400, 108404-108408, 108411-108414, 108416, 108418, 108420-108421, 108425-108428, 108433-108434, 108437, 108441-108445, 108447, 108449-108455, 108458-108465, 108467-108468, 108472-108475, 108482, 108485, 108489, 108492, 108494-108495, 108498, 108501-108503, 108505, 108507-108509, 108513-108516, 108518, 108524-108528, 108530-108532, 108534-108535, 108537, 108543-108549, 108551-108554, 108556-108557, 108559, 108563-108566, 108568, 108570-108573, 108576-108578, 108580-108585, 108587-108590, 108592-108593, 108595, 108599-108602, 108604, 108606-108612, 108615, 108618-108620, 108622, 108624, 108626-108628, 108631-108633, 108635, 108638, 108640, 108643-108650, 108652-108654, 108656, 108658-108662, 108664, 108666-108668, 108670-108674, 108676, 108678-108683, 108685, 108689, 108691, 108694-108695, 108697-108698, 108700, 108702, 108704-108705, 108707-108708, 108712, 108714-108719, 108722-108723, 108725-108747, 108749-108754, 108757-108767, 108769-108770, 108772-108775, 108777-108778, 108780-108781, 108783-108785, 108788-108794, 108796-108799, 108804-108805, 108808-108809, 108813-108814, 108818, 108820-108824, 108827-108836, 108842, 108844-108848, 108850, 108852, 108854-108862, 108864-108866, 108868, 108870, 108873, 108876, 108879-108883, 108885-108886, 108888-108889, 108891-108896, 108898, 108900-108901, 108903-108906, 108908-108915, 108919-108920, 108925, 108928-108934, 108936, 108938, 108941-108944, 108946, 108948-108949, 108953-108954, 108956, 108958-108959, 108964-108966, 108968, 108970, 108972-108973, 108977-108983, 108986-108988, 108993-109001, 109003-109011, 109013-109014, 109016, 109018, 109020, 109022-109024, 109027-109028, 109030, 109032, 109034-109037, 109039, 109041-109047, 109049, 109051, 109056-109058, 109061-109065, 109067, 109069-109073, 109076-109077, 109080, 109082-109087, 109090-109094, 109096-109097, 109099-109101, 109103-109107, 109109-109113, 109115, 109117, 109119-109124, 109127, 109130-109132, 109134, 109136-109142, 109146-109148, 109151-109153, 109155, 109158, 109160-109168, 109170-109172, 109175-109176, 109180-109181, 109185-109194, 109196, 109198-109199, 109201, 109203, 109205-109210, 109213-109220, 109223, 109226-109228, 109230-109231, 109236-109237, 109239-109242, 109245-109249, 109251, 109253-109256, 109258-109261, 109266, 109268, 109270-109272, 109274-109275, 109278, 109285-109287, 109289, 109291-109292, 109294-109296, 109299, 109302-109305, 109307-109308, 109310-109316, 109319-

109322, 109324-109325, 109327-109330, 109332-109335, 109338, 109340-109341, 109345, 109347-109354, 109357-109361, 109366, 109369-109373, 109376-109387, 109389-109397, 109399-109400, 109403, 109407-109411, 109414-109415, 109417, 109419-109422, 109424-109430, 109432-109434, 109437, 109439, 109448-109456, 109459-109460, 109462-109464, 109466-109468, 109470, 109473-109475, 109477-109478, 109480, 109489-109490, 109493, 109496-109497, 109499, 109501-109505, 109507-109508, 109510-109515, 109517-109523, 109528-109529, 109534-109536, 109539-109540, 109542-109546, 109548, 109551-109552, 109554, 109556, 109558-109565, 109567-109569, 109571-109572, 109574, 109579-109581, 109583-109587, 109589-109592, 109594, 109597-109599, 109601-109605, 109609, 109611-109617, 109621-109625, 109627, 109629-109630, 109634-109639, 109641-109642, 109644, 109646-109648, 109650-109651, 109654-109657, 109660-109662, 109664-109668, 109670-109671, 109674-109675, 109677-109679, 109685-109686, 109690, 109692, 109696, 109698-109699, 109702, 109705-109706, 109708, 109710, 109712-109713, 109715-109723, 109726-109728, 109730, 109732-109734, 109737-109743, 109747, 109749-109752, 109754-109757, 109759-109761, 109763, 109765-109770, 109772-109773, 109779-109781, 109784-109787, 109790-109798, 109800, 109802-109805, 109808-109811, 109814, 109816, 109819-109824, 109826, 109829, 109831, 109834-109840, 109842, 109844-109845, 109847-109850, 109854, 109859, 109861, 109863, 109867-109868, 109870-109881, 109883-109889, 109893-109894, 109896, 109898, 109901, 109903-109905, 109907-109915, 109917-109918, 109924-109927, 109929-109930, 109932, 109935-109936, 109938, 109940-109942, 109944-109948, 109950-109954, 109957-109958, 109960-109961, 109965, 109968-109970, 109972, 109974, 109976-109981, 109985, 109992-109994, 109998, 110000, 110002-110006, 110009, 110012, 110015-110016, 110020, 110024-110025, 110027, 110029, 110031-110038, 110040-110041, 110047-110056, 110063-110064, 110067-110071, 110073, 110075, 110078-110081, 110085, 110088, 110092, 110094-110095, 110097-110099, 110103, 110106, 110110, 110112-110116, 110118-110131, 110133, 110135, 110137, 110139, 110142-110145, 110147-110157, 110159, 110161-110162, 110164, 110166-110171, 110175-110178, 110180, 110185, 110188-110191, 110193, 110195, 110197-110198, 110200-110203, 110205-110211, 110213, 110223-110228, 110230, 110234, 110236, 110238-110239, 110241-110244, 110246-110249, 110251, 110253-110254, 110258-110259, 110262, 110265, 110268, 110276-110281, 110284-110286, 110288-110289, 110291, 110293-110297, 110299-110302, 110307-110310, 110314-110316, 110318, 110321-110322, 110324-110326, 110328-110330, 110335-110340, 110345, 110347-110350, 110357-110359, 110364, 110366, 110368-110379, 110382, 110385-110390, 110395, 110397-110399, 110401, 110405, 110407, 110411, 110413, 110416-110426, 110428, 110430, 110432-110433, 110435-110437, 110442-110443, 110448, 110452, 110456-110460, 110462, 110467, 110474-110477, 110480-110482, 110484-110487, 110490, 110493-110502, 110506-110508, 110510-110525, 110527-110529, 110531, 110533-110539, 110541-110549, 110552, 110554-110557, 110559, 110563, 110565, 110567-110571, 110574, 110578-110579, 110582, 110586, 110588-110591, 110593-110603, 110605, 110607-110613, 110619-110623, 110629, 110631-110632, 110635-110636, 110640-110642, 110646, 110651, 110654-110656, 110658-110660, 110664-110665, 110667-110670, 110672-110674, 110676, 110679, 110682-110683, 110685-110690, 110700, 110703-110706, 110709-110711, 110713-110718, 110723, 110728, 110731-110746, 110748, 110750, 110752-110754, 110756-110763, 110766, 110768, 110770-110772, 110778-110780, 110782, 110786-110788, 110791, 110793, 110795-110798, 110802, 110805, 110808-110810, 110813, 110815-110816, 110818-110819, 110823-110825, 110827-110828, 110832-110837, 110842, 110845-110846, 110850, 110852, 110854, 110864, 110867, 110869, 110872-110874, 110876-110881, 110883-110884, 110886-110887, 110890-110900, 110902-110910, 110912-110913, 110915, 110925-110926, 110928-110929, 110931-110937, 110939, 110941-110943, 110945, 110947-110948, 110950-110953, 110956, 110958-110959, 110961-110962, 110966, 110968-110969, 110971, 110974-110979, 110983, 110985, 110987-110990, 110992, 111001, 111008-111009, 111011-111013, 111015-111019, 111021, 111025-111028, 111034-111035, 111038-111040, 111043, 111045, 111049, 111054, 111056-111063, 111066, 111068, 111073, 111075-111077, 111079-111080, 111082-111086, 111088, 111090-111091, 111093, 111096, 111098, 111102, 111110-111111, 111114-111119, 111121, 111123, 111125-111126, 111128, 111130-111132, 111136, 111147-111151, 111154-111156, 111158, 111161, 111164, 111167-111172, 111174-111175, 111178-111180, 111182-111183, 111190-111191, 111193-111194, 111198, 111200, 111202-111204, 111208-111209, 111216, 111218-111221, 111223, 111227, 111230, 111232-111240, 111245-111246, 111249-111250, 111252, 111254, 111256, 111259, 111261-111263, 111267, 111269-111270, 111272-111274, 111276-111281, 111283, 111286-111295, 111298, 111303-111310, 111312, 111317, 111319, 111321-111341, 111343-111354, 111357-111362, 111365-111366, 111368, 111370, 111372-111373, 111376-111380, 111382-111385, 111387-111388, 111390-111393, 111397-111400, 111403-111408, 111410, 111412-111414, 111416-111417, 111420-111428, 111430-111432, 111435, 111437-111440, 111442, 111444-111445, 111447-111458, 111460-111462, 111464-111466, 111468-111472, 111474-111477, 111479-111483, 111486, 111489, 111491, 111493-111499, 111503-111506, 111508-111509, 111511, 111516-111518, 111520-111522, 111524-111528, 111530-111531, 111536-111537, 111540-111542, 111544, 111547-111552, 111556, 111558, 111560, 111568, 111571, 111576-111577, 111579-111582, 111584-111587, 111589-111593, 111595-111597, 111599, 111601-111608, 111612-111617, 111619-111624, 111626, 111628-111630, 111632-111633, 111635-111636, 111638-111640, 111642, 111644-111646, 111649-111651, 111653-111654, 111658-111659, 111661-111673, 111675, 111677, 111680-111685, 111687, 111689-111695, 111699, 111701-111706, 111710-111715, 111717-111718, 111720-111727, 111729, 111731-111733, 111735, 111737, 111740-111743, 111746, 111748, 111751-111752, 111754-111755, 111758-111759, 111761-111763, 111766-111770, 111772-111778, 111780-111781, 111783-111786, 111788-111795, 111797, 111802, 111804-111807, 111810-111811, 111814, 111816-111823, 111825-111826, 111829-111832, 111835, 111838-111842, 111845-111847, 111850, 111852-111857, 111860-111861, 111863-111868, 111870-111877, 111880-111883, 111885-111886, 111888-111892, 111895-111896, 111899-111901, 111906-111907, 111909-111922, 111925-111927, 111930, 111932-111936, 111940, 111942-111944, 111949-111950, 111952, 111954-111956, 111960, 111962-111965, 111968, 111970-111971, 111973, 111976, 111978-111986, 111988, 111990-111997, 111999-112002, 112004-112006, 112008-112013, 112015, 112019-112020, 112022-112031, 112033, 112037, 112039-112045, 112047-112049, 112051-112053, 112055, 112058, 112066, 112068, 112070, 112072-112073, 112077-112080, 112082-112083, 112087, 112089, 112091-112095, 112097-112102, 112104, 112109-112110, 112112, 112114-112116, 112118-112121, 112123-112132, 112134-112135, 112137-112138, 112140, 112142-112144, 112147-112149, 112151-112153, 112155-112157, 112160, 112162-112165, 112167-112168, 112170, 112172-112177, 112180, 112183, 112185-112189, 112191-112192, 112194-112195, 112197-112201, 112203-112208, 112211, 112215-112220, 112222-112224, 112226-112233, 112235, 112238-112246, 112250, 112253, 112258-112262, 112264-112265, 112268-112271, 112273-112280, 112283, 112286-112301, 112304-112306, 112308-112309, 112314-112315, 112317-112319, 112321-112323, 112325, 112327, 112329-112330, 112332-112339, 112341-112342, 112344-112345, 112347-112349, 112351-112358, 112360-112362, 112364, 112366-112373, 112378-112379, 112382, 112386, 112391, 112393-112394, 112397-112398, 112400-112401, 112403-112405, 112407-112409, 112412-112419, 112422-112431, 112435-112437, 112439, 112442-112443, 112447, 112449-112451, 112453-112460, 112463, 112465, 112467-112472, 112474, 112476, 112478-112481, 112483-112486, 112488-112493, 112495-112500, 112502-112507, 112510, 112513, 112516-112521, 112523-112524, 112527, 112529-112530, 112532-112536, 112538, 112540-112544, 112546-112550, 112552-112557, 112560, 112563-112568, 112570-112572, 112575, 112581-112592, 112594, 112596-112597, 112599-112603, 112605-112607, 112609-112615, 112617-112621, 112623-112625, 112627, 112630-112631, 112633, 112636-112638, 112640, 112644-112645, 112647-112648, 112652, 112656-112660, 112662-112666, 112668, 112670-112673, 112675-112676, 112678, 112681, 112684-112686, 112690, 112692-112693, 112695-112700, 112702-112703, 112705, 112707-112710, 112712-112717, 112720, 112722-112730, 112733-112734, 112740-112744, 112747, 112749, 112751, 112753, 112755, 112758-112761, 112763-112765, 112767, 112769-112771, 112773-112774, 112776-112780, 112782, 112784-112785, 112787-112794, 112796-112805, 112808-112811, 112813, 112816, 112820, 112823-112825, 112827-112831, 112833-112834, 112846, 112852-112856, 112858-112863, 112867, 112870-112872, 112876, 112880, 112885-112887, 112889-112898, 112900-112901, 112903-112904, 112906-112907, 112910, 112913-112916, 112919-112926, 112928, 112930-112932, 112935, 112937-112938, 112942, 112945-112950, 112952, 112954-112955, 112957-112961, 112965, 112970, 112972, 112977-112982, 112984-112988, 112990-112997, 112999, 113001, 113003, 113007-113011, 113013, 113015-113018, 113020-113021, 113024, 113026, 113029-113036, 113038-113043, 113045-113046, 113049, 113051-113053, 113056, 113059-113060, 113063-113066, 113069-113073, 113075-113077, 113079-113082, 113084-113087, 113089-113093, 113095, 113097-113098, 113100-113101, 113104, 113107, 113109-113112, 113120-113124, 113129, 113132, 113134-113135, 113138-113140, 113145, 113147, 113149, 113151-113154, 113156-113157, 113161-113167, 113169-113177, 113181-113182, 113185-113187, 113189-113200, 113202-113205, 113208-113211, 113213, 113215, 113217, 113219-113220, 113222-113223, 113225-113230, 113232-113233, 113235, 113237-113239, 113241, 113243-113246, 113250-113255, 113258, 113260-113263, 113265-113269, 113272-113275, 113277, 113279, 113285, 113289-113290, 113292, 113299-113302, 113305-113306, 113308, 113312, 113314-113318, 113322-113334, 113338, 113340, 113342, 113344-113348, 113351-113354, 113357-113358, 113361-113364, 113366-113368, 113370-113372, 113376-113378, 113380-113382, 113385-113388, 113390, 113393-113401, 113403, 113405-113406, 113409, 113411-113412, 113414-113415, 113418-113424, 113428, 113430, 113434, 113437-113438, 113442-113445, 113447-113452, 113454-113455, 113457, 113459-113461, 113463, 113467-113469, 113471, 113477-113485, 113487-113489, 113491, 113494-113495, 113498, 113500, 113502-113506, 113508, 113511, 113513-113514, 113516, 113518, 113522-113529, 113531, 113533, 113535, 113537, 113539-113540, 113542-113547, 113549-113550, 113552-113557, 113559-113560, 113562, 113564-113567, 113569, 113572, 113575, 113580-113584, 113586-113587, 113589-113590, 113592-113595, 113597-113599, 113603, 113605-113609, 113611, 113616, 113618, 113623-113624, 113628-113642, 113644, 113646-113648, 113652-113654, 113656, 113658-113661, 113663, 113666-113667, 113669-113670, 113672-113673, 113678-113679, 113681-113687, 113690-113692, 113694-113703, 113705, 113707, 113709, 113711, 113714-113717, 113720, 113723, 113725-113726, 113730-113732, 113734, 113737-113741, 113743, 113745, 113748-113749, 113752-113757, 113759, 113762-113764, 113766, 113768, 113770-113777, 113779-113780, 113783-113787, 113789, 113792-113793, 113796, 113798, 113801, 113807, 113810-113811, 113813, 113815-113817, 113822, 113826, 113829, 113835-113837, 113839-113847, 113853, 113855, 113857-113859, 113865-113870, 113872-113875, 113877-113881, 113887-113888, 113890-113892, 113894-113895, 113897-113899, 113901-113909, 113911-113913, 113915, 113918-113919, 113923, 113927, 113930-113933, 113936-113945, 113948, 113952, 113954-113955, 113957, 113959-113962, 113966, 113968, 113970-113974, 113977-113980, 113982-113988, 113990-113994, 113997, 114001-114003, 114005-114008, 114010, 114012-114013, 114015-114017, 114019-114028, 114030-114034, 114036-114046, 114048-114049, 114052, 114054, 114056, 114059-114061, 114063-114065, 114069-114071, 114073-114077, 114079-114082, 114085-114086, 114090, 114093-114094, 114096-

114102, 114106, 114108-114110, 114112-114113, 114116-114119, 114121, 114124-114128, 114131-114136, 114138, 114140-114142, 114144-114146, 114148-114149, 114152-114156, 114158, 114162-114168, 114172-114175, 114178-114179, 114182-114185, 114188-114192, 114194, 114196, 114198-114199, 114203-114206, 114208-114209, 114211-114212, 114214-114221, 114223-114224, 114227, 114230-114233, 114237-114242, 114244-114245, 114247-114248, 114250-114255, 114261, 114263-114265, 114268-114269, 114271, 114274, 114278-114282, 114284, 114286-114288, 114291-114301, 114303, 114305-114306, 114312-114313, 114315-114318, 114320-114324, 114326, 114328-114335, 114337, 114339-114340, 114344, 114346-114347, 114351, 114353-114354, 114356, 114358-114359, 114361-114362, 114364-114372, 114374-114375, 114377, 114379-114381, 114383, 114386, 114388-114393, 114395-114398, 114400, 114403-114405, 114407, 114409-114413, 114416, 114418, 114420-114421, 114423-114424, 114426-114427, 114430-114434, 114436-114442, 114444-114445, 114447-114448, 114450-114454, 114456-114457, 114459-114462, 114464-114466, 114468-114472, 114474, 114476-114481, 114484, 114486-114489, 114491-114493, 114495, 114498-114503, 114505-114506, 114508, 114510-114513, 114515, 114519, 114522-114525, 114527, 114530, 114532, 114534, 114538-114539, 114541-114542, 114544-114549, 114552-114557, 114560-114562, 114564, 114567-114577, 114579, 114582-114584, 114586-114589, 114592, 114595, 114597-114598, 114600-114606, 114608-114612, 114615, 114617-114624, 114628, 114630-114632, 114634-114637, 114639, 114641-114645, 114648-114666, 114668, 114670-114672, 114674, 114677, 114679-114686, 114690-114693, 114695-114696, 114698, 114700, 114704-114717, 114719-114721, 114723, 114726-114727, 114729-114733, 114735-114736, 114738-114740, 114743, 114747-114750, 114752-114753, 114757-114759, 114761-114768, 114771, 114776-114778, 114780-114781, 114783, 114785-114786, 114791-114794, 114797-114801, 114803-114805, 114807-114809, 114811-114819, 114821-114823, 114826-114829, 114831-114833, 114835, 114838-114844, 114848, 114850-114853, 114855-114856, 114858-114859, 114862, 114864-114869, 114872, 114874-114881, 114884-114885, 114888-114893, 114896, 114898, 114900, 114902-114903, 114907-114913, 114918-114919, 114921, 114923, 114925-114928, 114931, 114933-114935, 114937-114938, 114940, 114942-114949, 114951, 114953-114954, 114956, 114958-114960, 114963, 114966, 114968-114969, 114971-114978, 114982-114985, 114991-114994, 114999-115001, 115005-115007, 115009, 115012, 115014-115015, 115017-115021, 115025-115026, 115029, 115033-115037, 115040, 115043-115044, 115046, 115050-115053, 115055-115056, 115058-115060, 115062, 115065-115066, 115070-115077, 115079-115084, 115086, 115088, 115093, 115095-115097, 115099-115103, 115106-115107, 115109-115110, 115113-115117, 115119, 115121, 115123, 115125-115126, 115128, 115131-115138, 115143-115146, 115149-115152, 115156-115169, 115171, 115173-115179, 115181-115183, 115185, 115187-115188, 115191-115192, 115194-115195, 115197-115200, 115202-115213, 115216-115217, 115220, 115222-115225, 115227-115228, 115230, 115232, 115234-115236, 115238-115239, 115241-115247, 115249, 115251-115252, 115254, 115257-115258, 115260-115261, 115264-115265, 115267-115269, 115272-115274, 115276, 115278, 115280-115282, 115286, 115288, 115294-115297, 115300-115305, 115308, 115312-115320, 115323-115327, 115331-115343, 115345-115346, 115348, 115350, 115352-115353, 115355, 115359, 115361-115362, 115364, 115366-115367, 115369, 115372-115373, 115375-115376, 115379-115380, 115382-115383, 115385-115386, 115388-115389, 115391-115392, 115394-115395, 115397-115398, 115402-115403, 115405-115410, 115412-115416, 115420-115422, 115429-115432, 115439, 115441-115443, 115445-115447, 115449, 115453-115454, 115456, 115459, 115463-115466, 115469, 115471-115473, 115475-115477, 115481-115500, 115502, 115504-115505, 115509, 115514-115516, 115520-115521, 115523-115524, 115527, 115529, 115532-115533, 115535-115537, 115541-115542, 115546-115547, 115549-115551, 115555-115559, 115561, 115564-115567, 115570-115573, 115575-115578, 115580-115581, 115583-115584, 115587, 115589-115599, 115603, 115605-115608, 115610, 115612, 115614-115616, 115619, 115622-115624, 115626-115633, 115636-115640, 115644-115648, 115651, 115654-115660, 115662, 115664-115669, 115671-115677, 115679, 115681-115683, 115686, 115690, 115693-115697, 115700-115704, 115706, 115712-115720, 115722-115727, 115729, 115731-115736, 115738-115739, 115741-115742, 115744-115745, 115747, 115751-115752, 115755-115756, 115758-115759, 115761-115765, 115767-115774, 115777-115783, 115785-115787, 115789-115790, 115793-115794, 115796, 115798-115799, 115801-115807, 115809, 115811, 115813-115815, 115817-115818, 115820-115823, 115828, 115830-115838, 115840, 115843, 115847-115849, 115852, 115855, 115857-115861, 115864, 115866, 115868-115869, 115873-115875, 115877, 115880-115882, 115887-115889, 115892-115895, 115897-115898, 115900-115905, 115907-115909, 115911-115916, 115918-115921, 115923-115924, 115926-115931, 115935-115936, 115938-115940, 115943-115946, 115948-115951, 115953, 115958, 115963-115965, 115967, 115969-115972, 115974-115976, 115978-115981, 115984, 115986-115988, 115990-115994, 115996-115997, 115999-116002, 116004-116009, 116014-116016, 116018-116027, 116029, 116032-116033, 116035-116041, 116043, 116045-116047, 116049, 116051-116058, 116062-116068, 116070-116072, 116075, 116077, 116081-116082, 116084, 116086-116088, 116091-116093, 116095-116102, 116104, 116106-116108, 116110-116118, 116120-116129, 116133-116134, 116136-116138, 116140-116144, 116147-116151, 116153-116154, 116156-116160, 116162-116166, 116168-116169, 116171, 116173, 116175-116179, 116181, 116183-116184, 116187, 116189-116191, 116195-116196, 116198, 116200-116205, 116208-116213, 116215-116221, 116224, 116226, 116229-116231, 116233-116235, 116237-116244, 116247-116251, 116253, 116257, 116261-116264, 116266-116268, 116270-116274, 116276-116277, 116279-116282, 116284-116285, 116287, 116289-116291, 116294, 116300, 116304-116305, 116309-116311, 116315, 116318-116320, 116322-116323, 116325-116327, 116329-116330, 116334-

116336, 116338-116340, 116342-116347, 116349-116350, 116354-116357, 116359-116363, 116365, 116368-116369, 116372, 116375-116376, 116378-116382, 116385-116387, 116389-116390, 116392-116393, 116396, 116399-116400, 116403-116404, 116406, 116408, 116410-116414, 116416-116417, 116419-116420, 116422, 116426-116427, 116430, 116433-116436, 116438-116446, 116448-116452, 116454-116456, 116461, 116463-116466, 116469, 116471-116473, 116475-116478, 116480, 116482, 116484-116485, 116487-116495, 116498-116502, 116505-116509, 116511-116515, 116517-116527, 116530-116531, 116534, 116536, 116538-116539, 116541-116543, 116545-116546, 116548-116549, 116551-116552, 116556, 116559, 116561, 116563-116566, 116568-116571, 116573-116578, 116580-116581, 116583-116587, 116589-116591, 116593-116597, 116599-116608, 116611, 116613, 116619, 116621-116630, 116632, 116634-116640, 116642, 116644, 116646, 116648, 116650, 116652-116655, 116657, 116664-116665, 116669, 116672-116674, 116679-116691, 116693, 116695-116696, 116698, 116700-116701, 116703-116707, 116709-116710, 116717-116719, 116721, 116726, 116728, 116730-116733, 116735-116738, 116740-116741, 116743-116744, 116746-116747, 116749, 116751, 116753, 116756-116760, 116764-116767, 116773, 116775, 116777, 116780-116784, 116786, 116788, 116790-116792, 116794, 116796-116798, 116800-116803, 116805, 116807-116814, 116816-116818, 116820-116822, 116824-116834, 116841-116847, 116849-116850, 116852, 116854-116858, 116860, 116862-116866, 116868, 116873-116876, 116878-116881, 116886, 116888, 116891, 116893-116895, 116900, 116902-116903, 116906, 116908, 116911, 116913-116915, 116917, 116919-116920, 116924, 116927-116928, 116930-116931, 116933-116937, 116939-116940, 116942-116944, 116946-116949, 116951, 116954, 116956-116957, 116959-116962, 116964, 116966-116968, 116970-116971, 116973, 116975-116980, 116982-116983, 116986-116988, 116990-116993, 116995-116996, 117000-117008, 117011-117012, 117014-117015, 117019, 117021, 117023-117024, 117026, 117029-117031, 117033-117034, 117036-117038, 117040-117041, 117043-117044, 117048, 117052-117058, 117062, 117065-117066, 117068-117072, 117075, 117077-117078, 117083, 117086-117090, 117092-117097, 117099-117101, 117103, 117106-117107, 117112, 117114-117120, 117122-117123, 117125, 117129, 117131-117135, 117138-117147, 117151, 117154-117156, 117158, 117160-117165, 117167-117168, 117170, 117175, 117179-117180, 117182-117184, 117189-117191, 117193-117194, 117197-117199, 117201, 117204-117206, 117208-117210, 117212-117213, 117216-117220, 117223, 117226-117227, 117230-117234, 117236-117237, 117239-117245, 117247-117250, 117252-117256, 117258-117259, 117261, 117263, 117265-117268, 117271-117273, 117276, 117279, 117281, 117283, 117285-117287, 117291-117294, 117298-117300, 117302-117304, 117308-117313, 117315, 117317-117320, 117322-117323, 117325-117329, 117331-117332, 117341, 117343, 117345-117347, 117349-117350, 117352-117355, 117359-117360, 117363, 117365-117366, 117368, 117370-117372, 117375-117376, 117379, 117382, 117384, 117387-117393, 117395-117399, 117401, 117403-117410, 117412-117413, 117415-117423, 117425, 117427-117430, 117432-117436, 117439, 117442, 117447-117450, 117452-117457, 117464-117467, 117469-117471, 117476-117479, 117481-117483, 117488, 117491-117494, 117496, 117500-117502, 117504, 117506-117510, 117513, 117515, 117517, 117520, 117524-117530, 117533, 117535-117538, 117541, 117543-117545, 117547, 117551-117552, 117555, 117557, 117563, 117565-117567, 117571-117573, 117576-117577, 117579-117582, 117584-117590, 117593-117596, 117598, 117600, 117602, 117604-117607, 117609-117613, 117615-117616, 117618-117619, 117621-117622, 117624-117632, 117635-117637, 117641, 117643, 117645-117653, 117655-117656, 117659, 117661-117662, 117664-117666, 117669-117670, 117672, 117674, 117676, 117678, 117680, 117682-117684, 117686-117693, 117696, 117698-117700, 117702-117704, 117706-117707, 117709, 117711-117713, 117715-117719, 117721, 117723, 117725-117727, 117731, 117733-117735, 117738-117749, 117753, 117755-117756, 117758, 117760, 117764, 117766-117771, 117774-117778, 117781-117782, 117786-117787, 117791, 117793, 117795-117796, 117799-117806, 117808, 117815-117818, 117821-117822, 117825-117830, 117833, 117835-117837, 117839-117840, 117844-117851, 117853-117862, 117867-117875, 117877-117882, 117885-117887, 117889, 117891-117892, 117896, 117898-117910, 117912-117913, 117915-117926, 117930-117937, 117939-117940, 117944, 117950, 117953, 117955, 117957-117965, 117967-117969, 117971-117973, 117975-117976, 117978-117979, 117981-117982, 117985-117986, 117988-117992, 117994-117999, 118001, 118003, 118005-118007, 118009, 118011-118013, 118015-118016, 118018-118020, 118026, 118030-118032, 118034-118035, 118037-118046, 118049, 118052-118053, 118055, 118057-118059, 118061-118062, 118065-118073, 118084-118086, 118090-118091, 118093-118095, 118097, 118099-118100, 118103-118105, 118107-118112, 118114, 118116-118120, 118123, 118127-118130, 118133, 118135-118136, 118138-118139, 118141-118143, 118146-118152, 118154-118155, 118157-118159, 118161, 118163-118165, 118169, 118176-118177, 118180-118181, 118186-118188, 118190, 118193, 118196-118199, 118201, 118203-118204, 118206-118207, 118209, 118212-118220, 118224-118225, 118228-118229, 118231, 118233-118234, 118237-118239, 118242, 118244, 118246-118249, 118251-118252, 118254-118255, 118257, 118259-118262, 118264-118269, 118271-118276, 118279, 118281-118295, 118297-118299, 118302-118304, 118308, 118310-118314, 118316-118319, 118321-118323, 118329, 118331-118332, 118335-118336, 118341-118342, 118344, 118346, 118348, 118350-118353, 118355-118357, 118359, 118361, 118363, 118365-118367, 118369-118371, 118373-118381, 118384, 118389, 118391, 118394, 118396-118398, 118400-118403, 118405, 118407, 118409-118415, 118417, 118419-118423, 118425-118427, 118429-118433, 118439-118442, 118445, 118447-118448, 118451, 118455-118457, 118459-118460, 118466, 118468-118470, 118474-118476, 118478-118484, 118489-118492, 118495-118498, 118500-118504, 118506-118507, 118509, 118511, 118513, 118515-118521, 118525-118526, 118529-118530, 118532-118533, 118539-118541, 118543-

118544, 118547-118550, 118552-118562, 118566, 118570-118573, 118576-118583, 118585-118587, 118591, 118593, 118595, 118598-118600, 118603-118606, 118610-118613, 118615, 118617-118623, 118627, 118632-118636, 118641-118646, 118651, 118653-118654, 118656, 118658-118663, 118665-118668, 118671-118673, 118676-118679, 118681, 118683, 118685, 118688-118689, 118691-118695, 118698-118699, 118701, 118703-118704, 118706, 118708-118717, 118719-118720, 118726-118728, 118730-118733, 118737-118739, 118741-118743, 118745-118746, 118748, 118752-118754, 118757, 118761-118762, 118764-118768, 118772-118773, 118775-118777, 118779-118784, 118786, 118788, 118791-118792, 118794-118796, 118798-118807, 118809-118812, 118814-118816, 118818-118822, 118824, 118828-118834, 118836-118838, 118840, 118843, 118850-118854, 118856-118857, 118859-118863, 118866-118872, 118874-118879, 118881-118884, 118890-118892, 118894-118895, 118897-118900, 118907, 118909, 118912, 118914-118915, 118917-118920, 118922, 118932-118933, 118935, 118937-118940, 118948, 118951, 118954, 118956-118961, 118964-118968, 118970-118975, 118979-118980, 118982-118983, 118985, 118987, 118990-118991, 118993, 118995-118997, 118999-119005, 119008, 119017, 119019-119021, 119023-119025, 119027, 119029-119030, 119034-119036, 119038, 119048, 119050-119051, 119055-119057, 119061-119062, 119065-119066, 119068-119070, 119072-119082, 119085, 119087-119090, 119095-119103, 119105, 119107, 119109, 119111-119113, 119115-119116, 119118-119119, 119121-119124, 119127-119129, 119134-119141, 119143, 119151-119152, 119154-119155, 119157-119159, 119163, 119165-119169, 119171, 119174, 119178-119188, 119190-119192, 119194-119199, 119201-119206, 119208-119212, 119214-119220, 119224, 119226-119228, 119230-119232, 119235, 119237, 119239-119243, 119245, 119247, 119249-119250, 119252, 119255, 119257-119258, 119260-119265, 119267-119270, 119272-119273, 119275-119276, 119280-119287, 119289-119294, 119299-119300, 119302-119303, 119308-119310, 119312-119316, 119321-119322, 119324, 119326-119329, 119333, 119338-119339, 119341, 119343-119348, 119350, 119352-119355, 119359, 119361-119364, 119368, 119372-119375, 119379-119380, 119382-119385, 119387, 119389, 119391-119392, 119394-119395, 119399, 119401, 119403-119406, 119408, 119412, 119415-119417, 119423-119431, 119434-119436, 119438-119444, 119446, 119449-119455, 119458-119464, 119466-119467, 119470-119473, 119476-119484, 119486-119487, 119495, 119497, 119499-119504, 119507, 119509, 119513, 119515-119517, 119519, 119521-119524, 119526, 119528-119529, 119532, 119534, 119537, 119539-119540, 119545, 119547-119549, 119553-119560, 119563-119564, 119566-119567, 119569, 119579-119580, 119584, 119587-119588, 119590, 119594-119595, 119599-119603, 119605-119627, 119629, 119632, 119635-119639, 119641, 119643-119651, 119655, 119657-119672, 119675, 119677, 119681-119684, 119686-119688, 119691-119694, 119697-119704, 119706, 119708-119710, 119713-119714, 119716-119720, 119725-119727, 119731-119732, 119734-119735, 119737-119739, 119742-119746, 119748-119759, 119762-119767, 119769-119770, 119772, 119774, 119776, 119779-119780, 119782-119787, 119789, 119792, 119795-119796, 119798, 119800-119804, 119806, 119808-119810, 119812-119814, 119817, 119820-119822, 119825, 119827-119828, 119830, 119835-119836, 119838, 119840-119843, 119845, 119847, 119849-119850, 119852, 119854-119858, 119860, 119862-119869, 119871, 119873-119874, 119876, 119878, 119880-119881, 119885-119887, 119890-119896, 119898-119899, 119901-119903, 119905, 119907-119910, 119912, 119914, 119916, 119918-119924, 119926-119938, 119940-119944, 119946, 119948-119959, 119962-119964, 119968-119969, 119971, 119973, 119978-119989, 119991-119996, 119998-120002, 120004-120007, 120009-120018, 120021-120022, 120025, 120027-120029, 120031-120036, 120038-120039, 120041-120042, 120044-120049, 120051-120054, 120057-120062, 120065-120077, 120079-120080, 120082-120087, 120089, 120092, 120094-120095, 120097-120105, 120109, 120111-120118, 120120-120122, 120124, 120126, 120128, 120131-120136, 120138, 120143, 120145-120149, 120151, 120154-120155, 120157-120158, 120161-120163, 120165, 120167, 120169, 120171-120173, 120175-120179, 120181-120183, 120185-120186, 120188, 120195, 120197-120198, 120200-120209, 120212, 120214-120217, 120219, 120221-120226, 120230-120232, 120234, 120236-120240, 120242-120245, 120248-120257, 120260-120264, 120266, 120271-120274, 120276-120279, 120281-120284, 120286-120287, 120291-120292, 120295, 120297, 120299-120300, 120302-120304, 120306, 120308-120312, 120314, 120316-120321, 120326-120329, 120331-120333, 120336-120342, 120344, 120352, 120356-120357, 120361-120362, 120365-120368, 120371-120374, 120376-120378, 120382-120386, 120388-120396, 120399, 120401, 120405-120406, 120409-120415, 120418-120419, 120422-120424, 120426-120433, 120435-120436, 120440-120442, 120444-120449, 120451, 120455-120462, 120465-120466, 120470-120471, 120474-120475, 120478-120479, 120481, 120483, 120485-120488, 120491-120493, 120495-120503, 120506-120513, 120515-120522, 120524, 120527-120530, 120535-120542, 120545-120546, 120548, 120550-120552, 120554-120555, 120557-120560, 120562, 120564, 120566-120575, 120579-120580, 120582-120586, 120589-120590, 120592-120594, 120600-120606, 120608-120613, 120615, 120620, 120622, 120625-120628, 120630-120639, 120643-120649, 120651, 120653, 120656-120657, 120661, 120664-120669, 120671-120673, 120675, 120678, 120681-120683, 120685-120686, 120688-120691, 120693, 120695-120707, 120711-120712, 120716-120717, 120719, 120721, 120724, 120726, 120730, 120735-120736, 120739-120746, 120748-120754, 120757-120760, 120762, 120764-120768, 120770-120771, 120774-120778, 120780, 120782, 120784-120787, 120789, 120791, 120794-120795, 120797-120799, 120801-120803, 120807, 120809-120814, 120816-120817, 120819-120822, 120824, 120826, 120830, 120834, 120838-120843, 120846-120847, 120850-120851, 120853-120857, 120859-120862, 120864, 120866-120868, 120871-120880, 120882-120884, 120886, 120888-120891, 120895, 120899, 120902-120906, 120909-120916, 120918-120919, 120923-120930, 120935-120937, 120941, 120943-120945, 120947-120950, 120953, 120955-120957, 120959-120960, 120962, 120964-120969, 120971, 120973-120974, 120976-120978, 120980, 120983-120986, 120989-120990, 120992-121000, 121005, 121007-121010, 121012-121013, 121017-121018, 121020, 121024-121026, 121028-121029, 121031-121032, 121036-121040, 121044, 121046-121047, 121050, 121053, 121055-121056, 121059, 121061, 121063-121067, 121069-121071, 121073, 121075-121078, 121081, 121084-121086, 121088-121091, 121093-121094, 121096-121097, 121099-121100, 121103, 121105-121117, 121122-121126, 121131-121132, 121136-121138, 121145-121149, 121151-121158, 121161-121164, 121167-121172, 121174-121175, 121177-121182, 121184, 121187-121190, 121192-121193, 121196-121198, 121200-121204, 121206-121210, 121212, 121214-121217, 121219-121220, 121223, 121226-121229, 121231-121233, 121235-121236, 121238-121239, 121241-121242, 121244-121250, 121252-121253, 121255, 121257-121259, 121261-121263, 121265, 121267-121273, 121275-121277, 121279, 121283-121298, 121302, 121305-121307, 121309-121313, 121315, 121317-121326, 121328, 121331-121342, 121344, 121347, 121350-121353, 121355-121357, 121359, 121361, 121363-121365, 121369-121371, 121373, 121375-121376, 121378-121380, 121382-121385, 121389, 121391-121393, 121395, 121397-121398, 121400, 121402, 121405-121407, 121410-121411, 121413, 121415-121419, 121421, 121424-121428, 121430-121434, 121436-121438, 121442, 121444-121453, 121456-121458, 121460-121463, 121466-121469, 121471-121472, 121474, 121478, 121480-121484, 121486, 121488-121489, 121491-121493, 121496, 121498-121500, 121502-121504, 121506-121508, 121512, 121515-121517, 121520-121522, 121524-121527, 121529-121530, 121536-121537, 121539-121546, 121549-121550, 121553-121555, 121557-121560, 121562, 121564-121566, 121569, 121571-121576, 121578-121579, 121581, 121584, 121589, 121595-121601, 121603, 121609-121610, 121612-121618, 121620-121621, 121623, 121625-121628, 121630, 121632, 121634-121639, 121641-121646, 121648-121651, 121653-121654, 121656, 121658, 121660-121670, 121672-121674, 121679-121683, 121685-121691, 121693-121694, 121696, 121701-121704, 121706-121712, 121714-121718, 121720, 121722, 121726-121727, 121729-121732, 121734-121737, 121741-121742, 121744-121745, 121747-121748, 121750, 121756, 121759-121763, 121768-121769, 121771-121778, 121780-121782, 121785-121786, 121788-121793, 121796-121797, 121799-121803, 121812, 121817-121818, 121820-121822, 121825-121827, 121833-121834, 121836-121842, 121844-121852, 121854-121858, 121860-121862, 121865, 121867-121870, 121873-121878, 121886, 121888-121892, 121894-121896, 121898, 121900, 121905-121906, 121908, 121910, 121912-121916, 121918-121921, 121926-121929, 121931, 121934, 121936-121937, 121939-121940, 121943-121944, 121946, 121949-121953, 121955-121958, 121960, 121963, 121969-121970, 121974-121977, 121981-121986, 121988-121993, 121995, 122000, 122002, 122004, 122008-122013, 122015-122023, 122025-122027, 122029-122030, 122033, 122035, 122037-122044, 122046-122050, 122052-122053, 122055, 122057-122059, 122061-122062, 122065-122072, 122074-122075, 122077-122078, 122081, 122083, 122086-122088, 122090-122092, 122094, 122099-122100, 122102-122104, 122106, 122109-122113, 122115-122117, 122119, 122121-122127, 122129-122135, 122137-122138, 122140-122142, 122144, 122148, 122150-122151, 122154-122155, 122158, 122161-122163, 122166-122167, 122169, 122172-122173, 122175, 122177-122179, 122184, 122187-122189, 122191-122197, 122199-122208, 122212, 122214-122215, 122218, 122223-122224, 122226-122227, 122229, 122231-122232, 122237, 122241-122243, 122245, 122247-122252, 122256, 122258-122261, 122264-122268, 122270-122274, 122280-122282, 122285-122286, 122288-122289, 122291-122296, 122301-122303, 122306, 122309, 122312-122316, 122318, 122320-122321, 122323-122326, 122328-122333, 122335, 122337, 122339, 122341-122342, 122344-122346, 122348, 122351-122357, 122362, 122366-122368, 122373, 122375, 122377-122381, 122383-122384, 122388-122390, 122393-122395, 122397-122403, 122405-122407, 122409-122410, 122412-122414, 122417-122418, 122420-122422, 122424-122425, 122427-122444, 122446, 122451, 122453-122455, 122457, 122459, 122462, 122464-122468, 122470-122472, 122474, 122476, 122479, 122481, 122483-122486, 122489-122491, 122493-122502, 122504, 122506, 122510-122511, 122514-122516, 122518, 122520-122524, 122526-122530, 122533, 122535-122537, 122541, 122543, 122545-122546, 122549-122551, 122555-122559, 122561-122562, 122564-122565, 122568-122569, 122571-122572, 122574, 122576, 122581-122586, 122588-122593, 122596-122604, 122606-122609, 122614, 122616-122622, 122626, 122628-122630, 122632-122634, 122636, 122638-122641, 122643-122644, 122646-122655, 122657, 122659-122663, 122666, 122675, 122677-122686, 122690-122693, 122695-122696, 122698-122701, 122705, 122708-122710, 122712-122714, 122717-122720, 122723-122726, 122728-122735, 122738-122739, 122741-122748, 122750-122751, 122753-122754, 122756-122759, 122763-122768, 122770-122774, 122776-122777, 122779-122781, 122784-122785, 122789, 122791-122794, 122798, 122801-122803, 122805-122810, 122812-122813, 122815-122817, 122819-122833, 122835, 122838-122839, 122841, 122844-122850, 122853, 122856-122860, 122862-122866, 122869-122873, 122876-122879, 122882, 122885-122886, 122888, 122890-122891, 122894-122895, 122897, 122899, 122902, 122904-122906, 122908-122914, 122918-122925, 122927-122928, 122932, 122936, 122938, 122940-122942, 122944, 122946-122947, 122949, 122953-122957, 122959-122964, 122967-122974, 122976, 122978, 122980-122985, 122988-122989, 122991, 122994, 122999, 123001-123002, 123005, 123007, 123009, 123011-123012, 123015, 123017-123021, 123023-123028, 123030-123031, 123034-123038, 123040, 123044, 123046, 123048-123056, 123058-123064, 123066-123067, 123069-123073, 123075-123076, 123078, 123081-123083, 123085-123086, 123088-123093, 123095, 123097-123098, 123101-123104, 123107-123108, 123110-123112, 123115, 123117-123120, 123125-123132, 123134, 123137, 123140-123142, 123145, 123152-123154, 123156, 123159-123160, 123162-123164, 123166, 123170, 123173-123175, 123177-123183, 123185, 123188-123189, 123191-123194, 123197, 123199, 123203-

123212, 123215, 123217-123218, 123220-123221, 123224, 123226-123229, 123231, 123233-123234, 123241, 123243-123244, 123248-123250, 123253-123261, 123263, 123266-123267, 123270, 123276-123279, 123281, 123283, 123285, 123287, 123292-123293, 123295-123297, 123299-123304, 123306-123319, 123321, 123324-123325, 123327-123328, 123330, 123332-123333, 123335, 123337-123340, 123342, 123346-123347, 123349, 123357, 123362-123363, 123365, 123367-123368, 123370-123371, 123373-123374, 123377, 123379-123383, 123387-123389, 123391, 123397, 123400-123401, 123403, 123405-123406, 123408-123427, 123429-123430, 123434, 123436, 123438-123439, 123441-123446, 123449, 123452-123454, 123460-123462, 123464-123465, 123467-123468, 123471-123476, 123478-123479, 123481, 123484, 123487-123493, 123496, 123498, 123500, 123502-123506, 123510-123515, 123517-123520, 123522-123535, 123537, 123540-123543, 123545-123547, 123551-123553, 123556-123561, 123564-123566, 123568-123571, 123574-123576, 123578-123583, 123585, 123587-123588, 123590-123591, 123593-123595, 123597, 123599, 123603-123606, 123609-123610, 123612-123613, 123615, 123619-123623, 123625-123631, 123634-123640, 123642-123647, 123649, 123651, 123653-123655, 123657-123666, 123668, 123671-123672, 123675-123677, 123679-123683, 123685-123686, 123689-123695, 123698-123705, 123707, 123711, 123713-123714, 123717, 123721, 123723, 123726, 123728-123730, 123733, 123735-123738, 123740-123742, 123744-123747, 123749-123751, 123755, 123758-123761, 123768, 123770-123776, 123778-123785, 123787-123789, 123791, 123794-123803, 123805-123814, 123816, 123820-123821, 123823-123827, 123830, 123832-123836, 123838, 123840, 123843, 123849, 123852-123856, 123858, 123860-123865, 123870, 123872-123873, 123875, 123881-123882, 123884-123888, 123894-123896, 123898, 123902-123906, 123908, 123912, 123914-123915, 123917, 123919-123921, 123924, 123926-123927, 123930, 123935, 123937, 123941-123946, 123948-123956, 123958, 123960, 123962, 123965, 123968, 123972-123978, 123980-123983, 123985-123987, 123989, 123991-123996, 123999, 124001-124006, 124008-124012, 124015-124016, 124018-124019, 124021, 124023, 124025, 124028-124030, 124032-124034, 124036-124037, 124039-124042, 124044, 124047-124048, 124051, 124053-124055, 124057, 124059, 124064, 124066, 124068-124070, 124072-124076, 124078-124079, 124082-124086, 124088-124091, 124093-124095, 124098, 124102-124104, 124107-124110, 124112-124117, 124119-124121, 124127, 124130-124136, 124138, 124142, 124144-124151, 124156-124160, 124163-124164, 124166-124167, 124170-124176, 124178-124180, 124182, 124184-124186, 124188, 124190-124195, 124197, 124199, 124201-124205, 124209-124212, 124214, 124218-124220, 124222, 124224-124225, 124228-124233, 124235-124238, 124240-124246, 124250-124254, 124256, 124258, 124263-124266, 124268-124269, 124273, 124277-124282, 124285-124288, 124290, 124292, 124296, 124298-124299, 124301, 124303-124305, 124308-124313, 124315-124317, 124319-124320, 124324, 124328-124330, 124332-124334, 124336-124337, 124339, 124342, 124344-124351, 124353-124354, 124357, 124360, 124362, 124364, 124367, 124371-124373, 124375, 124377-124384, 124386, 124388-124390, 124392, 124395-124396, 124400-124401, 124405, 124408-124409, 124412-124414, 124417-124420, 124422-124427, 124429-124430, 124433-124438, 124440-124442, 124445-124454, 124457, 124460, 124462, 124466, 124468, 124470, 124472-124476, 124478-124482, 124486-124488, 124495, 124497-124499, 124504-124505, 124509-124510, 124512, 124514-124515, 124519-124522, 124524-124527, 124529-124532, 124539-124541, 124543-124545, 124549, 124552-124553, 124557, 124560, 124562, 124564, 124566-124573, 124575-124577, 124579-124580, 124582-124588, 124590, 124592-124594, 124596-124600, 124603, 124607, 124609-124611, 124613, 124615-124622, 124624-124625, 124631-124634, 124636-124638, 124640-124646, 124649-124650, 124652-124654, 124656, 124658-124660, 124662-124663, 124665-124668, 124670, 124672-124678, 124682, 124685-124689, 124691-124697, 124699-124700, 124702-124708, 124710-124715, 124717-124724, 124729-124734, 124737-124741, 124743-124745, 124747-124748, 124751-124760, 124762, 124764-124766, 124768-124772, 124775-124780, 124782-124783, 124785, 124789-124793, 124795-124796, 124800, 124802-124809, 124812, 124814-124816, 124820, 124823, 124825-124827, 124829-124831, 124835, 124841, 124843-124846, 124848, 124851-124852, 124854, 124860-124861, 124867-124868, 124870, 124875-124876, 124878-124888, 124890-124894, 124896, 124898, 124900, 124903-124907, 124910-124915, 124917-124919, 124922-124924, 124930, 124932-124937, 124940-124944, 124947, 124949, 124951-124954, 124956-124957, 124959-124964, 124967-124968, 124970, 124974-124975, 124978, 124980-124982, 124984-124990, 124992-124994, 124996-125002, 125008, 125010-125012, 125015, 125018-125021, 125029-125032, 125034-125036, 125041, 125044, 125047-125053, 125055-125057, 125059-125061, 125063-125070, 125072, 125075-125078, 125080-125081, 125084-125085, 125087-125091, 125095-125100, 125102-125104, 125106-125116, 125118-125121, 125124-125125, 125127-125129, 125131-125132, 125134-125135, 125137-125138, 125142-125144, 125146-125150, 125152-125154, 125156-125157, 125159-125161, 125163-125168, 125170, 125172-125173, 125176-125177, 125181-125190, 125192-125194, 125196, 125198, 125200-125202, 125204-125205, 125207-125208, 125211, 125214, 125217-125218, 125222-125229, 125232-125234, 125237, 125239-125240, 125242-125244, 125246-125248, 125251-125260, 125263-125265, 125267, 125269, 125271-125273, 125277-125278, 125280, 125283-125286, 125288-125291, 125293, 125295-125299, 125301, 125303, 125305, 125307, 125310-125311, 125313-125315, 125317-125318, 125320-125324, 125326-125332, 125336-125339, 125343-125345, 125347, 125352, 125354, 125356-125357, 125359, 125363-125366, 125368, 125371-125376, 125378-125382, 125385-125388, 125390-125393, 125397-125403, 125405-125406, 125409, 125411-125416, 125418-125425, 125427-125428, 125430-125435, 125437-125444, 125447, 125449, 125451, 125453, 125455, 125457-125458, 125461, 125463, 125466, 125468-125471, 125473-125479, 125481-125482, 125484-125490, 125494-125500, 125502-125503, 125506-125508, 125510, 125512, 125514, 125516-125522, 125527-125529, 125532, 125535, 125537, 125539-125543, 125546-125547, 125549-125550, 125553-125556, 125558-125561, 125563-125567, 125569-125570, 125572-125576, 125579-125581, 125583-125587, 125589-125590, 125592, 125594-125595, 125599-125600, 125604-125608, 125610, 125612-125616, 125619, 125621, 125624-125627, 125631-125634, 125637, 125639-125641, 125643-125645, 125647, 125649-125650, 125652, 125655-125662, 125664-125665, 125668-125670, 125675, 125677-125679, 125681, 125687-125688, 125690-125698, 125700-125701, 125704, 125706-125708, 125713-125716, 125720, 125722, 125724, 125726, 125728-125729, 125732-125734, 125736-125740, 125743, 125745-125748, 125752-125754, 125759, 125761-125765, 125767-125772, 125775-125778, 125780-125781, 125783-125785, 125787-125788, 125790, 125793-125794, 125796-125797, 125800-125801, 125803-125808, 125813-125817, 125819-125829, 125831-125833, 125838-125842, 125844, 125850-125852, 125854-125856, 125859-125864, 125867-125868, 125870-125873, 125877-125878, 125880-125889, 125893-125895, 125900, 125907-125911, 125913, 125915-125924, 125926-125927, 125929-125930, 125932-125934, 125937-125943, 125946-125947, 125949-125950, 125952, 125956-125957, 125959, 125963-125964, 125967-125973, 125976-125981, 125984, 125986-125988, 125991-125992, 125994, 126001, 126005-126019, 126022-126026, 126028, 126031-126032, 126034-126036, 126038, 126041-126045, 126047-126049, 126052-126054, 126056-126059, 126063, 126065-126068, 126070-126072, 126078-126082, 126085-126087, 126089-126092, 126094-126096, 126098-126101, 126103-126105, 126107-126122, 126124-126126, 126128, 126130-126131, 126134, 126137, 126139-126143, 126145-126149, 126151-126152, 126154, 126156, 126158-126160, 126163, 126165-126167, 126169-126173, 126175, 126177-126179, 126181, 126184, 126190, 126194-126197, 126201-126206, 126210, 126212, 126215-126216, 126218, 126220-126229, 126231-126242, 126247-126249, 126251, 126255-126256, 126258, 126263, 126265, 126267-126271, 126273, 126275-126281, 126283-126287, 126290-126291, 126299-126304, 126308-126310, 126313-126314, 126317-126319, 126321-126325, 126327-126333, 126335, 126338-126339, 126341-126342, 126345-126348, 126358, 126360-126363, 126367-126370, 126374-126375, 126377-126378, 126384, 126389-126400, 126402-126407, 126409-126419, 126423, 126426, 126430-126432, 126435-126437, 126440-126441, 126443, 126445-126451, 126453-126457, 126459, 126461, 126463-126466, 126468-126471, 126473, 126476-126477, 126479, 126481-126482, 126484-126487, 126489-126490, 126492-126497, 126500, 126502, 126505-126512, 126514, 126516, 126519, 126522, 126528, 126532, 126534, 126536-126538, 126540-126541, 126543-126546, 126548-126549, 126552-126553, 126555-126556, 126559-126560, 126563-126570, 126572, 126574-126575, 126578, 126580-126584, 126586, 126589-126590, 126595-126597, 126603-126608, 126610-126611, 126613-126617, 126621, 126623-126624, 126628, 126632, 126636-126638, 126640, 126642, 126645-126653, 126657, 126659, 126661-126664, 126668-126670, 126674-126678, 126681, 126683-126684, 126686-126687, 126689, 126691-126696, 126698-126700, 126704-126706, 126708-126709, 126711-126712, 126714-126715, 126717, 126722-126727, 126729-126736, 126739-126740, 126744-126745, 126747, 126749-126750, 126753-126769, 126771, 126773, 126775-126779, 126781-126784, 126786-126790, 126792, 126795, 126797-126801, 126803-126806, 126808, 126812, 126815-126822, 126825-126829, 126831-126834, 126837, 126839, 126841, 126843, 126845, 126848, 126853, 126856, 126858, 126860-126865, 126867-126869, 126871-126872, 126875-126879, 126881, 126884, 126886-126891, 126895, 126899-126900, 126903, 126905, 126910, 126912, 126914, 126923, 126926, 126928-126934, 126936-126941, 126943, 126945, 126947-126952, 126955, 126957-126958, 126961-126962, 126964, 126969, 126972, 126978-126980, 126982, 126984-126988, 126992-126997, 126999-127001, 127003-127005, 127007-127014, 127017-127019, 127021-127022, 127024, 127026-127028, 127032-127033, 127035, 127037-127042, 127044, 127047-127049, 127051-127052, 127054-127055, 127057-127058, 127060-127066, 127070, 127072, 127074-127076, 127078, 127080-127082, 127084, 127091-127096, 127099-127102, 127105-127110, 127112-127113, 127116, 127118-127119, 127121-127122, 127124, 127126-127143, 127147-127154, 127157-127161, 127163-127164, 127170, 127172, 127177-127179, 127181-127185, 127187, 127191-127193, 127195, 127200-127202, 127204-127206, 127208-127210, 127213-127216, 127218, 127220, 127222-127223, 127225, 127227-127229, 127231-127232, 127234-127236, 127238-127244, 127246-127249, 127252-127256, 127259-127266, 127269, 127271-127272, 127274, 127276-127278, 127280, 127282-127283, 127286, 127288-127290, 127292-127295, 127298-127300, 127303, 127305-127306, 127308-127309, 127311-127312, 127314-127323, 127325-127326, 127328-127331, 127335-127339, 127345, 127348-127351, 127353-127356, 127358-127360, 127362-127365, 127367, 127369-127371, 127373-127385, 127387-127391, 127393-127395, 127399, 127403-127408, 127410-127413, 127415, 127417, 127419-127420, 127423-127425, 127428, 127431-127432, 127435-127442, 127444-127448, 127450, 127452-127453, 127455, 127457, 127459-127462, 127464, 127466, 127468-127472, 127474, 127476-127477, 127479-127483, 127485, 127490, 127492-127500, 127502-127509, 127513, 127515-127516, 127518-127522, 127524-127530, 127533, 127538-127545, 127547-127552, 127554, 127558-127562, 127564, 127566-127572, 127574-127579, 127582-127588, 127591-127592, 127595, 127597-127598, 127600-127602, 127605-127607, 127613, 127615-127616, 127619-127622, 127627, 127631-127632, 127634-127635, 127638-127644, 127647-127648, 127650-127669, 127671-127674, 127676-127679, 127681, 127683, 127685-127692, 127695, 127697-127700, 127702-127705, 127709-127711, 127713-127714, 127719-127722, 127724-127725, 127727-127733, 127735-127739, 127741-127743, 127746, 127748-127749, 127753, 127755-127757, 127759-127760, 127762-127765, 127768, 127772, 127774-127775, 127777, 127779, 127783-127791, 127793-127797, 127799, 127801, 127804-127809, 127811, 127813, 127815-127823, 127826, 127828, 127833-127835, 127837-127840, 127842-127848, 127854-127855, 127857-127858, 127860, 127862, 127864-127867, 127870-127873, 127878-127883, 127885-127891, 127895, 127897-127905, 127908, 127911-127916, 127918-127920, 127923, 127927, 127931-127933, 127935-127938, 127940, 127942-127943, 127946, 127948, 127950, 127953-127954, 127956-127964, 127967, 127970-127971, 127973, 127976-127977, 127979-127981, 127984-127985, 127988-127993, 127996-127997, 128000-128005, 128008-128011, 128013, 128015, 128019, 128021, 128023-128030, 128032-128033, 128035-128039, 128041, 128044-128046, 128048, 128050, 128052, 128054-128055, 128057-128059, 128061, 128065, 128067, 128071, 128073, 128075, 128077-128081, 128083-128086, 128088-128090, 128093, 128095, 128097-128098, 128100-128102, 128104, 128106, 128108, 128110-128113, 128115-128119, 128122-128132, 128136-128137, 128144-128145, 128148-128149, 128151, 128153, 128155-128158, 128161, 128166-128169, 128172-128176, 128180-128183, 128187-128188, 128190-128195, 128197-128211, 128213-128221, 128223, 128226-128227, 128229-128230, 128232, 128235-128239, 128242-128244, 128251-128254, 128258-128269, 128272, 128274-128280, 128283-128285, 128289, 128291-128299, 128302-128303, 128305-128306, 128309-128311, 128313-128319, 128322, 128328, 128330-128347, 128349-128354, 128356, 128358-128366, 128368-128369, 128373-128375, 128379-128380, 128384, 128387, 128391-128393, 128395, 128397-128401, 128403-128406, 128409-128411, 128414-128421, 128423-128426, 128428-128429, 128432-128433, 128435-128437, 128439-128445, 128447-128451, 128454-128460, 128462-128463, 128465-128466, 128468, 128472-128475, 128483-128493, 128497, 128500-128502, 128504-128506, 128508, 128510, 128513-128514, 128516-128518, 128520-128525, 128527-128528, 128530, 128535, 128539-128553, 128555-128561, 128564-128565, 128567-128568, 128572, 128574-128582, 128585-128587, 128589, 128591-128593, 128595-128601, 128603-128605, 128608-128610, 128612-128615, 128618-128620, 128624, 128626, 128628-128634, 128637-128638, 128640, 128643, 128645-128646, 128648, 128650-128657, 128659-128660, 128662-128663, 128665-128667, 128670-128671, 128673, 128675-128676, 128678-128683, 128685-128686, 128689, 128692-128695, 128697-128699, 128705, 128707-128712, 128714-128716, 128718-128723, 128726, 128728-128732, 128736-128737, 128741-128742, 128744, 128746, 128752-128755, 128757-128758, 128761-128763, 128765, 128767-128768, 128770-128773, 128776, 128779-128780, 128783, 128787-128788, 128790, 128793, 128795-128801, 128803-128804, 128808-128811, 128814, 128816-128817, 128822, 128825-128826, 128828-128830, 128834-128836, 128838-128844, 128846, 128848-128849, 128852-128854, 128856-128859, 128863, 128865-128867, 128869-128870, 128872-128874, 128876-128878, 128880, 128885, 128887, 128889, 128895-128898, 128900-128905, 128907, 128909-128917, 128919, 128922, 128924, 128926-128927, 128930, 128935, 128937-128938, 128940, 128942, 128945-128954, 128956-128963, 128966, 128968-128975, 128977-128979, 128981, 128983-128984, 128986-128989, 128991-128992, 128995-129000, 129002, 129004-129007, 129011-129012, 129014-129015, 129017-129019, 129021-129022, 129024-129029, 129031-129033, 129035-129038, 129041-129056, 129060-129071, 129074, 129076, 129078-129079, 129081-129084, 129087-129092, 129095-129100, 129102-129103, 129105-129110, 129113-129115, 129117, 129119, 129122-129123, 129125, 129127-129128, 129131, 129134-129135, 129138-129144, 129146-129149, 129151, 129154-129157, 129159-129162, 129166-129170, 129173, 129176-129177, 129180-129181, 129184-129192, 129195, 129197, 129199-129201, 129203-129204, 129206-129210, 129213-129216, 129218-129219, 129223-129225, 129227-129230, 129232-129233, 129235, 129237-129239, 129241, 129245-129246, 129248-129251, 129253, 129255, 129257-129258, 129260-129269, 129272-129275, 129277-129280, 129282, 129284-129293, 129295-129303, 129306-129312, 129314-129317, 129320, 129322-129323, 129326-129332, 129334-129336, 129339-129344, 129346, 129348-129350, 129352-129356, 129359-129369, 129371-129378, 129381-129383, 129385, 129389, 129392, 129394, 129399-129402, 129406-129412, 129415-129416, 129418, 129420, 129422-129424, 129428, 129430-129432, 129434, 129436-129448, 129450-129451, 129453, 129457, 129459, 129461-129462, 129464-129467, 129469-129471, 129474-129475, 129477-129480, 129485-129491, 129495, 129501-129502, 129505, 129507-129513, 129515-129516, 129518-129520, 129522, 129524-129526, 129530, 129532, 129534-129535, 129537-129540, 129542-129543, 129546-129551, 129553-129554, 129557-129559, 129561, 129563-129564, 129566-129571, 129573-129578, 129580-129581, 129583, 129585-129586, 129589, 129593-129596, 129601, 129603-129610, 129612-129616, 129618-129635, 129638, 129640, 129643-129648, 129650-129653, 129655, 129657-129660, 129664-129685, 129687-129690, 129692-129694, 129696-129698, 129700, 129702-129708, 129710-129712, 129715-129718, 129720-129728, 129730, 129732-129733, 129737-129738, 129741-129745, 129747, 129750-129753, 129756-129760, 129763-129773, 129775-129776, 129778-129787, 129789-129794, 129799, 129801-129802, 129804-129805, 129807, 129809-129810, 129814-129815, 129817-129820, 129822, 129824-129828, 129835, 129838, 129840-129841, 129843-129855, 129857-129858, 129860, 129862-129865, 129868-129869, 129872, 129874-129875, 129877-129882, 129884, 129886-129891, 129893-129896, 129898-129908, 129910-129911, 129917-129919, 129921-129926, 129928, 129934-129938, 129940-129942, 129944, 129946-129949, 129951, 129953, 129956, 129958-129963, 129969, 129972, 129974, 129978-129981, 129984-129989, 129992-129993, 129995, 129997-130003, 130005, 130007-130009, 130011-130017, 130020-130021, 130023-130024, 130026, 130028-130029, 130031-130036, 130039-130041, 130043, 130045, 130047, 130049-130052, 130055-130065, 130067-130069, 130073-130076, 130080, 130082-130087, 130089-130091, 130097, 130100, 130102-130104, 130106-130112, 130115-130116, 130119-130133, 130136, 130140-130144, 130146-130152, 130154, 130156-130160, 130162-130163, 130165, 130167-130168, 130170-130174, 130176-130180, 130183-130184, 130186-130190, 130192-130194, 130197-130198, 130200, 130203-130204, 130206-130207, 130209-130211, 130213-130214, 130216-130217, 130219-130221, 130224-130226, 130229, 130231, 130233, 130235-130239, 130241-130242, 130245, 130250-130264, 130266, 130268-130274, 130277-130278, 130281-130284, 130286-130293, 130300, 130302-130305, 130307, 130309-130310, 130312-130317, 130319-130330, 130332, 130336-130341, 130344-130348, 130350-130352, 130354-130355, 130357-130359, 130361, 130363, 130365-130366, 130368-130377, 130379, 130381-130385, 130387-130396, 130399-130400, 130402-130406, 130409-130411, 130413-130414, 130416-130422, 130426, 130433-130437, 130439-130443, 130447, 130450-130451, 130454-130456, 130458-130467, 130470-130474, 130476-130478, 130480, 130482-130488, 130490-130492, 130497-130498, 130500-130506, 130508-130509, 130512-130514, 130516, 130518, 130520-130525, 130527-130529, 130531, 130533, 130535, 130538-130543, 130545, 130547, 130549-130551, 130556-130558, 130560, 130563-130571, 130575-130578, 130580, 130583-130585, 130587, 130589-130596, 130598-130606, 130608, 130610-130612, 130614-130626, 130629-130630, 130632-130635, 130637-130638, 130640-130642, 130645-130646, 130650, 130652, 130654, 130656, 130658-130662, 130664, 130667-130668, 130672, 130674-130678, 130682-130689, 130692, 130694-130696, 130699, 130701-130705, 130708-130710, 130712, 130714-130720, 130722-130723, 130726, 130728-130729, 130732, 130734-130736, 130738, 130740, 130742-130744, 130746, 130748, 130751-130757, 130759, 130762-130764, 130767, 130769, 130771-130772, 130774, 130776, 130778-130781, 130784-130793, 130795-130798, 130802-130807, 130810-130816, 130819-130820, 130823-130825, 130827, 130829, 130832-130834, 130837-130838, 130840-130844, 130847-130851, 130853, 130855-130856, 130858-130860, 130862-130863, 130866-130873, 130875, 130877-130878, 130882, 130886-130887, 130889-130890, 130892-130895, 130898, 130900, 130902-130903, 130905-130906, 130908-130910, 130912-130916, 130918-130920, 130923-130924, 130929-130932, 130934-130944, 130947, 130949, 130951-130956, 130959, 130962-130969, 130971-130978, 130980-130981, 130985, 130987, 130989-130990, 130994-130996, 130999, 131001-131005, 131008, 131011-131014, 131017-131025, 131028, 131030-131036, 131038-131042, 131044, 131046-131047, 131049-131051, 131053-131054, 131057-131059, 131062, 131064, 131066-131075, 131077, 131079-131082, 131084, 131086-131089, 131092-131093, 131095-131096, 131098-131099, 131101-131103, 131105-131111, 131113, 131115-131117, 131119-131120, 131122-131129, 131131-131136, 131138, 131142, 131144-131145, 131150-131153, 131158, 131161-131162, 131164-131175, 131177, 131179, 131181, 131184-131185, 131187-131190, 131192-131200, 131202-131203, 131205-131206, 131208, 131210, 131220, 131222, 131225, 131227, 131229-131231, 131233-131234, 131237-131258, 131260-131261, 131263-131264, 131266, 131268-131270, 131272-131275, 131277-131278, 131282-131283, 131285-131286, 131289-131291, 131293-131297, 131300, 131303-131307, 131310-131318, 131320-131322, 131328-131336, 131343, 131345-131346, 131348-131351, 131356-131362, 131364, 131366-131368, 131370, 131374-131377, 131379-131382, 131384, 131387, 131392, 131398-131402, 131404-131408, 131411-131413, 131415-131418, 131420-131427, 131430-131432, 131434-131436, 131438-131440, 131442, 131444, 131446, 131448-131449, 131451-131455, 131457, 131459, 131461, 131463-131468, 131470-131478, 131481, 131486-131501, 131504, 131506-131507, 131509, 131511-131513, 131516, 131519-131526, 131529-131531, 131533-131534, 131537, 131539-131542, 131544-131550, 131552, 131554-131555, 131557-131562, 131566-131570, 131573-131574, 131576-131585, 131587-131590, 131592, 131594-131595, 131597-131601, 131604, 131607-131615, 131618-131621, 131624, 131628, 131631, 131635-131636, 131638, 131640-131641, 131643, 131645-131646, 131648-131649, 131651-131653, 131655-131663, 131666-131668, 131670-131671, 131674-131675, 131677-131684, 131686-131687, 131691-131693, 131696-131699, 131701-131702, 131705-131707, 131709-131710, 131713, 131716, 131718-131723, 131727, 131730, 131735-131736, 131740, 131742-131748, 131750-131753, 131757, 131759, 131761-131765, 131767-131772, 131775, 131777, 131782-131784, 131787, 131790-131791, 131794-131796, 131798-131799, 131801-131804, 131807, 131809, 131811, 131813, 131815, 131817-131820, 131822-131823, 131825-131826, 131831, 131833-131834, 131837, 131839-131840, 131844, 131850-131852, 131854-131856, 131858-131859, 131862, 131864-131866, 131869-131873, 131875, 131877, 131881-131883, 131885-131894, 131896, 131898-131905, 131907-131910, 131913, 131915-131921, 131923-131924, 131926, 131928, 131931, 131934, 131936-131939, 131941-131953, 131955-131957, 131959-131960, 131966, 131971-131973, 131975, 131977-131981, 131986-131990, 131992, 131995-131999, 132001-132007, 132009, 132013, 132016-132022, 132024-132026, 132029-132033, 132035-132036, 132038-132043, 132046, 132049-132060, 132063, 132065, 132067, 132069, 132072-132073, 132076-132078, 132081-132085, 132087, 132090, 132092-132096, 132098-132099, 132101, 132104-132106, 132108-132112, 132114-132116, 132119-132123, 132126, 132129, 132131-132132, 132134, 132136, 132138-132142, 132144, 132146-132147, 132149-132150, 132153-132156, 132160-132167, 132170, 132173-132179, 132181-132184, 132186-132187, 132189-132192, 132197, 132199-132206, 132210, 132215, 132221-132225, 132228, 132230-132232, 132234-132236, 132238, 132240, 132243-132245, 132247, 132249, 132251-132257, 132260, 132262-132265, 132267-132271, 132274-132282, 132284-132290, 132293-132295, 132299-132300, 132302-132303, 132305, 132307, 132309-132310, 132312-132314, 132316, 132318-132320, 132322, 132325-132326, 132329-132331, 132334-132336, 132338-132339, 132341-132342, 132345-132346, 132348, 132350-132351, 132354, 132359, 132361-132363, 132365-132367, 132372-132377, 132379-132380, 132382, 132384-132387, 132390-132397, 132403-132404, 132406-132409, 132411-132417, 132419-132420, 132423-132424, 132428-132429, 132431-132433, 132435-132437, 132440-132441, 132443-132446, 132448-132450, 132454, 132458-132461, 132464-132466, 132471, 132473-132474, 132476, 132479-132491, 132497, 132499-132502, 132506-132507, 132509-132510, 132512, 132516, 132518, 132520-132522, 132527-132531, 132533-132536, 132539-132540, 132542-132543, 132545, 132547-132548, 132550, 132552-132554, 132556-132560, 132563-132564, 132566-132570, 132572-132575, 132577, 132580-132583, 132585-132589, 132591, 132596-132600, 132602, 132606, 132608, 132610, 132612-132615, 132617-132619, 132622, 132624-132626, 132628, 132632, 132634-132639, 132641-132645, 132648, 132652-132654, 132657-132662, 132665-132666, 132668-132670, 132672-132673, 132676-132678, 132681-132682, 132684-132685, 132688-132689, 132691-132695, 132697-132698, 132700, 132702-132707, 132709-132713, 132716-132721, 132724-132729, 132731-132742, 132744-132747, 132751-132754, 132756, 132758-132762, 132764, 132767, 132769-132776, 132779, 132781-132782, 132784, 132786, 132788-132794, 132797-132798, 132801-132804, 132806, 132809-132816, 132820-132828, 132833-132835, 132837-132839, 132841-132845, 132847-132848, 132850-132853, 132857-132859, 132861-132865, 132867-132868, 132870-132874, 132876-132877, 132879, 132881-132884, 132886-132893, 132896-132897, 132899-132903, 132906-132911, 132914-132921, 132924, 132931-132935, 132938-132941, 132949, 132951-132959, 132961-132965, 132968-132969, 132972, 132975-132982, 132986-132989, 132991-132992, 132994-132997, 132999, 133001-133003, 133005-133018, 133020-133023, 133025-133027, 133029-133037, 133040-133041, 133043-133053, 133056-133059, 133061-133071, 133075-133076, 133078-133085, 133087, 133089, 133092, 133094-133103, 133106-133108, 133110, 133115-133116, 133119, 133124-133125, 133127, 133129-133131, 133134-133138, 133141-133142, 133146-133148, 133150, 133153-133155, 133160-133163, 133166-133169, 133171-133172, 133175-133178, 133180, 133182, 133184, 133186-133187, 133189, 133192-133208, 133210-133211, 133214-133222, 133224, 133228-133231, 133233, 133235, 133238, 133240-133241, 133245, 133249-133251, 133253-133254, 133256-133262, 133265-133269, 133271, 133275-133290, 133294, 133296, 133298-133304, 133306-133308, 133312-133315, 133317, 133319-133325, 133327-133329, 133331-133332, 133334-133335, 133337-133342, 133344, 133347, 133349, 133352-133359, 133363, 133365-133366, 133370-133371, 133373-133374, 133377-133380, 133382, 133385-133386, 133388, 133390, 133393, 133395-133396, 133398-133399, 133402-133410, 133414, 133416-133420, 133422, 133424-133429, 133432-133437, 133440-133442, 133450-133456, 133458, 133460-133464, 133466, 133468-133470, 133472-133473, 133483-133486, 133488-133499, 133501, 133503-133505, 133507-133513, 133516, 133518-133520, 133522-133529, 133531, 133533-133535, 133538-133540, 133542, 133545-133546, 133549-133552, 133554, 133556, 133559-133561, 133563-133571, 133576-133582, 133584-133587, 133589, 133592, 133594-133596, 133598-133602, 133604-133607, 133610-133613, 133615-133617, 133619, 133621, 133623-133626, 133628-133629, 133632-133638, 133640-133641, 133643, 133645, 133648-133649, 133651-133652, 133655, 133657, 133659-133661, 133663-133665, 133669, 133671-133672, 133674-133677, 133679-133685, 133687-133692, 133694-133697, 133699-133700, 133702, 133704, 133706-133713, 133715-133723, 133725-133726, 133728-133732, 133734, 133736, 133738, 133744-133748, 133750, 133752-133760, 133762, 133765-133769, 133771-133772, 133774-133776, 133778-133779, 133787-133788, 133790, 133793-133797, 133799-133800, 133802, 133806, 133808-133819, 133821-133825, 133829, 133832-133838, 133841-133844, 133846, 133849-133858, 133860-133861, 133863, 133867-133879, 133881-133882, 133884, 133887, 133890-133892, 133895-133897, 133899-133900, 133903, 133906, 133911, 133913-133914, 133916-133918, 133920-133925, 133928, 133931-133936, 133940-133941, 133943, 133945, 133947-133949, 133952-133953, 133955-133958, 133960-133962, 133965-133970, 133972-133973, 133978-133982, 133984-133988, 133991-133992, 133994, 133996-133999, 134001, 134003-134007, 134009-134012, 134014-134016, 134018-134019, 134022-134024, 134026-134027, 134029-134030, 134032-134033, 134036, 134038-134039, 134041-134042, 134044-134045, 134048-134050, 134056, 134058-134061, 134063, 134065-134067, 134070, 134072-134074, 134076-134079, 134081-134082, 134086-134087, 134089-134092, 134094, 134097, 134099, 134103-134104, 134106, 134108-134109, 134111-134114, 134116-134129, 134131-134133, 134135, 134137, 134139-134141, 134143-134144, 134147, 134150-134155, 134157-134158, 134164-134165, 134169, 134171-134180, 134182-134184, 134187-134189, 134193-134196, 134200-134204, 134206-134207, 134209, 134211-134212, 134215-134220, 134222-134223, 134225-134230, 134232, 134235-134237, 134239-134242, 134244-134245, 134251-134252, 134254-134256, 134258, 134261-134262, 134264, 134266-134268, 134274-134276, 134278-134286, 134292-134298, 134300-134301, 134303, 134310-134311, 134314-134316, 134318-134322, 134324-134328, 134330-134331, 134338-134339, 134342, 134344-134347, 134349, 134351-134357, 134360, 134362, 134370, 134372-134374, 134380-134382, 134384, 134386-134388, 134390-134394, 134398, 134400-134401, 134403, 134405, 134407, 134409-134411, 134413, 134415, 134417, 134421, 134423, 134426-134428, 134430, 134433-134437, 134439, 134441-134444, 134447, 134451-134452, 134454-134456, 134459-134460, 134462, 134464-134468, 134470, 134472-134476, 134478, 134482-134483, 134486, 134488, 134491, 134493-134494, 134497-134509, 134511, 134513-134516, 134518, 134521-134522, 134525, 134527, 134529-134530, 134532-134533, 134535-134536, 134541-134543, 134546, 134548, 134550-134552, 134555-134564, 134568-134569, 134571, 134573-134577, 134579-134580, 134582, 134584-134586, 134588-134590, 134593-134599, 134603-134605, 134608, 134611-134612, 134614-134615, 134617, 134620, 134623-134628, 134630-134631, 134635-134641, 134645-134649, 134651-134653, 134655-134658, 134660-134667, 134669, 134675, 134679-134680, 134683, 134685, 134687-134691, 134693-134697, 134699-134701, 134703-134709, 134712-134715, 134718, 134720-134724, 134726, 134731-134732, 134736-134744, 134747, 134749, 134751-134757, 134759-134761, 134763-134764, 134766-134769, 134772, 134774-134779, 134781, 134783-134785, 134787, 134791-134792, 134794-134796, 134800, 134803-134807, 134809, 134812, 134814, 134817, 134819-134821, 134824, 134826, 134828, 134831-134840, 134842, 134844-134845, 134847-

134852, 134854-134856, 134858-134860, 134862, 134864-134865, 134867, 134872-134873, 134877-134879, 134881, 134883, 134885-134892, 134895, 134897-134898, 134902-134905, 134907-134912, 134917-134918, 134921, 134923-134928, 134930-134935, 134937, 134939-134944, 134946, 134950-134951, 134956, 134958, 134960-134961, 134963-134964, 134966-134968, 134970-134974, 134978, 134980-134984, 134986, 134988-134989, 134992-134993, 134995-134996, 134999-135001, 135003-135004, 135006-135009, 135012-135018, 135023, 135025, 135028, 135030-135031, 135033-135035, 135037-135040, 135043-135044, 135046-135049, 135052, 135054, 135056-135058, 135060-135063, 135065-135067, 135069-135072, 135075, 135077, 135081-135082, 135084-135085, 135088-135090, 135092, 135095-135096, 135099-135100, 135102, 135104-135106, 135109-135110, 135112-135113, 135115, 135117-135118, 135120, 135122, 135124-135127, 135129-135130, 135132-135136, 135138, 135141-135144, 135146, 135149, 135153-135155, 135157-135158, 135160-135161, 135163-135164, 135166, 135168, 135172, 135174, 135176, 135178-135184, 135186, 135191-135193, 135195-135198, 135202-135204, 135206, 135209, 135211-135212, 135214-135215, 135219-135223, 135225-135230, 135232-135233, 135236-135242, 135244, 135246-135252, 135255-135258, 135260, 135265-135270, 135272, 135274-135275, 135277, 135282, 135284, 135286, 135288-135294, 135296-135298, 135301-135312, 135315-135316, 135318, 135321-135326, 135328-135335, 135338, 135340, 135343-135346, 135348-135349, 135352, 135356-135357, 135360-135361, 135363, 135369, 135371, 135374-135375, 135377-135378, 135381-135383, 135387, 135390, 135393-135395, 135397-135398, 135400-135404, 135406-135407, 135413-135414, 135416, 135419-135422, 135424, 135426-135431, 135433, 135436-135437, 135439-135441, 135443-135444, 135446, 135448, 135450, 135452-135454, 135456, 135459, 135462-135466, 135468-135474, 135476, 135478, 135480-135484, 135489, 135492, 135498-135499, 135504, 135506, 135510-135511, 135513-135514, 135516-135517, 135522, 135524, 135527, 135532-135533, 135536-135540, 135543, 135545-135546, 135549-135556, 135559, 135563-135564, 135567-135569, 135571-135572, 135575-135577, 135579, 135583, 135585-135587, 135589-135590, 135592-135595, 135598-135604, 135608-135620, 135624-135626, 135631, 135633, 135635-135639, 135641-135642, 135646-135650, 135652-135654, 135661-135672, 135674, 135676-135678, 135680-135685, 135687-135690, 135692, 135694-135695, 135698-135700, 135702-135707, 135709-135711, 135713, 135715, 135717-135718, 135720-135722, 135724, 135727-135731, 135733, 135740, 135745-135749, 135751-135752, 135754-135756, 135758-135761, 135766, 135771, 135776-135783, 135785, 135791, 135794, 135796-135798, 135800-135802, 135806-135809, 135811-135812, 135817-135824, 135826-135828, 135831-135838, 135840-135847, 135850, 135852, 135858, 135860-135861, 135867, 135869-135871, 135873, 135875-135876, 135879, 135881, 135883, 135885-135889, 135891-135902, 135904-135916, 135918-135920, 135923-135926, 135929-135932, 135934, 135937-135939, 135941, 135943, 135945-135946, 135948, 135953-135958, 135960-135961, 135963-135964, 135968, 135970-135972, 135974, 135976-135977, 135979-135980, 135982, 135985-135988, 135990-135993, 135995-135997, 135999-136001, 136003-136010, 136012, 136014-136015, 136017-136023, 136026-136031, 136033, 136036-136037, 136039-136059, 136061, 136064-136065, 136070-136071, 136073-136085, 136087-136089, 136091-136093, 136095-136109, 136111-136113, 136115-136119, 136122, 136124-136126, 136128, 136130-136131, 136135, 136137, 136140-136141, 136143-136145, 136147-136149, 136151, 136153-136156, 136158, 136160-136164, 136166-136167, 136169, 136172-136173, 136177, 136179, 136182-136186, 136188-136190, 136192, 136194-136197, 136199, 136208, 136210-136220, 136222-136224, 136227-136229, 136231, 136233-136239, 136241-136242, 136244-136245, 136247, 136250-136255, 136257, 136259-136260, 136262-136263, 136265, 136267, 136269-136272, 136275-136278, 136280-136299, 136301, 136305-136306, 136308-136310, 136312-136325, 136328, 136331-136338, 136340, 136342, 136344-136346, 136348-136349, 136351-136352, 136358-136367, 136369-136370, 136372-136373, 136377, 136380, 136382-136385, 136388, 136390, 136392-136407, 136409-136412, 136414, 136416-136418, 136420-136422, 136424-136425, 136427-136428, 136430, 136432, 136434-136440, 136442-136446, 136448, 136450, 136452, 136454-136455, 136459, 136464, 136466-136467, 136469-136472, 136475, 136477, 136480-136482, 136489, 136491-136493, 136495, 136499, 136501-136506, 136509-136517, 136519-136523, 136526-136534, 136537-136541, 136543, 136545, 136547-136549, 136552, 136554, 136556-136557, 136559, 136562-136563, 136565-136566, 136568, 136570, 136574, 136576, 136582-136585, 136589, 136594, 136596, 136600-136605, 136607-136608, 136610, 136612-136619, 136622, 136626, 136628-136630, 136633-136635, 136639-136641, 136645, 136649-136650, 136652-136655, 136658, 136664-136666, 136671-136674, 136676-136678, 136680, 136682-136684, 136686-136687, 136689, 136692-136696, 136702, 136710-136711, 136713, 136717-136718, 136721-136725, 136727-136730, 136732-136733, 136738-136741, 136743-136745, 136747-136753, 136757-136764, 136766-136768, 136772-136774, 136776, 136778-136780, 136782, 136785-136789, 136794-136796, 136798, 136801-136803, 136805-136808, 136810-136812, 136814, 136816-136817, 136819, 136823-136833, 136836-136844, 136846-136848, 136850, 136853, 136855, 136857-136861, 136864, 136866-136867, 136869-136874, 136876-136877, 136881-136882, 136884-136888, 136890-136896, 136899, 136902, 136904-136905, 136907-136908, 136910-136913, 136915-136916, 136918-136920, 136922, 136924-136928, 136930-136939, 136941-136942, 136945, 136949-136952, 136955-136956, 136958, 136960-136968, 136970-136974, 136980-136983, 136985-136991, 136994, 136996-137003, 137005, 137007-137017, 137019, 137021, 137024, 137027, 137030, 137032-137034, 137037, 137039-137041, 137043-137045, 137047-137060, 137064, 137067-137069, 137071-137072, 137076-137077, 137081, 137083-137085, 137088, 137090, 137097, 137099-137102, 137107-137110, 137118, 137121-137122, 137124-137125, 137127-137142, 137144-137146, 137150, 137157-137158, 137160, 137162-137170, 137172, 137174-137177, 137179-137181, 137183-137184, 137186-137194, 137196, 137198, 137200-137201, 137206-137209, 137211-137214, 137216-137217, 137219-137221, 137224-137225, 137227-137228, 137230-137231, 137233, 137237, 137239, 137241-137243, 137245-137246, 137248-137249, 137251, 137253-137258, 137260, 137262, 137264-137265, 137268, 137271-137274, 137276, 137283, 137285, 137287-137288, 137290-137292, 137294, 137296-137297, 137300-137301, 137305, 137307, 137309-137311, 137314-137316, 137318-137320, 137322, 137324-137330, 137332-137336, 137338, 137341-137345, 137347-137348, 137350-137354, 137356, 137359-137362, 137366, 137369-137372, 137375, 137377-137378, 137380-137382, 137385, 137389, 137394-137395, 137398, 137400-137404, 137407-137417, 137421-137424, 137426-137427, 137429, 137432-137433, 137435-137436, 137438-137440, 137442, 137444-137445, 137447-137450, 137452-137454, 137456-137458, 137460, 137463, 137465, 137467, 137469-137471, 137473, 137475-137476, 137479, 137481, 137483-137484, 137486-137492, 137494-137501, 137504, 137507-137510, 137512-137515, 137518, 137520-137521, 137523, 137527, 137529, 137531-137532, 137535-137539, 137541-137545, 137547-137548, 137550, 137552-137563, 137565, 137567, 137569-137575, 137578-137582, 137584, 137586-137587, 137589-137590, 137595, 137597-137600, 137602-137607, 137609-137610, 137614-137618, 137621-137622, 137624-137637, 137639-137641, 137643-137646, 137648-137659, 137663, 137666, 137668-137679, 137683-137687, 137689-137693, 137695-137697, 137699-137702, 137705-137710, 137712, 137714-137719, 137721-137727, 137730-137733, 137735, 137738, 137741, 137744-137749, 137751-137753, 137755, 137757-137758, 137760, 137764, 137766-137767, 137770, 137772, 137775-137782, 137785, 137789-137790, 137792, 137796, 137798-137800, 137803, 137805-137809, 137811-137815, 137819-137822, 137824, 137827, 137829, 137831-137837, 137839-137840, 137842, 137846, 137848-137850, 137857-137864, 137866-137867, 137869-137870, 137872, 137874-137876, 137878-137883, 137886-137887, 137892-137894, 137898, 137905, 137907, 137909, 137911-137913, 137915-137917, 137920, 137922, 137924, 137927, 137930, 137935-137936, 137940-137941, 137944-137946, 137948, 137950-137956, 137960, 137962-137964, 137970-137971, 137973-137985, 137988-137989, 137991-137992, 137994-137996, 137998, 138006, 138008-138012, 138014-138015, 138018, 138021-138027, 138030-138032, 138034, 138036-138039, 138043-138044, 138046-138049, 138051, 138053-138054, 138058, 138060-138061, 138063, 138065-138076, 138078-138082, 138084-138095, 138097, 138099-138101, 138103, 138106-138112, 138115-138118, 138120, 138122, 138124-138127, 138130-138132, 138134-138139, 138142-138143, 138145-138147, 138154-138156, 138158-138160, 138163-138168, 138170, 138173, 138176, 138178, 138180-138182, 138187-138200, 138202, 138204-138206, 138208, 138210-138211, 138215-138216, 138219-138225, 138228-138234, 138236, 138238-138242, 138244-138245, 138247, 138249, 138251, 138253-138257, 138259, 138263-138264, 138266, 138268-138269, 138271-138274, 138276-138277, 138279-138285, 138287, 138290-138291, 138293-138295, 138298-138299, 138301-138302, 138304-138309, 138311, 138314, 138318-138323, 138325, 138329, 138332-138333, 138341-138344, 138348-138349, 138351-138355, 138357, 138360-138362, 138364-138365, 138367-138370, 138372, 138375-138376, 138378-138382, 138384-138385, 138388-138392, 138396, 138399-138400, 138402-138403, 138405, 138407-138412, 138415-138417, 138419, 138421-138423, 138426-138429, 138433-138437, 138439, 138441-138446, 138448-138453, 138455, 138457, 138459, 138461, 138464-138468, 138471, 138473, 138475-138476, 138480-138482, 138484, 138487-138491, 138493-138494, 138498, 138500-138501, 138503-138507, 138509-138511, 138516, 138518-138519, 138521-138522, 138525-138526, 138528-138529, 138531-138534, 138536-138537, 138539-138543, 138546-138548, 138551-138553, 138557, 138559, 138561, 138564, 138568, 138570, 138572, 138574-138576, 138578-138585, 138587, 138589-138590, 138592, 138601-138602, 138606-138607, 138609-138615, 138617, 138619, 138621-138625, 138627-138628, 138631-138635, 138637-138638, 138642-138643, 138645-138646, 138649-138657, 138660, 138662, 138666, 138668, 138670-138672, 138674-138676, 138678, 138680-138682, 138684-138693, 138695-138705, 138712, 138714-138717, 138719-138721, 138723, 138725-138727, 138729, 138731, 138734, 138736-138737, 138741-138743, 138748-138753, 138757, 138760, 138762-138769, 138772-138774, 138776-138777, 138779-138781, 138783-138785, 138788-138791, 138793, 138795, 138800, 138802-138806, 138808, 138813-138818, 138821-138828, 138830-138831, 138833-138834, 138836-138846, 138848-138849, 138851, 138853, 138855-138863, 138865, 138868, 138872, 138875-138881, 138885, 138888-138890, 138893-138898, 138901-138905, 138907-138909, 138911-138912, 138914, 138916-138920, 138922-138929, 138933, 138935, 138937-138938, 138943-138946, 138948, 138951-138954, 138956-138959, 138962-138968, 138970-138974, 138976-138978, 138980-138981, 138983, 138987, 138990-138995, 138997-138998, 139000, 139002-139004, 139006-139007, 139010-139016, 139019-139020, 139022, 139024, 139027, 139029-139031, 139033-139036, 139038-139039, 139042, 139044, 139046-139048, 139050-139052, 139054-139060, 139062, 139066-139073, 139076-139077, 139079, 139081-139083, 139085-139086, 139089-139090, 139094, 139096-139098, 139100-139102, 139109-139110, 139115-139117, 139120-139121, 139123, 139125, 139127-139130, 139133, 139135-139141, 139146, 139148-139149, 139151, 139154-139158, 139161-139163, 139165-139175, 139178, 139180, 139182, 139187-139190, 139192, 139194-139195, 139197, 139199, 139201, 139203-139204, 139206-139209, 139214, 139216-139225, 139228, 139230-139231, 139233-139236, 139239, 139241-139242, 139244-139245, 139249-139250, 139252-139253, 139255, 139257, 139259-139261, 139263-139267, 139272, 139274-139282, 139284, 139286-139287, 139291-139293, 139295, 139297-139298, 139300, 139302, 139305-139307, 139309, 139311-139315, 139317, 139319-139320, 139323-139325, 139327, 139329-139331, 139333, 139336-139344, 139347-139355, 139357-139361, 139363, 139365, 139367-139368, 139371, 139373-139374, 139376-139377, 139379-139381, 139383, 139386, 139388, 139390-139392, 139394-139395, 139398, 139400, 139402-139404, 139407-139409, 139412, 139414-139421, 139423, 139425-139426, 139429, 139431-139433, 139435, 139438, 139440-139441, 139443, 139447-139448, 139450-139451, 139454-139463, 139466, 139468-139469, 139472-139474, 139478-139484, 139486-139489, 139492, 139495-139498, 139502, 139504-139505, 139507-139509, 139511-139513, 139515-139516, 139521, 139525, 139529-139531, 139533-139534, 139536-139540, 139543-139544, 139547-139550, 139552, 139555-139558, 139560-139563, 139573, 139575, 139578-139581, 139588, 139591-139593, 139595-139596, 139599, 139606-139611, 139614-139615, 139617-139620, 139622, 139624-139625, 139627-139629, 139632-139639, 139641, 139643, 139645-139646, 139648-139650, 139652, 139655-139666, 139668-139672, 139674, 139676-139680, 139682-139684, 139687-139688, 139691-139692, 139694-139695, 139700-139701, 139704-139706, 139711, 139713-139714, 139716, 139718-139722, 139724-139726, 139728-139729, 139731-139732, 139735, 139738-139755, 139759, 139761-139762, 139764, 139766, 139768, 139771, 139776-139777, 139781, 139783-139786, 139788, 139790-139796, 139800-139801, 139803-139806, 139808-139810, 139812, 139814, 139820-139824, 139829-139831, 139833, 139835, 139837-139839, 139841, 139844-139845, 139847-139851, 139854, 139860-139862, 139864, 139868-139869, 139878-139882, 139885, 139887, 139889-139891, 139893, 139897, 139900-139902, 139904-139905, 139907-139909, 139911-139913, 139916, 139918-139921, 139923, 139926, 139928, 139931, 139933, 139937, 139940, 139942-139943, 139946, 139948-139952, 139956-139963, 139965-139968, 139971, 139973-139977, 139979-139980, 139983, 139986-139992, 139996, 139998-140000, 140002-140003, 140005-140009, 140013, 140017-140018, 140020, 140023, 140025-140033, 140035-140036, 140038-140039, 140041, 140044-140045, 140055, 140057, 140059-140060, 140062, 140065, 140067, 140069-140070, 140074-140075, 140082-140083, 140088, 140091-140093, 140096-140098, 140100-140102, 140108, 140111-140113, 140115-140116, 140122-140123, 140125-140127, 140130, 140133-140134, 140141, 140143, 140154-140167, 140170, 140172, 140174, 140177-140178, 140180, 140182-140183, 140188, 140191-140200, 140202-140203, 140205-140206, 140208-140212, 140214, 140216, 140218-140221, 140223-140227, 140230, 140233, 140235, 140237, 140240, 140242-140243, 140248-140249, 140251, 140253, 140255-140258, 140260-140264, 140266-140269, 140271, 140273-140278, 140280-140285, 140287, 140291-140297, 140299, 140303-140308, 140310-140312, 140314, 140316-140318, 140320, 140322-140330, 140332-140335, 140343-140346, 140348-140350, 140352-140353, 140355-140357, 140361-140367, 140370-140373, 140375, 140378, 140380-140383, 140385-140396, 140398-140402, 140404-140407, 140409-140411, 140413, 140415-140418, 140422-140423, 140425-140428, 140431, 140433-140441, 140443-140444, 140448-140450, 140452-140453, 140455, 140457-140459, 140461-140462, 140466-140467, 140469-140472, 140474-140480, 140482-140485, 140487-140490, 140492-140493, 140495, 140497, 140500-140504, 140507-140511, 140513-140515, 140517-140522, 140524, 140526-140528, 140531, 140533, 140535, 140538-140539, 140541-140550, 140552-140561, 140563-140573, 140575-140576, 140578-140580, 140582-140583, 140585, 140587-140590, 140593, 140595, 140597-140599, 140602, 140604, 140607-140610, 140613-140617, 140620, 140623-140627, 140629-140632, 140634, 140636, 140641-140643, 140645-140646, 140650-140651, 140653-140654, 140657, 140659-140667, 140669-140672, 140675-140678, 140680, 140684-140685, 140687, 140689, 140695-140697, 140699, 140702, 140705, 140710-140712, 140714-140718, 140720-140721, 140725, 140728, 140730, 140733, 140735-140739, 140741-140742, 140744-140745, 140747, 140749-140755, 140757-140758, 140760, 140766-140767, 140769, 140771, 140774-140777, 140779-140781, 140784-140785, 140787, 140789, 140791-140793, 140795, 140797-140802, 140804, 140807-140810, 140812, 140815, 140818-140821, 140824-140825, 140828-140829, 140831-140832, 140834-140837, 140842-140849, 140853, 140855-140858, 140861-140862, 140864-140865, 140867, 140869-140871, 140873, 140878-140879, 140881-140886, 140889-140891, 140893, 140895, 140897-140898, 140900-140903, 140905-140909, 140913-140916, 140920-140923, 140929, 140933, 140937, 140939-140940, 140942, 140945-140950, 140952, 140955-140958, 140963-140965, 140970, 140973-140974, 140976-140979, 140982, 140985-140986, 140988-140989, 140991-140994, 140997-140998, 141000, 141002, 141004-141009, 141011, 141013-141017, 141020, 141024-141026, 141030, 141033-141038, 141040, 141042-141043, 141045, 141047, 141049-141052, 141055-141057, 141059-141065, 141067, 141073-141076, 141082-141086, 141089-141091, 141093-141099, 141101, 141104-141105, 141107, 141110-141111, 141113, 141117-141123, 141127, 141132-141133, 141135-141136, 141140-141141, 141144, 141146, 141150, 141153-141158, 141160-141166, 141169, 141172, 141176-141182, 141184, 141190, 141192-141201, 141205-141209, 141211-141216, 141218-141221, 141223, 141226-141230, 141233-141235, 141237-141239, 141242-141243, 141245, 141248-141252, 141255, 141259, 141262, 141264-141269, 141271, 141273-141277, 141282-141284, 141286-141293, 141296-141298, 141301-141305, 141307, 141309-141314, 141316-141319, 141322-141329, 141331-141336, 141338-141341, 141344-141348, 141350, 141353-141359, 141362-141365, 141368-141378, 141380-141387, 141389, 141394-141403, 141405-141411, 141416-141417, 141419-141423, 141425-141432, 141435-141436, 141440-141443, 141450-141452, 141454-141455, 141458, 141460, 141463-141465, 141467-141471, 141473, 141475-141476, 141480, 141484-141485, 141488, 141490, 141492-141493, 141496, 141498-141500, 141502, 141504-141506, 141508-141516, 141519, 141521-141524, 141526-141537, 141542-141543, 141546-141547, 141550, 141553-141557, 141560, 141562, 141564-141565, 141567, 141572, 141574, 141576-141578, 141583-141585, 141587, 141589-141590, 141592-141596, 141599-141604, 141606, 141608-141611, 141613-141614, 141616-141617, 141622, 141624-141629, 141632, 141634, 141636, 141638-141642, 141644-141648, 141650, 141652-141655, 141657-141660, 141662-141663, 141666-141667, 141669, 141674-141675, 141679-141681, 141683, 141693, 141695, 141697, 141699-141701, 141703-141709, 141712, 141714-141716, 141718-141719, 141725-141729, 141731-141732, 141735, 141737, 141739-141740, 141742, 141744-141747, 141749-141751, 141756-141757, 141759-141762, 141764-141774, 141777-141779, 141781, 141783-141789, 141792, 141794-141798, 141801-141815, 141817-141820, 141822-141824, 141827-141828, 141831-141832, 141834-141835, 141837, 141839, 141842, 141844, 141846, 141851-141852, 141855-141856, 141858-141860, 141864, 141866-141867, 141869-141870, 141872-141881, 141883-141896, 141902, 141905-141910, 141913, 141915-141916, 141918-141931, 141933, 141935-141939, 141942, 141945-141946, 141948-141952, 141954, 141957, 141960, 141962, 141966-141967, 141969-141970, 141973, 141975-141976, 141978-141980, 141983, 141985, 141987-141988, 141990-141992, 141996-142000, 142002-142011, 142013, 142015, 142017-142026, 142028-142031, 142033-142038, 142041-142042, 142044-142045, 142047, 142049-142050, 142053, 142056, 142058-142059, 142068-142076, 142078, 142081-142086, 142088-142089, 142091-142094, 142096, 142108, 142110-142118, 142120-142123, 142125-142131, 142133, 142135, 142138-142148, 142150-142152, 142154, 142156, 142159-142163, 142166-142168, 142170-142171, 142173-142174, 142176-142177, 142179, 142181, 142184-142187, 142189-142190, 142192-142193, 142195-142198, 142201-142203, 142205-142206, 142208, 142211, 142213, 142216, 142219-142220, 142222-142223, 142225, 142227-142229, 142231-142235, 142237, 142239-142241, 142243-142245, 142247-142248, 142251-142252, 142254-142256, 142258, 142260-142261, 142263-142266, 142268, 142270, 142274-142276, 142279-142281, 142283, 142285, 142287-142293, 142296-142297, 142299, 142302-142303, 142307-142308, 142310-142312, 142315, 142319, 142322-142325, 142327-142334, 142336-142338, 142340-142343, 142345, 142347-142349, 142351, 142353, 142355, 142357, 142359, 142362-142363, 142365-142366, 142368, 142370-142374, 142377-142378, 142380, 142382-142383, 142385, 142390-142391, 142393-142399, 142401-142403, 142406-142413, 142415, 142417, 142419, 142421, 142424-142425, 142427-142428, 142431, 142433, 142435-142438, 142440, 142443, 142445, 142449, 142451, 142453, 142457, 142459-142464, 142466-142468, 142470-142471, 142473-142477, 142479, 142481, 142483-142488, 142492, 142496, 142498-142500, 142502-142503, 142506, 142508, 142510-142513, 142515, 142517, 142519-142522, 142524-142525, 142528, 142531-142532, 142536, 142538-142539, 142541-142545, 142550-142558, 142560-142566, 142569, 142571-142574, 142577, 142579, 142581, 142584-142585, 142588, 142590-142591, 142595, 142598, 142602, 142604-142606, 142610, 142612-142613, 142617, 142619-142620, 142624, 142626-142628, 142631, 142633-142634, 142636-142637, 142639-142640, 142645-142658, 142660-142661, 142663-142664, 142667, 142670-142674, 142678-142682, 142685-142689, 142693-142694, 142696, 142698-142699, 142701, 142704-142705, 142708, 142715-142718, 142721-142728, 142732, 142734, 142736, 142739-142740, 142742, 142745, 142747-142748, 142751, 142754-142755, 142757-142762, 142764, 142766-142771, 142773, 142775, 142777, 142779-142780, 142785, 142787, 142789-142791, 142793-142794, 142796, 142798, 142800-142801, 142803, 142805, 142807-142812, 142814, 142816, 142820-142823, 142825-142836, 142838-142841, 142843-142847, 142849-142850, 142852-142853, 142855, 142857-142859, 142861-142868, 142870-142874, 142876, 142879, 142881, 142883, 142885, 142887, 142890-142893, 142895, 142898, 142900-142901, 142903, 142907-142910, 142913-142917, 142919-142921, 142923, 142926-142927, 142929-142935, 142937-142939, 142941-142944, 142946-142947, 142949, 142951-142952, 142954, 142956, 142960-142966, 142970-142975, 142977-142980, 142982-142990, 142992-142993, 142995-142997, 142999, 143001, 143005, 143007-143010, 143012-143014, 143016-143020, 143025-143028, 143031-143032, 143036-143037, 143039, 143043-143045, 143047, 143049-143051, 143053-143058, 143060-143062, 143064-143068, 143070-143079, 143082-143086, 143089-143095, 143098-143099, 143102-143106, 143108-143115, 143117-143120, 143122, 143124-143126, 143129-143138, 143140-143141, 143144-143147, 143149-143153, 143155, 143157-143158, 143160-143162, 143165-143169, 143171-143176, 143179, 143181, 143183-143193, 143196-143197, 143200-143203, 143206-143208, 143211-143215, 143220-143221, 143223, 143225-143226, 143228-143236, 143240, 143242, 143244-143248, 143253-143256, 143259-143265, 143267-143268, 143270, 143272-143285, 143287-143289, 143291, 143293-143300, 143304-143306, 143311-143314, 143318-143321, 143324, 143327-143330, 143334-143336, 143338, 143341-143343, 143345-143346, 143349, 143356-143358, 143362-143365, 143367-143368, 143371-143377, 143379-143380, 143385, 143388-143391, 143394-143397, 143399, 143403, 143405-143407, 143409-143410, 143412, 143414, 143416-143418, 143421, 143424, 143426-143427, 143429-143431, 143433-143435, 143437-143438, 143440, 143443-143444, 143446-143452, 143456-143458, 143460, 143462-143464, 143466, 143469-143472, 143474-143475, 143477-143481, 143485, 143487-143488, 143490-143496, 143498, 143500, 143505-143509, 143512, 143515-143524, 143527-143532, 143534, 143536-143537, 143539-143541, 143543-143547, 143549, 143551-143553, 143555-143559, 143561, 143563, 143566-143567, 143570-143579, 143581-143585, 143588-143590, 143592-143593, 143596-143597, 143600, 143602-143613, 143616, 143618, 143625-143628, 143631-143635, 143638, 143640-143644, 143646, 143648, 143650, 143652, 143654-143656, 143659-143662, 143664, 143666-143668, 143670, 143672-143679, 143683-143685, 143687-143694, 143696, 143702, 143707-143710, 143712, 143714, 143716-143717, 143719-143722, 143724, 143727-143728, 143730-143732, 143734-143736, 143739, 143742, 143744, 143746-143747, 143750-143751, 143753, 143757, 143759-143760, 143762-143765, 143767, 143770, 143773-143778, 143780, 143782-143783, 143785-143786, 143788-143793, 143796, 143799, 143803-143807, 143810, 143812, 143814, 143817-143823, 143827, 143829-143830, 143832-143835, 143837-143843, 143847, 143853-143855, 143857-143864, 143866-143867, 143870-143876, 143880-143885, 143887-143896, 143898, 143900-143912, 143915-143917, 143921, 143923-143927, 143930-143934, 143937-143939, 143941-143944, 143946, 143948, 143950-143951, 143953-143957, 143959, 143962-143969, 143971-143972, 143974-143976, 143978-143979, 143984, 143986, 143988, 143992-143993, 143995, 143998, 144000, 144002-144011, 144016-144018, 144020, 144023, 144025-144028, 144030, 144032-144038, 144042, 144045-144047, 144051, 144054-144061, 144064-144068, 144070-144078, 144081-144083, 144086-144089, 144091-144101, 144103-144106, 144108-144115, 144117-144119, 144121-144122, 144124, 144126-144133, 144139, 144141-144143, 144148, 144151, 144156-144157, 144159, 144161-144169, 144172-144176, 144179, 144181, 144183-144187, 144189-144190, 144192-144193, 144195-144196, 144198-144201, 144205-144212, 144215-144217, 144219-144220, 144222-144229, 144231-144233, 144236, 144238-144239, 144241-144243, 144248-144249, 144253-144255, 144258-144259, 144261, 144265-144272, 144274-144276, 144278-144285, 144289-144291, 144293-144303, 144307, 144309-144310, 144312, 144314, 144316-144317, 144323-144327, 144329-144331, 144333-144336, 144338-144339, 144341-144343, 144347-144348, 144351-144352, 144354, 144357-144359, 144361-144363, 144365-144367, 144369-144375, 144378-144380, 144382-144384, 144386-144387, 144389, 144391-144394, 144397, 144399-144401, 144404, 144406-144408, 144410-144413, 144419-144425, 144427-144428, 144431, 144434-144435, 144437-144439, 144441, 144443-144444, 144446-144453, 144455-144457, 144459-144460, 144465-144467, 144469-144472, 144475-144476, 144478, 144481-144484, 144486-144488, 144491-144495, 144497, 144500-144502, 144504, 144506, 144510-144511, 144513-144519, 144521-144522, 144524, 144531, 144534-144536, 144538-144543, 144547-144552, 144554, 144556, 144558-144565, 144567, 144569-144573, 144576-144578, 144580, 144584-144594, 144597-144600, 144602, 144604, 144607-144610, 144615-144617, 144620, 144622-144631, 144633-144638, 144640, 144644, 144646-144647, 144650, 144653, 144655-144658, 144661-144662, 144665-144667, 144669-144673, 144681, 144687, 144690, 144692-144693, 144695-144697, 144699-144703, 144705, 144707-144709, 144711-144713, 144715-144716, 144718-144719, 144721-144723, 144728-144730, 144733, 144736, 144739-144740, 144742-144747, 144751, 144753-144754, 144757-144760, 144762, 144764-144766, 144770-144773, 144775-144777, 144780-144782, 144784-144796, 144798, 144800-144801, 144803-144804, 144806, 144808-144811, 144814-144815, 144819, 144824-144825, 144829-144832, 144834, 144836-144839, 144841-144843, 144845-144847, 144850-144851, 144856, 144859-144869, 144871-144872, 144877-144878, 144881-144882, 144885, 144887, 144891-144892, 144894-144896, 144898-144899, 144902-144903, 144905, 144908-144911, 144913, 144915, 144917-144920, 144924, 144926-144927, 144930, 144932, 144934, 144937-144938, 144940-144960, 144962-144963, 144965, 144967, 144969, 144971-144973, 144975, 144977-144978, 144982, 144984-144988, 144990-144991, 144995, 144997-145002, 145004, 145008-145010, 145014, 145017-145025, 145027, 145029-145032, 145035-145036, 145040-145043, 145047, 145053-145055, 145057-145059, 145061-145065, 145068, 145070, 145072-145073, 145075-145077, 145079-145081, 145084-145087, 145093, 145095, 145097-145100, 145102, 145104, 145106-145108, 145110, 145113, 145116, 145119, 145124, 145126, 145128-145129, 145131-145132, 145134-145138, 145140, 145145, 145147, 145149, 145151, 145153-145154, 145157-145159, 145161, 145163-145168, 145170-145172, 145175-145189, 145191-145197, 145199, 145201, 145205-145209, 145211-145221, 145223-145225, 145227-145228, 145231, 145234-145238, 145241, 145245-145252, 145254, 145257, 145259-145262, 145265-145267, 145269-145274, 145276, 145279-145282, 145284-145287, 145289, 145291-145292, 145294-145296, 145298-145299, 145303-145305, 145308, 145310, 145312, 145314, 145316-145319, 145321-145325, 145327-145334, 145336-145338, 145340-145345, 145348-145352, 145355, 145357-145358, 145360, 145362, 145367, 145369, 145373, 145375, 145377-145378, 145380-145385, 145387-145390, 145394-145399, 145402-145403, 145406, 145408, 145410-145411, 145414-145415, 145417-145419, 145422-145444, 145446-145453, 145455, 145457, 145459, 145461-145468, 145470, 145474-145480, 145483, 145490-145494, 145496, 145498-145499, 145501-145502, 145505-145506, 145510, 145519-145521, 145523, 145527, 145530, 145532, 145534, 145536-145537, 145539, 145541-145542, 145546-145548, 145550-145551, 145553, 145555-145561, 145563-145564, 145566, 145568, 145570-145571, 145575, 145577, 145579, 145581, 145583, 145586-145587, 145589-145590, 145592, 145594, 145596-145598, 145601, 145606, 145611, 145613, 145616-145621, 145623-145635, 145637-145648, 145650, 145653, 145655, 145657-145659, 145661-145675, 145678-145687, 145691-145692, 145696-145704, 145709, 145713, 145715, 145719-145720, 145722, 145731-145735, 145737, 145739-145740, 145742-145744, 145746-145750, 145752, 145754-145771, 145777-145781, 145783-145786, 145788-145792, 145794-145796, 145798, 145804, 145806-145809, 145811-145813, 145815-145833, 145835-145837, 145839-145847, 145849-145851, 145853-145855, 145857-145862, 145866-145877, 145883-145886, 145888-145890, 145892-145893, 145895, 145897-145900, 145902-145908, 145910-145914, 145917-145921, 145923-145926, 145928-145929, 145932-145934, 145937-145938, 145940, 145942-145944, 145946-145947, 145949-145953, 145955, 145958, 145961, 145965-145966, 145969, 145975, 145977-145979, 145981-145982, 145985, 145989, 145992-145993, 145995-145996, 145998, 146000-146002, 146005-146008, 146011, 146013-146021, 146023-146024, 146026-146031, 146040-146042, 146044, 146049, 146051, 146055, 146057-146058, 146060-146063, 146065, 146067-146069, 146071, 146074, 146076-146079, 146081-146084, 146086, 146089, 146091, 146093-146095, 146098, 146100-146101, 146105-146108, 146111-146112, 146116-146117, 146120-146122, 146124-146125, 146127, 146130, 146132-146138, 146140, 146146-146148, 146151-146157, 146161, 146165, 146169, 146172, 146174, 146176, 146178-146182, 146186-146189, 146191-146192, 146195-146198, 146200-146205, 146208-146215, 146220-146222, 146225-146229, 146231, 146233-146235, 146238-146240, 146242-146244, 146246-146248, 146253-146257, 146259, 146262-146267, 146270, 146272-146278, 146281-146282, 146285-146294, 146298-146299, 146303-146307, 146310-146311, 146313-146314, 146317-146322, 146324-146331, 146333-146339, 146342, 146345, 146347-146351, 146354, 146356, 146358-146361, 146363-146368, 146370, 146373, 146375, 146377-146378, 146382, 146385, 146387-146391, 146393, 146400-146405, 146408-146409, 146411-146413, 146415-146416, 146418-146420, 146423-146430, 146432-146434, 146436-146437, 146440-146444, 146446-146447, 146449, 146451, 146453-146454, 146458, 146462, 146464, 146467, 146471-146473, 146475, 146477-146478, 146480-146482, 146484-146487, 146492, 146494-146495, 146498-146499, 146502-146503, 146505, 146508-146510, 146513-146515, 146520-146523, 146525, 146528-146531, 146533-146537, 146539, 146541-146542, 146546, 146548-146549, 146551, 146555, 146557-146558, 146560-146566, 146569, 146571, 146574-146575, 146578-146579, 146581-146585, 146587-146591, 146595, 146598, 146601-146605, 146608-146610, 146615-146616, 146619, 146622-146626, 146629-146630, 146633, 146635-146639, 146641-146642, 146644-146645, 146647-146653, 146656-146657, 146659-146660, 146662, 146665, 146668, 146670-146676, 146678, 146682-146683, 146687-146690, 146692, 146694-146695, 146697-146699, 146703-146706, 146712-146714, 146716-146717, 146719-146728, 146731-146732, 146735, 146737, 146740, 146742, 146744, 146746-146747, 146749-146752, 146754, 146759-146762, 146764-146768, 146770-146777, 146780, 146785-146787, 146790, 146792-146798, 146803, 146806, 146808-146811, 146813-146814, 146819-146821, 146823, 146826, 146829, 146831-146834, 146836, 146838-146846, 146848-146849, 146851, 146853, 146856-146862, 146865, 146867, 146870-146871, 146873, 146875-146878, 146880-146882, 146885-146887, 146891, 146894-146896, 146898-146899, 146906, 146909, 146911-146913, 146915-146916, 146919-146920, 146922, 146925-146928, 146933-146936, 146939-146943, 146945-146950, 146952-146956, 146958-146960, 146962, 146964-146968, 146971-146974, 146977, 146986-146989, 146992-146996, 146998-146999, 147002-147003, 147005, 147007-147008, 147010-147012, 147014-147015, 147017-147021, 147023, 147025-147026, 147030, 147032-147045, 147053, 147055-147066, 147070, 147073-147075, 147077-147079, 147082-147084, 147087-147091, 147093-147094, 147096-147097, 147099-147100, 147102-147103, 147105-147106, 147108, 147110, 147112-147117, 147119-147120, 147122-147124, 147128, 147130, 147132-147136, 147138-147149, 147152-147155, 147157-147159, 147161, 147165, 147167-147172, 147177, 147179-147184, 147186, 147188, 147192, 147195-147208, 147210, 147213-147214, 147217-147218, 147221-147222, 147227, 147230, 147232-147237, 147241, 147243, 147246-147247, 147249-147250, 147252-147254, 147256, 147259-147260, 147264-147265, 147268-147273, 147275-147279, 147281-147285, 147287-147294, 147296, 147301, 147303, 147308, 147311-147312, 147314-147326, 147330, 147332-147333, 147336-147337, 147339-147341, 147343-147344, 147346-147350, 147354, 147356-147357, 147359-147364, 147366, 147370-147371, 147373, 147375, 147377-147381, 147383, 147385-147389, 147391-147392, 147394-147395, 147397, 147399-147400, 147403-147404, 147407, 147409-147417, 147420-147426, 147428, 147430-147432, 147434, 147436-147442, 147444-147447, 147449-147450, 147452-147453, 147456, 147459-147462, 147466, 147468-147473, 147475, 147477-147478, 147480, 147482-147484, 147486-147488, 147490-147492, 147495-147496, 147498-147501, 147505-147509, 147513, 147515-147516, 147518, 147520-147521, 147524-147526, 147528-147536, 147538-147540, 147542-147543, 147545-147546, 147548-147550, 147552-147555, 147557, 147560, 147564-147567, 147569, 147571, 147573-147581, 147586-147599, 147604-147609, 147611, 147614-147619, 147621, 147623, 147625-147627, 147629, 147631-147632, 147634-147638, 147642-147647, 147650-147657, 147659-147661, 147663-147669, 147672-147677, 147679, 147681, 147683-147705, 147708-147709, 147711-147718, 147721-147726, 147728-147729, 147733, 147735-147737, 147739-147744, 147746, 147750, 147753-147754, 147756-147757, 147761-147764, 147769-147771, 147777, 147779-147783, 147790, 147792, 147795-147800, 147802-147804, 147807-147815, 147818-147822, 147824, 147826, 147828-147830, 147836-147840, 147842-147846, 147848-147853, 147855-147856, 147858-147859, 147861, 147863-147871, 147873-147874, 147876, 147879, 147881-147888, 147892, 147894-147898, 147900-147901, 147907-147911, 147913-147916, 147918-147920, 147922-147923, 147925-147929, 147931, 147934-147935, 147937-147945, 147948, 147950-147952, 147954-147955, 147957-147963, 147966, 147968-147974, 147976, 147979-147983, 147986-147989, 147991-147993, 147997-147998, 148001, 148003-148004, 148006-148008, 148010, 148012-148017, 148019-148022, 148025-148028, 148030-148034, 148036, 148039-148042, 148044, 148046-148049, 148051-148053, 148055-148058, 148060-148062, 148070-148076, 148078-148079, 148081-148091, 148094-148095, 148098-148099, 148101-148104, 148106-148108, 148110-148112, 148116-148120, 148125-148133, 148136, 148139-148144, 148146-148151, 148155, 148158-148166, 148169, 148171, 148173-148176, 148178-148179, 148181, 148183-148184, 148189-148192, 148194-148198, 148205-148208, 148210-148211, 148214, 148216-148220, 148222-148224, 148227-148228, 148232-148237, 148239, 148242-148243, 148246-148249, 148251-148252, 148255-148257, 148259-148260, 148262, 148264-148265, 148269-148270, 148272-148273, 148276, 148278, 148280-148282, 148284, 148286-148294, 148297-148300, 148302-148306, 148310, 148317, 148320-148323, 148326-148330, 148332-148334, 148336-148339, 148342, 148344, 148347-148348, 148350-148354, 148357-148360, 148362, 148365-148370, 148373-148375, 148377, 148379-148388, 148390-148392, 148394, 148396, 148398, 148400-148401, 148403-148404, 148406-148424, 148426, 148428-148429, 148431, 148433-148439, 148443-148453, 148455, 148457-148459, 148462-148464, 148466-148468, 148470, 148472-148476, 148478-148479, 148483-148485, 148489, 148491, 148497, 148499, 148503-148519, 148521-148522, 148525-148529, 148531-148532, 148534-148537, 148539-148540, 148542-148545, 148547, 148549, 148552-148554, 148556, 148558-148568, 148570, 148572, 148574-148576, 148578, 148581-148583, 148585-148586, 148588-148591, 148593-148597, 148600-148606, 148608-148609, 148611-148614, 148616, 148618, 148620-148621, 148623-148627, 148630-148632, 148634-148640, 148642-148644, 148648, 148651-148653, 148656, 148660-148661, 148663, 148665, 148668-148669, 148672, 148674, 148677-148679, 148681, 148683, 148687, 148689, 148692, 148694-148698, 148700-148713, 148716, 148718-148723, 148725-148726, 148728, 148730-148734, 148736-148742, 148747, 148749-148754, 148756, 148758, 148762-148766, 148768, 148771-148773, 148775, 148777-148779, 148783-148788, 148790-148793, 148795-148796, 148798-148800, 148803, 148805-148812, 148814, 148817-148819, 148821-148831, 148834-148836, 148838-148839, 148841, 148844-148848, 148850-148851, 148853, 148855-148860, 148862-148868, 148870-148871, 148873-148874, 148876-148877, 148880, 148882-148889, 148891-148894, 148896, 148899-148902, 148904, 148906-148908, 148911-148915, 148917, 148922-148925, 148927, 148929-148930, 148932-148933, 148935, 148938, 148940-148944, 148947-148949, 148951-148954, 148956-148957, 148961, 148964, 148967-148973, 148979-148982, 148984-148985, 148988-148989, 148991-148992, 148994-148996, 148998, 149000-149001, 149004, 149007-149011, 149015-149016, 149018-149019, 149021-149025, 149027-149036, 149038-149040, 149042, 149046-149052, 149055-149056, 149059, 149061-149063, 149066-149076, 149079-149083, 149085, 149087, 149089-149094, 149096-149100, 149104, 149107-149109, 149111, 149115-149119, 149121, 149123-149127, 149129-149137, 149139-149140, 149142-149152, 149154-149164, 149168, 149170, 149172-149173, 149176-149177, 149179-149182, 149185-149186, 149188, 149192-149193, 149195, 149199, 149201, 149203-149215, 149218-149220, 149222-149223, 149225-149228, 149230, 149232-149233, 149235, 149238-149240, 149242-149243, 149245, 149247, 149249-149255, 149257, 149260, 149262-149263, 149266, 149268-149269, 149271-149277, 149279-149286, 149288-149298, 149300, 149302-149303, 149305-149313, 149315-149316, 149318-149327, 149329-149334, 149337, 149343, 149345-149347, 149351-149353, 149355-149360, 149362-149363, 149366, 149369-149376, 149378-149379, 149381, 149384, 149386, 149390, 149392, 149394-149395, 149398-149399, 149406-149407, 149409-149412, 149414-149418, 149421, 149428-149431, 149434-149435, 149438, 149440-149445, 149453-149456, 149458, 149460-149461, 149464-149466, 149468, 149470-149471, 149473-149474, 149476-149483, 149485, 149488, 149490-149494, 149498-149501, 149505-149513, 149517-149520, 149522, 149525-149527, 149529-149531, 149533-149538, 149540-149542, 149545-149546, 149548-149551, 149553, 149555, 149557-149570, 149572, 149575-149577, 149581-149583, 149586-149587, 149589, 149591-149595, 149597-149601, 149603, 149605-149607, 149611, 149613, 149615, 149618, 149622-149623, 149627-149628, 149630, 149632, 149635, 149637-149639, 149641, 149643, 149648, 149650-149654, 149656-149658, 149661, 149663-149668, 149670-149673, 149676-149678, 149680-149683, 149686, 149688-149689, 149691-149696, 149699-149701, 149703-149707, 149711, 149716, 149719-149721, 149724, 149727-149731, 149733-149736, 149738-149742, 149744-149751, 149753, 149756, 149758-149764, 149769, 149771-149774, 149776, 149778, 149780, 149782-149783, 149785-149789, 149791-149798, 149800, 149804-149808, 149810-149813, 149816, 149820, 149822-149824, 149826, 149829-149833, 149835-149836, 149838, 149840-149844, 149850, 149853, 149856-149857, 149859-149860, 149862-149867, 149869-149871, 149874, 149876-149877, 149879-149881, 149888-149896, 149898-149899, 149901, 149903, 149908-149909, 149911, 149913-149914, 149916-149924, 149926-149934, 149936, 149940, 149943-149953, 149955, 149958-149959, 149961-149965, 149967, 149972-149977, 149980, 149983, 149987, 149989, 149992-149994, 149996-150005, 150009-150013, 150016, 150019-150022, 150024, 150026, 150028, 150030-150032, 150034-150037, 150040-150044, 150048-150054, 150056-150066, 150068, 150074, 150076-150077, 150079-150081, 150083-150084, 150090-150095, 150099, 150101-150103, 150105-150108, 150110, 150112-150113, 150115-150119, 150123-150126, 150129, 150132-150138, 150141, 150144-150146, 150148-150155, 150158, 150163-150171, 150173-150175, 150177, 150179-150181, 150186, 150193-150196, 150200, 150202-150203, 150207-150213, 150215-150216, 150218, 150220-150221, 150223-150224, 150226-150230, 150232-150235, 150238, 150240-150243, 150245-150247, 150251-150254, 150256-150258, 150260, 150263, 150266-150270, 150272, 150275-150276, 150279-150281, 150283-150284, 150287-150288, 150290-150291, 150296-150299, 150302, 150307, 150311, 150313, 150315-150317, 150323-150325, 150327, 150329-150333, 150335-150340, 150342-150345, 150347-150351, 150353-150360, 150362-150363, 150365-150369, 150372-150378, 150380-150381, 150383-150386, 150394-150398, 150400-150406, 150408-150410, 150412, 150414-150415, 150417-150418, 150420-150421, 150423-150427, 150429-150435, 150438-150449, 150452-150454, 150457-150460, 150463, 150466-150471, 150474-150476, 150478-150480, 150482-150483, 150486-150490, 150492, 150494-150495, 150497-150498, 150500-150502, 150504, 150506, 150508, 150510, 150512-150515, 150517-150518, 150520-150522, 150525, 150527-150528, 150530-150531, 150533-150535, 150537-150540, 150543-150545, 150547-150549, 150551-150553, 150555, 150558-150562, 150564-150565, 150567, 150571-150580, 150583-150586, 150588-150589, 150591, 150594-150595, 150597-150599, 150601-150611, 150613, 150615-150618, 150620-150622, 150624-150631, 150634-150636, 150638-150639, 150641-150646, 150649, 150651, 150653, 150655-150656, 150658-150660, 150663-150666, 150668, 150671-150675, 150677-150678, 150680-150685, 150687-150691, 150694-150695, 150697-150698, 150700, 150703, 150705, 150709-150711, 150713-150716, 150722, 150724, 150727-150728, 150730, 150732-150733, 150736-150737, 150739-150743, 150745, 150748-150751, 150754, 150756, 150758-150759, 150761-150762, 150764, 150767, 150769-150771, 150773-150776, 150779-150781, 150783-150785, 150788-150791, 150793-150795, 150802, 150805-150806, 150808-150815, 150818-150820, 150823-150826, 150830, 150835, 150837-150840, 150843-150848, 150851, 150855-150858, 150860, 150868-150875, 150877, 150882, 150885-150886, 150888, 150892, 150894, 150896, 150898-150901, 150903-150905, 150907-150908, 150910-150915, 150920-150922, 150925, 150927-150932, 150934, 150937-150939, 150941, 150943-150944, 150948-150949, 150951-150952, 150954, 150956-150958, 150962, 150964, 150966-150969, 150971, 150973-150980, 150983-150984, 150987, 150990-150993, 150995-150999, 151001-151003, 151005, 151008, 151010-151011, 151014-151017, 151019, 151021, 151023, 151025-151027, 151029-151031, 151034-151044, 151046-151051, 151053, 151055-151057, 151059-151061, 151063, 151065-151069, 151071, 151073-151074, 151077-151084, 151086, 151088-151092, 151094-151095, 151097-151102, 151105, 151109-151114, 151116-151118, 151124, 151126, 151129, 151131-151132, 151134-151137, 151141-151145, 151147, 151149-151151, 151153-151154, 151156-151157, 151161, 151163, 151165-151170, 151172, 151174-151175, 151177, 151179, 151181, 151187, 151189-151193, 151195-151197, 151199-151200, 151202-151207, 151209-151210, 151212-151217, 151219, 151223-151225, 151228-151230, 151233, 151236, 151238-151240, 151244, 151246-151264, 151270, 151273-151275, 151277-151281, 151283-151287, 151290-151291, 151298, 151301-151307, 151311, 151319, 151324, 151326, 151328-151332, 151334-151340, 151343-151349, 151351-151353, 151359-151360, 151362-151363, 151366, 151368-151372, 151374-151376, 151378-151380, 151382, 151384, 151389-151390, 151393, 151396-151398, 151400, 151403-151408, 151410-151412, 151414-151416, 151418-151419, 151421-151426, 151432-151433, 151436, 151439-151441, 151443-151447, 151449, 151452-151455, 151457, 151459-151467, 151470-151471, 151474-151475, 151478-151479, 151481-151482, 151487-151489, 151491-151493, 151495-151496, 151498, 151500-151501, 151505-151511, 151513, 151515-151516, 151518, 151520-151521, 151524-151530, 151532-151536, 151538, 151540-151542, 151544-151546, 151548-151549, 151552-151553, 151555-151562, 151564-151579, 151582-151584, 151586, 151588-151589, 151591, 151594-151595, 151597-151600, 151602-151606, 151608, 151612-151619, 151621-151631, 151634, 151636, 151638, 151644-151645, 151647-151649, 151651-151655, 151657-151661, 151663, 151666, 151668-151671, 151674-151675, 151682, 151684-151694, 151696, 151699, 151703-151706, 151708, 151712-151713, 151716, 151719-151720, 151723-151724, 151726-151728, 151730, 151732-151733, 151740, 151742-151746, 151748-151749, 151752-151753, 151755-151758, 151762, 151764-151767, 151769-151770, 151773-151774, 151777-151779, 151781-151783, 151785, 151788-151792, 151794, 151799-151800, 151802-151803, 151808, 151810, 151814-151819, 151822-151823, 151825, 151827-151828, 151831-151833, 151835, 151839, 151841-151843, 151845, 151847, 151849, 151851-151853, 151858-151859, 151862-151863, 151865, 151867-151868, 151870-151876, 151879-151881, 151887, 151889, 151891-151892, 151899-151903, 151905, 151907, 151909-151910, 151913, 151915-151917, 151920-151922, 151924-151925, 151927-151932, 151934-151938, 151941-151944, 151946-151951, 151953, 151955-151957, 151960-151962, 151964, 151966-151973, 151975-151983, 151985, 151987, 151989-152002, 152004, 152006, 152008-152017, 152020-152023, 152025, 152027-152031, 152034, 152036-152037, 152040, 152042, 152045-152047, 152049, 152052, 152054-152057, 152059-152064, 152066-152082, 152084-152085, 152088-152089, 152091-152095, 152097-152098, 152100-152101, 152104-152113, 152115-152120, 152122-152135, 152138-152144, 152147-152149, 152152-152158, 152160-152162, 152164-152165, 152167-152169, 152171, 152173, 152175-152176, 152178-152179, 152182-152183, 152185, 152187-152189, 152192-152195, 152197, 152200-152202, 152205-152208, 152210, 152213-152214, 152216-152224, 152226-152227, 152229-152230, 152232, 152234-152235, 152238-152239, 152241-152242, 152246, 152248, 152250-152251, 152253, 152256-152264, 152266-152268, 152270-152274, 152276, 152279, 152282-152284, 152288-152290, 152292, 152294, 152296-152307, 152310, 152312, 152314, 152316, 152319-152321, 152323, 152326-152329, 152331-152332, 152334-152337, 152339-152340, 152343-152347, 152349-152352, 152354-152355, 152357, 152359, 152363-152364, 152366, 152376-152383, 152385-152386, 152388, 152391-152394, 152398-152401, 152405, 152408-152415, 152417-152423, 152425-152428, 152430, 152432-152434, 152436-152437, 152440, 152442-152453, 152455-152459, 152463, 152465-152468, 152471-152473, 152476-152484, 152486-152494, 152497-152501, 152504-152510, 152512-152513, 152517-152518, 152521-152522, 152526-152528, 152530-152533, 152535-152536, 152538, 152540-152548, 152550-152551, 152555-152558, 152561, 152563-152564, 152568-152569, 152572-152577, 152579-152580, 152583-152584, 152586, 152588-152590, 152593-152594, 152596, 152598-152600, 152602-152605, 152607-152611, 152615-152619, 152623, 152627-152629, 152631-152632, 152635-152637, 152639-152642, 152644-152648, 152650-152663, 152665-152672, 152674-152675, 152677-152684, 152686-152687, 152692, 152694-152695, 152699-152707, 152709, 152711-152715, 152718-152727, 152729, 152731-152739, 152742-152751, 152753-152756, 152758, 152763-152770, 152772-152779, 152781-152782, 152785, 152787-152790, 152792-152793, 152796, 152798-152800, 152803-152805, 152807-152808, 152810-152816, 152818, 152820, 152822-152823, 152825, 152827, 152829-152832, 152834-152835, 152839-152841, 152843-152844, 152846-152853, 152856-152860, 152863-152865, 152867-152868, 152870-152873, 152876, 152878-152881, 152883-152888, 152890-152894, 152896-152899, 152901, 152903-152908, 152910, 152913, 152915-152918, 152920, 152925-152928, 152930-152931, 152934-152938, 152940-152943, 152945, 152948-152949, 152951-152953, 152955-152956, 152958-152960, 152962, 152966-152968, 152972, 152976, 152978-152981, 152983-152985, 152987-152989, 152993, 152995, 152998-152999, 153001-153002, 153010, 153013-153014, 153018, 153020-153021, 153023-153025, 153028-153033, 153037, 153039-153043, 153045-153046, 153048-153049, 153052-153056, 153058, 153060-153062, 153064-153065, 153068-153069, 153071-153074, 153079-153081, 153083-153084, 153087, 153089-153092, 153094-153096, 153098-153100, 153102-153106, 153109, 153112-153113, 153116-153120, 153123-153128, 153130-153132, 153134-153136, 153138-153144, 153147-

153148, 153150, 153152-153155, 153159, 153162, 153164-153165, 153167-153168, 153170-153174, 153177, 153183-153189, 153195-153196, 153198-153205, 153207-153210, 153214-153217, 153219, 153221-153222, 153224-153228, 153230-153232, 153235-153236, 153239-153240, 153243-153245, 153247-153250, 153252-153254, 153256-153261, 153264-153266, 153268, 153270, 153273, 153276, 153278, 153282-153284, 153288-153289, 153292-153293, 153295-153305, 153307, 153309-153311, 153321, 153323-153329, 153331-153336, 153340-153347, 153350, 153352, 153358-153360, 153362-153369, 153371, 153375-153380, 153385-153386, 153388, 153390-153391, 153393-153405, 153407, 153413-153415, 153417, 153419, 153421, 153423-153424, 153428-153444, 153447-153450, 153452-153455, 153458-153465, 153467-153469, 153473-153475, 153477, 153480-153491, 153493, 153496-153498, 153500, 153503-153504, 153506-153507, 153509, 153513-153514, 153518-153521, 153526, 153530-153540, 153543-153546, 153552-153553, 153555-153557, 153560-153561, 153563, 153567-153568, 153570, 153572, 153576-153585, 153588-153589, 153592-153596, 153600-153601, 153603-153604, 153608-153611, 153614-153615, 153617, 153619-153623, 153626-153627, 153629, 153632-153634, 153636, 153638-153640, 153642-153643, 153651, 153655-153656, 153658-153660, 153662-153667, 153669, 153673-153676, 153678-153681, 153683-153684, 153687, 153691, 153696-153697, 153699-153702, 153705-153710, 153714, 153716, 153720, 153722-153723, 153729-153732, 153734-153737, 153741-153753, 153755-153756, 153758-153765, 153768-153769, 153772-153777, 153779-153782, 153784-153800, 153802-153804, 153806, 153808-153809, 153812-153814, 153816, 153822, 153835, 153838-153844, 153846-153848, 153851-153852, 153863-153865, 153867-153886, 153888, 153896-153897, 153900-153904, 153906-153916, 153921-153923, 153925-153926, 153928-153929, 153931-153940, 153944-153945, 153947, 153951, 153953, 153956-153960, 153962-153967, 153970-153973, 153975-153984, 153987-153988, 153990-153991, 153996-153998, 154001, 154005, 154007-154008, 154010, 154013-154014, 154016, 154018-154021, 154024-154032, 154034-154037, 154039-154041, 154048-154057, 154059-154060, 154062-154079, 154081-154084, 154086, 154089-154107, 154110-154111, 154113-154114, 154118-154124, 154127-154131, 154133-154137, 154140-154142, 154144-154148, 154150-154153, 154155, 154157, 154159, 154163-154164, 154166, 154170-154172, 154174, 154176, 154179-154184, 154186, 154188-154189, 154191-154194, 154196-154198, 154202-154203, 154205-154208, 154210, 154212, 154217-154220, 154222-154226, 154228-154230, 154232-154238, 154242, 154244-154245, 154248, 154250-154251, 154253-154254, 154257-154264, 154266, 154268-154271, 154273-154274, 154277-154282, 154284-154285, 154287-154289, 154291, 154293-154297, 154299-154301, 154303-154304, 154306-154307, 154309, 154311, 154314-154318, 154320, 154322-154328, 154331, 154333, 154337-154339, 154349, 154352, 154355-154358, 154360, 154363-154365, 154369-154372, 154374, 154377, 154379-154380, 154383, 154385-154391, 154393-154395, 154397-154405, 154408-154411, 154413, 154415, 154417, 154421, 154423-154425, 154427, 154429, 154431, 154433-154440, 154442-154443, 154446, 154448, 154450-154452, 154454-154464, 154467, 154469-154471, 154473-154477, 154479-154481, 154483-154489, 154491, 154496-154502, 154504-154506, 154509-154513, 154515, 154517, 154519-154520, 154522, 154524, 154526, 154529-154531, 154534-154536, 154540, 154543-154547, 154549-154550, 154553-154557, 154559, 154561-154567, 154569-154570, 154572-154575, 154578, 154580, 154585, 154589-154590, 154592-154593, 154595-154596, 154598-154599, 154602-154610, 154612, 154614-154626, 154628, 154631-154632, 154634, 154636, 154638, 154640, 154642, 154644, 154646, 154649, 154651-154653, 154655, 154657-154663, 154665, 154667, 154669-154675, 154677-154681, 154684-154690, 154692, 154694-154698, 154700-154703, 154707-154709, 154711, 154714-154718, 154722, 154724, 154726-154727, 154731-154738, 154742-154744, 154746-154749, 154752-154754, 154756-154757, 154761-154763, 154766, 154772-154775, 154777-154780, 154782, 154784-154787, 154789-154792, 154794-154798, 154800-154810, 154812-154814, 154816, 154819, 154821-154828, 154830-154836, 154839, 154841-154843, 154846, 154850-154853, 154855-154859, 154861-154862, 154868, 154872, 154874, 154877-154882, 154885, 154890, 154894, 154896-154907, 154910-154913, 154915, 154918-154923, 154927, 154929, 154932-154934, 154940-154942, 154945-154949, 154953, 154955-154956, 154958-154960, 154962-154967, 154970, 154972-154979, 154984-154985, 154989-154994, 154997, 155004-155007, 155009-155013, 155016-155017, 155019-155023, 155025-155028, 155030-155032, 155034-155039, 155041-155042, 155046-155054, 155056-155066, 155070-155071, 155076-155079, 155082-155086, 155090-155091, 155093, 155097, 155099, 155101-155104, 155106, 155109-155112, 155114-155122, 155124-155127, 155129, 155133, 155135, 155137, 155140-155142, 155144-155149, 155151, 155153-155159, 155162-155163, 155166, 155171, 155173, 155175-155182, 155186, 155188-155195, 155197-155205, 155209, 155212, 155214-155224, 155226-155232, 155234-155238, 155240, 155242-155247, 155249-155253, 155256-155258, 155263, 155265-155268, 155274-155284, 155286, 155289-155298, 155300-155308, 155310, 155313-155333, 155336, 155338, 155340-155342, 155344-155345, 155348, 155350-155351, 155353-155357, 155359, 155362-155368, 155371-155376, 155378-155384, 155386-155403, 155405-155408, 155411, 155413-155415, 155417, 155419-155420, 155422, 155424-155430, 155433-155446, 155448, 155450, 155452-155462, 155464, 155466-155469, 155473-155477, 155480-155481, 155485-155486, 155488-155493, 155495-155497, 155503-155504, 155506-155508, 155510-155516, 155520, 155525-155526, 155528, 155530-155531, 155533-155534, 155537-155542, 155546-155550, 155552-155555, 155559-155560, 155562-155563, 155565, 155567-155569, 155571, 155573, 155575, 155577-155584, 155586-155588, 155590-155592, 155596, 155598, 155600-155601, 155603, 155606-155612, 155614, 155616-155617, 155620-155622, 155624-155625, 155627-155628, 155630-155631, 155636-155638, 155640, 155643-155644, 155648, 155650-155653, 155655, 155657, 155659-155660, 155664-

155671, 155673-155675, 155681, 155684-155687, 155690-155695, 155697-155698, 155701, 155703-155705, 155707-155710, 155712-155716, 155722, 155725, 155727, 155732-155734, 155736, 155738-155740, 155743, 155745-155753, 155757, 155759-155762, 155765-155771, 155773-155774, 155779, 155783, 155785-155790, 155792-155795, 155797, 155799, 155801-155803, 155805-155810, 155812-155813, 155815-155827, 155829, 155831-155832, 155836-155837, 155840-155843, 155846, 155848-155849, 155851, 155853-155854, 155856, 155858-155859, 155861, 155863-155871, 155873-155876, 155878, 155880, 155884-155895, 155897-155898, 155901-155904, 155907-155912, 155914-155915, 155917-155918, 155920-155923, 155928-155939, 155944-155945, 155948, 155950-155951, 155953-155954, 155956-155959, 155961-155964, 155966-155968, 155970-155974, 155976-155978, 155980, 155982-155985, 155987, 155989-155991, 155993-156000, 156002-156004, 156007, 156009-156015, 156019-156020, 156023-156026, 156028-156030, 156032-156034, 156037-156041, 156043-156045, 156049, 156051, 156054-156055, 156059, 156061-156062, 156068-156071, 156074, 156077, 156080, 156082-156087, 156089, 156092-156096, 156100, 156102-156104, 156106-156108, 156111-156113, 156115-156117, 156119-156124, 156126-156128, 156130-156139, 156141, 156143-156146, 156148-156153, 156157, 156161-156163, 156165-156166, 156168-156170, 156172-156173, 156176, 156180, 156182, 156184-156186, 156188-156192, 156196-156197, 156199-156202, 156205-156207, 156209-156210, 156212-156215, 156218, 156220-156228, 156230-156239, 156241, 156243-156244, 156247, 156250-156254, 156256-156260, 156264-156265, 156267, 156269-156270, 156275-156277, 156281, 156283, 156287, 156290-156300, 156302-156304, 156310, 156315-156316, 156318-156319, 156321-156322, 156324-156330, 156332-156338, 156341, 156344, 156347-156350, 156352, 156354, 156356-156357, 156359, 156365-156367, 156369-156378, 156381-156382, 156384-156389, 156391-156392, 156394, 156398-156401, 156403-156404, 156409-156412, 156417, 156419, 156421-156424, 156426-156428, 156433, 156437-156438, 156441-156444, 156446, 156448, 156451, 156453-156457, 156460, 156464-156467, 156469-156470, 156472, 156474-156475, 156479-156480, 156482-156484, 156486, 156488-156492, 156494-156497, 156499-156501, 156504, 156507, 156510, 156513-156515, 156517-156518, 156520-156521, 156523-156525, 156527-156535, 156537, 156541, 156547-156548, 156550-156551, 156554, 156556-156564, 156566, 156568-156574, 156577-156578, 156582-156584, 156588, 156593-156598, 156600, 156602-156606, 156608-156609, 156612-156615, 156617, 156619-156622, 156626-156630, 156633-156634, 156644, 156646, 156648-156650, 156653-156657, 156660-156662, 156668-156673, 156677-156679, 156683-156686, 156689, 156692, 156694, 156697-156700, 156702, 156704-156707, 156709, 156711-156721, 156723, 156725-156728, 156730-156735, 156738-156740, 156744-156745, 156747-156751, 156753, 156755, 156757-156758, 156760, 156764-156766, 156769, 156776-156781, 156783, 156786, 156788-156796, 156798-156801, 156805-156806, 156809-156817, 156819-156820, 156822, 156826-156829, 156831-156839, 156841, 156843-156852, 156855, 156857, 156859, 156861-156862, 156865-156868, 156870-156874, 156877-156880, 156882-156883, 156886-156887, 156889, 156892-156894, 156897-156899, 156901-156903, 156906, 156908, 156910-156914, 156916, 156918, 156921-156923, 156925, 156929, 156932-156933, 156936-156937, 156939-156940, 156942-156949, 156952, 156954, 156956-156957, 156959-156960, 156962-156964, 156967-156977, 156980-156982, 156985-156986, 156988-156996, 156998, 157000, 157003, 157005-157006, 157009, 157012-157021, 157023, 157025-157026, 157029, 157031, 157033-157038, 157040, 157042-157044, 157046-157047, 157049-157054, 157056, 157063, 157065, 157069, 157072, 157076, 157079-157080, 157083-157087, 157089-157094, 157097, 157100-157108, 157111-157112, 157114, 157116-157120, 157122-157129, 157131-157133, 157135, 157137, 157146, 157149-157152, 157154-157155, 157157-157160, 157162-157163, 157166, 157168-157171, 157174, 157176, 157179-157182, 157184, 157186-157189, 157191-157193, 157195-157206, 157208-157212, 157214-157216, 157221-157223, 157225-157226, 157228-157229, 157231-157232, 157234-157237, 157240-157241, 157244-157245, 157247-157248, 157250, 157253, 157255, 157257-157264, 157266-157267, 157269-157270, 157272-157275, 157278, 157280, 157285, 157290-157299, 157301-157303, 157305-157306, 157308, 157311, 157313, 157316, 157318-157319, 157321-157322, 157324, 157328-157330, 157334-157336, 157344-157346, 157349, 157351-157353, 157355, 157357, 157360-157368, 157371, 157373-157376, 157378, 157382-157385, 157388-157391, 157393, 157396-157397, 157399-157400, 157402, 157405, 157407, 157409, 157411, 157413, 157416-157419, 157422-157428, 157431-157434, 157436-157437, 157439-157440, 157442-157443, 157447, 157451-157464, 157466-157467, 157469-157473, 157476-157477, 157480-157482, 157484-157485, 157488, 157490-157496, 157498, 157500, 157502, 157504-157508, 157510, 157517-157521, 157523-157526, 157529-157537, 157541, 157543-157559, 157562, 157564, 157567-157570, 157572, 157574, 157576-157577, 157579-157581, 157584, 157586-157588, 157592, 157594, 157596-157608, 157611-157612, 157614-157615, 157617-157629, 157631-157632, 157634-157639, 157641-157644, 157646, 157649-157652, 157654-157655, 157661-157662, 157665-157668, 157672-157673, 157676, 157678-157680, 157682-157684, 157687-157693, 157695, 157697-157703, 157705, 157709-157726, 157730, 157733-157734, 157736-157740, 157742-157743, 157745-157746, 157748-157750, 157753-157754, 157756-157761, 157763, 157765-157766, 157769, 157771-157773, 157775, 157778, 157780-157781, 157786-157787, 157790-157798, 157800-157801, 157803, 157805-157814, 157817-157821, 157823-157827, 157829-157833, 157835-157837, 157840-157844, 157847, 157851, 157854-157856, 157858-157859, 157861, 157863-157866, 157868-157871, 157873-157877, 157880-157882, 157884, 157888-157891, 157893, 157897-157900, 157902-157903, 157906-157912, 157914, 157917-157923, 157926, 157928-157935, 157937-157945, 157947-157948, 157950, 157952-157956, 157960, 157962, 157964-157965, 157969-157976, 157978-157979, 157981-157983, 157986-157990, 157993, 157995, 157998, 158000, 158003-158006, 158008, 158010-158013, 158015, 158017-158018, 158020, 158022-158023, 158026, 158029, 158032-158035, 158039-158045, 158047-158052, 158054, 158057, 158059-158062, 158065-158067, 158069-158070, 158072-158073, 158075-158079, 158081-158087, 158090-158094, 158096-158097, 158099-158104, 158109-158114, 158116-158121, 158125-158136, 158138-158139, 158141-158142, 158145, 158147-158148, 158150-158164, 158166-158169, 158172, 158174-158187, 158189, 158191-158195, 158198-158203, 158206, 158210, 158214, 158216, 158219-158223, 158225-158226, 158229-158231, 158233, 158235-158236, 158238, 158240-158241, 158244-158245, 158247, 158249-158256, 158259, 158262-158263, 158269-158270, 158272-158273, 158276-158277, 158279-158281, 158284-158285, 158287-158288, 158290-158291, 158294-158295, 158299-158301, 158303-158304, 158308, 158310-158311, 158316-158317, 158320-158329, 158331-158336, 158338-158339, 158343-158344, 158346-158347, 158350, 158352, 158354-158355, 158357-158361, 158363-158364, 158366, 158368-158369, 158371, 158373-158381, 158383-158386, 158388, 158390-158391, 158395-158397, 158399-158400, 158405-158419, 158421, 158423, 158425, 158429-158433, 158437-158438, 158440-158441, 158443, 158445-158447, 158450-158453, 158455-158456, 158458-158460, 158462-158467, 158469-158472, 158474-158485, 158487, 158489-158491, 158495, 158497-158499, 158501-158515, 158517, 158519-158520, 158522-158525, 158527-158528, 158535, 158537-158538, 158540-158541, 158543-158544, 158546-158549, 158551, 158553, 158555-158560, 158568-158570, 158573-158576, 158578-158579, 158582-158586, 158588, 158590, 158592-158594, 158599-158601, 158603, 158607-158609, 158611-158622, 158624, 158628-158633, 158635-158651, 158653-158654, 158657-158659, 158662, 158664-158666, 158668, 158670-158674, 158678-158680, 158683-158685, 158687, 158689-158694, 158696, 158698-158704, 158706-158709, 158712-158714, 158718-158723, 158726-158728, 158730-158732, 158734, 158736-158740, 158742, 158745-158747, 158749-158751, 158753-158755, 158757-158759, 158761, 158764, 158768, 158770-158772, 158774-158778, 158780-158781, 158785, 158787-158788, 158790-158791, 158793-158802, 158805-158806, 158808, 158810-158812, 158817, 158819-158821, 158824, 158827-158837, 158840-158845, 158850, 158854-158855, 158858, 158860, 158862-158864, 158869-158872, 158874-158876, 158879-158885, 158887-158889, 158891-158893, 158895-158896, 158898-158901, 158905-158910, 158912-158913, 158915-158917, 158919, 158921-158926, 158933, 158935, 158937-158942, 158945-158946, 158948-158949, 158952, 158956, 158960, 158962-158966, 158968-158970, 158972-158973, 158975-158977, 158979, 158981, 158983-158984, 158987-158992, 158999-159004, 159006-159010, 159015, 159017-159019, 159021, 159023-159028, 159030-159041, 159043, 159045, 159049-159051, 159054-159057, 159059, 159061-159074, 159076-159079, 159083-159085, 159089-159090, 159092-159097, 159099-159100, 159104-159112, 159114-159118, 159120, 159123, 159125-159126, 159128, 159131, 159134-159138, 159140, 159142-159143, 159146-159147, 159149, 159152, 159154-159155, 159157-159168, 159173-159175, 159177-159179, 159181-159184, 159186-159192, 159195, 159197-159201, 159203, 159207-159208, 159212, 159215-159218, 159220-159224, 159226, 159228, 159231-159237, 159243-159245, 159247-159248, 159250-159251, 159254, 159256, 159258, 159260-159263, 159265-159273, 159275-159276, 159280, 159282-159286, 159288-159290, 159292-159294, 159296, 159298, 159301-159302, 159306-159307, 159309, 159311, 159314-159318, 159321-159326, 159328, 159330-159332, 159334-159338, 159340, 159342, 159344-159352, 159354-159355, 159358-159362, 159365-159366, 159370, 159373, 159375-159376, 159378, 159380-159382, 159384, 159386-159387, 159389-159390, 159392, 159394, 159398-159402, 159404, 159406, 159408-159411, 159413-159414, 159416, 159420, 159422-159431, 159433-159436, 159439, 159441-159445, 159448-159452, 159455, 159460-159461, 159463, 159466-159467, 159469-159470, 159473-159475, 159478-159479, 159481-159488, 159491, 159493-159494, 159496, 159498-159507, 159509, 159511-159512, 159514-159515, 159517-159522, 159527, 159529-159530, 159532, 159534-159535, 159541-159543, 159545, 159547-159550, 159552-159554, 159556, 159558-159560, 159562-159563, 159566-159567, 159572-159576, 159580-159586, 159588-159590, 159592-159595, 159597-159601, 159603, 159605-159606, 159608, 159611-159614, 159616, 159618, 159621, 159623, 159625-159631, 159633, 159635, 159637-159638, 159640-159641, 159644-159648, 159650-159652, 159655-159664, 159666, 159669-159673, 159675-159680, 159684-159685, 159691-159694, 159696-159697, 159699-159705, 159707-159708, 159710, 159712-159724, 159726-159728, 159734, 159736, 159738-159742, 159745-159753, 159759-159761, 159763-159769, 159772-159773, 159776-159777, 159781, 159783, 159785-159787, 159789, 159791, 159796, 159799-159801, 159803, 159805-159808, 159811-159818, 159822, 159824, 159826-159830, 159833-159837, 159839-159841, 159844-159856, 159858, 159860-159862, 159865, 159867, 159872, 159874-159879, 159881, 159883-159884, 159886, 159888-159889, 159891, 159893-159902, 159904-159906, 159908, 159910, 159913, 159915-159916, 159918, 159920-159921, 159923-159925, 159927, 159929-159930, 159932, 159935-159940, 159942, 159944-159945, 159948-159952, 159954-159960, 159962-159963, 159966-159969, 159972-159973, 159975-159976, 159979, 159981-159982, 159984-159986, 159988, 159991-159997, 159999-160000, 160002-160004, 160006-160007, 160009, 160011-160012, 160014, 160017-160019, 160022-160023, 160025-160031, 160033-160034, 160037-160040, 160042, 160044-160048, 160050-160054, 160056, 160058, 160061, 160063-160064, 160071-160073, 160075, 160078, 160080-160081, 160083, 160085-160086, 160088, 160091-160094, 160097, 160099-160100, 160102-160103, 160105-160113, 160119-160120, 160122-160127, 160130-160136, 160141-160142, 160144, 160146-160152, 160155-160156, 160158, 160160, 160162-160165, 160167, 160174, 160177-160180, 160183, 160185, 160188-160189, 160191-160196, 160198-160205, 160207-160210, 160212-160213, 160215-160217, 160219-160220, 160222-160223, 160225-160229, 160231-160233, 160236-160237, 160239, 160244-160249, 160251-160252, 160254, 160256-160257, 160260, 160264-160275, 160279-160281, 160284-160286, 160288, 160290, 160292, 160294, 160296-160297, 160300-160316, 160318-160319, 160321, 160323-160324, 160326, 160328-160333, 160336, 160339, 160341-160346, 160348-160351, 160354-160361, 160366-160373, 160376, 160378, 160382-160383, 160386-160389, 160391, 160393-160396, 160398-160400, 160403, 160405-160412, 160414-160415, 160418-160419, 160421, 160423, 160425-160426, 160428-160433, 160436-160443, 160446, 160448-160450, 160456-160458, 160470, 160472-160478, 160482-160484, 160486-160489, 160494, 160498-160499, 160503, 160505-160508, 160511-160514, 160516-160527, 160531, 160533-160534, 160536-160538, 160543, 160545, 160547-160548, 160553, 160555-160576, 160580-160582, 160584-160587, 160590, 160596-160598, 160600, 160602-160608, 160611-160613, 160617-160618, 160620-160625, 160627-160629, 160633, 160635, 160637-160643, 160647, 160649, 160651, 160653, 160655, 160657-160658, 160663, 160665, 160667-160678, 160680-160689, 160694-160697, 160699-160700, 160702-160703, 160707, 160710-160714, 160719-160720, 160722, 160725-160726, 160730-160734, 160737, 160739-160741, 160746, 160748-160751, 160753-160754, 160757-160758, 160760, 160763, 160765, 160768-160769, 160771-160777, 160781, 160783-160784, 160786-160787, 160789-160794, 160796-160797, 160799-160800, 160804, 160810-160811, 160813, 160815-160818, 160821-160823, 160825-160827, 160829-160832, 160834-160835, 160838-160846, 160849, 160851-160853, 160856-160857, 160860-160861, 160863-160864, 160866-160868, 160870, 160872-160874, 160876-160893, 160895-160899, 160903, 160906-160910, 160912, 160914-160918, 160920-160922, 160924-160925, 160927, 160929, 160931-160933, 160935-160936, 160938-160942, 160945, 160948-160949, 160952-160953, 160955-160958, 160960, 160962-160978, 160980-160981, 160983, 160985-160989, 160991, 160993, 160995-160997, 160999-161000, 161002-161006, 161009, 161012, 161016-161017, 161019-161021, 161023-161024, 161027, 161029-161030, 161033-161034, 161037-161038, 161040-161043, 161045-161054, 161058, 161062-161063, 161065-161066, 161068, 161070-161074, 161076-161077, 161079-161080, 161082-161083, 161085-161087, 161089-161096, 161099-161102, 161104-161106, 161108-161111, 161114-161116, 161120-161128, 161130-161131, 161134, 161136-161137, 161139-161142, 161145-161152, 161154-161160, 161164, 161167-161168, 161170-161172, 161174-161177, 161179-161185, 161187, 161189, 161191-161193, 161195-161197, 161199, 161201-161202, 161204, 161206-161212, 161214-161217, 161219-161223, 161225-161226, 161230, 161232-161234, 161239-161243, 161245, 161247, 161249, 161251, 161254, 161257, 161259-161260, 161262, 161265-161266, 161272, 161278-161279, 161282, 161286-161290, 161293, 161296, 161300, 161303, 161305-161310, 161312, 161315, 161318-161323, 161325-161327, 161329, 161332-161335, 161338-161340, 161346-161352, 161355-161356, 161358-161361, 161365, 161368-161373, 161377, 161379-161385, 161387, 161390-161399, 161403-161404, 161407-161413, 161417, 161419, 161426, 161429-161433, 161435-161436, 161438, 161440-161441, 161443-161444, 161446, 161449-161453, 161457, 161459-161466, 161469, 161471-161472, 161475, 161477-161478, 161480, 161483, 161488-161490, 161492, 161495, 161499-161501, 161503-161505, 161507-161511, 161520, 161524-161525, 161528-161529, 161531-161532, 161534-161535, 161537, 161540, 161542-161545, 161547, 161552-161554, 161556, 161558-161560, 161563-161565, 161567-161570, 161573-161576, 161579-161585, 161588-161590, 161593, 161595-161597, 161600, 161604-161605, 161607-161608, 161610-161613, 161617-161619, 161625, 161627, 161629-161630, 161632-161639, 161641, 161643-161644, 161646, 161650-161658, 161660-161661, 161663, 161665-161673, 161675-161676, 161680-161683, 161685, 161688-161690, 161693, 161696-161700, 161703, 161706, 161711-161712, 161714-161718, 161720-161721, 161725-161728, 161730, 161733, 161736-161740, 161742-161743, 161746-161758, 161761-161765, 161767, 161769-161770, 161777, 161779-161780, 161784, 161786-161791, 161794-161798, 161800-161802, 161804, 161806-161807, 161809, 161811-161813, 161818-161821, 161824-161825, 161827-161828, 161832, 161834-161840, 161842-161855, 161857, 161860-161876, 161880, 161882-161887, 161891-161893, 161898-161901, 161904-161907, 161909, 161911-161912, 161915, 161921, 161923-161924, 161926, 161929-161933, 161935-161940, 161943-161944, 161948, 161950-161956, 161961-161963, 161965, 161969, 161971, 161974-161975, 161977-161981, 161983, 161985, 161989, 161993-161995, 161997-161999, 162001-162006, 162008-162011, 162015-162019, 162021-162023, 162027, 162030-162032, 162034-162035, 162038, 162042, 162044, 162046-162055, 162057-162059, 162062-162063, 162066-162067, 162069-162070, 162072, 162075-162082, 162086-162089, 162091-162092, 162094-162097, 162100-162101, 162108, 162111, 162115-162118, 162121-162122, 162125-162127, 162129, 162133-162135, 162141, 162147-162148, 162150-162153, 162156, 162161-162169, 162172-162178, 162180, 162182-162184, 162187-162189, 162191-162192, 162194, 162196-162198, 162201-162202, 162206-162213, 162217-162219, 162221-162222, 162224, 162228, 162230-162239, 162242, 162246, 162248, 162250-162252, 162254-162255, 162259, 162261-162262, 162265-162269, 162272-162273, 162276-162279, 162281-162285, 162287-162289, 162291-162293, 162295, 162297-162300, 162302-162303, 162305-162308, 162311, 162315, 162317, 162319-162325, 162327-162328, 162330-162333, 162335-162340, 162342-162343, 162345-162347, 162350, 162354-162356, 162358-162363, 162365, 162368, 162370, 162372-162373, 162376-162379, 162382-162384, 162386-162387, 162389-162394, 162397-162400, 162402, 162406-162410, 162412-162415, 162417-162422, 162424-162425, 162427-162432, 162434-162437, 162439-162443, 162446, 162448-162455, 162459-162467, 162471-162472, 162475-162477, 162480-162481, 162483-162484, 162486-162488, 162492-162494, 162496-162497, 162499-162501, 162504-162505, 162507-162508, 162510, 162512-162514, 162516-162522, 162524-162527, 162530, 162532-162533, 162535, 162539-162542, 162544, 162548-162550, 162552-162553, 162555-162557, 162560-162562, 162564, 162566, 162568-162572, 162574-162575, 162578-162580, 162582-162584, 162586, 162589-162592, 162595-162598, 162600, 162605-162620, 162622-162637, 162640, 162642, 162644, 162647, 162649, 162652-162654, 162657, 162659-162660, 162662, 162664-162671, 162674-162683, 162685-162689, 162692-162694, 162698, 162700-162703, 162705, 162709-162710, 162713, 162715-162718, 162720-162722, 162724-162727, 162729, 162731-162735, 162739, 162741, 162743-162751, 162754, 162756, 162758-162763, 162767-162772, 162774-162775, 162778, 162780-162782, 162785, 162789, 162791-162798, 162800, 162802, 162805, 162807-162808, 162810-162814, 162816, 162818, 162821-162823, 162825, 162829-162835, 162840-162853, 162855-162857, 162860, 162862, 162865-162868, 162870-162873, 162875-162877, 162882-162883, 162885-162888, 162895, 162898, 162900, 162902-162906, 162908-162910, 162913, 162920, 162925-162926, 162928-162932, 162934, 162936, 162939, 162941, 162944-162952, 162955-162959, 162961-162962, 162964-162972, 162974-162975, 162977-162978, 162980-162982, 162986, 162988-162995, 162997, 162999-163001, 163003, 163006-163007, 163010, 163012-163017, 163022-163025, 163027-163028, 163031-163034, 163036-163042, 163045-163048, 163051, 163053-163055, 163058-163060, 163064, 163067, 163070-163075, 163078-163080, 163082, 163084, 163087, 163090-163091, 163093-163095, 163097-163099, 163101-163102, 163106-163110, 163115, 163117-163123, 163125-163127, 163133-163138, 163140-163142, 163145, 163147, 163149-163152, 163155-163156, 163158-163161, 163165-163167, 163169, 163171-163178, 163180-163185, 163187, 163190-163191, 163193, 163195-163196, 163199-163200, 163203, 163208, 163211, 163217, 163219-163222, 163226, 163228, 163232-163234, 163236, 163240-163241, 163243-163244, 163246-163247, 163249-163253, 163256-163257, 163260, 163265-163266, 163268-163270, 163272-163274, 163279-163280, 163284, 163286-163288, 163290-163291, 163298-163306, 163310, 163313-163315, 163318, 163320, 163323-163325, 163328-163330, 163332-163334, 163336-163342, 163345-163346, 163348-163354, 163356-163357, 163360-163361, 163364-163365, 163368-163369, 163373, 163375-163377, 163382-163389, 163391-163398, 163401-163402, 163405-163406, 163409, 163411, 163414, 163416, 163418, 163422, 163424, 163426-163428, 163435, 163437-163439, 163441-163442, 163444, 163447-163450, 163452, 163454, 163456-163458, 163460-163461, 163463, 163466-163474, 163480, 163482-163484, 163486-163489, 163492, 163494-163496, 163498-163500, 163503, 163505, 163509, 163512, 163514-163515, 163517-163523, 163526-163527, 163529, 163532, 163534-163535, 163540-163544, 163547-163549, 163551-163554, 163556-163561, 163564-163566, 163568-163570, 163572-163574, 163576-163579, 163581-163584, 163586-163589, 163591-163593, 163595, 163598, 163600-163603, 163611, 163614-163626, 163631-163633, 163636, 163640-163643, 163647-163648, 163650-163651, 163654, 163656-163659, 163661-163665, 163667-163669, 163671, 163673-163675, 163677-163680, 163683, 163688, 163690-163691, 163693-163695, 163697-163698, 163701-163702, 163704-163707, 163709, 163716-163717, 163719-163723,
163725-163731, 163734, 163736, 163739, 163741, 163743-163745, 163747, 163751-163757, 163759-163760, 163762-163769, 163772-163774, 163776, 163778, 163780, 163784, 163787, 163792-163794, 163796-163800, 163802-163804, 163807, 163809, 163811-163813, 163815-163819, 163823-163824, 163826-163828, 163830-163833, 163835, 163839, 163841-163842, 163844-163847, 163851, 163854, 163856-163857, 163860-163865, 163867-163871, 163873-163874, 163876-163881, 163883-163885, 163887-163891, 163893-163895, 163897, 163900-163901, 163904-163905, 163907-163908, 163910-163912, 163915-163916, 163919-163920, 163922, 163924-163925, 163927-163931, 163933-163934, 163942, 163944, 163946-163950, 163955-163957, 163959, 163961-163963, 163965-163972, 163980-163987, 163989-163990, 163993, 163995, 163998, 164000-164007, 164009, 164012, 164014, 164016-164018, 164020-164023, 164027, 164029, 164031-164036, 164038, 164040-164042, 164044, 164046-164047, 164049-164050, 164052, 164055, 164057-164059, 164061, 164063-164064, 164066, 164069-164075, 164077-164078, 164081-164082, 164084, 164087-164088, 164090-164097, 164101-164102, 164104-164107, 164112-164113, 164115, 164117-164119, 164121, 164124-164126, 164128-164132, 164134-164135, 164138, 164140-164145, 164147-164150, 164154, 164156-164161, 164164-164169, 164171-164173, 164175, 164178-164181, 164183, 164185, 164191-164192, 164194-164195, 164198-164199, 164201, 164203-164204, 164206, 164210-164217, 164219, 164221-164223, 164225-164229, 164231, 164234-164237, 164239, 164242-164246, 164248-164249, 164251-164262, 164264, 164266, 164270, 164272, 164274-164275, 164285-164286, 164288, 164290-164293, 164295-164296, 164298, 164303, 164305, 164307, 164314, 164316-164317, 164320-164326, 164328-164331, 164334-164335, 164337-164338, 164341, 164345-164348, 164350-164359, 164364-164368, 164371, 164373-164378, 164380-164384, 164386-164388, 164390-164393, 164396-164399, 164402-164403, 164405, 164407-164416, 164418, 164420-164427, 164429, 164432-164437, 164439-164440, 164444, 164446-164448, 164452, 164455, 164457, 164461-164462, 164466, 164468-164477, 164484-164489, 164497-164498, 164500, 164502-164505, 164507, 164509-164510, 164512, 164514-164516, 164518-164521, 164523-164528, 164530-164537, 164539-164540, 164542, 164546-164547, 164549, 164551-164553, 164556-164561, 164566-164573, 164576, 164579, 164582-164585, 164589-164595, 164597-164598, 164600-164601, 164603-164604, 164606-164622, 164625-164627, 164629-164633, 164635-164636, 164638-164641, 164643-164651, 164653-164654, 164663-164667, 164669, 164671, 164673-164675, 164678-164688, 164690-164691, 164693-164695, 164697, 164699-164710, 164712, 164715, 164717-164718, 164721-164725, 164727-164730, 164737-164738, 164740, 164742, 164744-164745, 164747, 164749-164750, 164753, 164755, 164757-164758, 164761-164766, 164769-164773, 164775-164776, 164778-164782, 164784-164793, 164795-164801, 164803-164804, 164806-164807, 164813-164819, 164822-164823, 164825-164827, 164829-164830, 164832-164840, 164845-164857, 164859-164862, 164864-164868, 164871-164872, 164874-164882, 164884, 164887-164888, 164890-164892, 164894-164895, 164899-164901, 164903, 164905-164907, 164909-164910, 164912, 164914-164924, 164927, 164929, 164932-164934, 164936-164937, 164942-164943, 164945-164948, 164950-164952, 164956, 164958-164959, 164961-164962, 164967, 164969-164970, 164972, 164977-164978, 164982-164983, 164986, 164988-164989, 164991-164994, 164996-164997, 164999-165003, 165005-165011, 165014-165017, 165019-165022, 165024-165026, 165029, 165031, 165033, 165036-165038, 165040, 165042, 165044-165046, 165050-165051, 165053, 165055-165056, 165059-165065, 165067, 165069-165079, 165086-165087, 165089, 165091-165093, 165095-165096, 165098-165100, 165103, 165105-165107, 165109-165111, 165113-165116, 165118, 165120-165121, 165123, 165125-165126, 165129-165137, 165139-165143, 165145, 165148-165154, 165156-165157, 165160, 165163-165169, 165172-165176, 165179-165180, 165184-165186, 165190-165199, 165201, 165203, 165205-165213, 165216-165222, 165224, 165226-165228, 165230-165251, 165254-165256, 165259, 165262-165265, 165267-165269, 165271-165283, 165286-165295, 165298-165306, 165308-165309, 165311-165314, 165316-165317, 165320-165321, 165323, 165325-165338, 165340, 165342-165345, 165347-165348, 165350-165352, 165355-165356, 165358, 165360, 165362-165364, 165366-165368, 165370, 165372-165374, 165377-165382, 165387-165388, 165392-165395, 165399, 165401, 165405-165409, 165411-165413, 165415-165416, 165418-165419, 165423, 165427-165437, 165445-165449, 165451, 165453, 165455-165459, 165461-165462, 165464-165465, 165467-165473, 165475, 165477-165480, 165484-165486, 165488, 165492, 165494, 165497, 165500-165503, 165506, 165508-165510, 165512-165513, 165517-165518, 165520, 165523-165525, 165531, 165534-165541, 165544-165550, 165553-165554, 165556-165567, 165569-165576, 165578, 165580-165581, 165583, 165585, 165592, 165595, 165597, 165601, 165603-165604, 165606, 165608-165610, 165612-165615, 165618-165619, 165621-165626, 165628, 165630, 165633-165635, 165637, 165639-165640, 165644-165648, 165650-165660, 165663, 165665-165667, 165669, 165672-165674, 165676-165677, 165679-165686, 165688, 165690-165692, 165694-165699, 165702, 165704-165705, 165707-165710, 165712, 165715-165716, 165719, 165722, 165724-165725, 165727, 165729-165733, 165735-165740, 165742, 165745-165756, 165758-165766, 165768-165774, 165776, 165779-165780, 165782-165794, 165798-165800, 165802, 165804-165805, 165808, 165811, 165813-165821, 165824, 165826-165827, 165829, 165831, 165835-165838, 165848, 165851-165855, 165858, 165863-165869, 165873, 165875-165880, 165884-165887, 165889, 165891-165892, 165894-165902, 165905-165907, 165909-165914, 165917, 165920-165921, 165923-165924, 165926, 165928-165930, 165932, 165934, 165936-165937, 165939-165940, 165944, 165948, 165950, 165953, 165955, 165957-165958, 165961-165964, 165967-165968, 165971, 165973-165976, 165979-165982, 165985-165987, 165990-165992, 165995, 165997-166000, 166003, 166005, 166007, 166009, 166012, 166014-166019, 166021-166025, 166027-166028, 166031-166032, 166034-166035, 166037, 166042-166043, 166049-166051, 166054, 166058-166061, 166063, 166065, 166068, 166070-166073, 166075, 166077, 166080-166083, 166085, 166087, 166089-166091, 166095-166096, 166098-166101, 166104-166105, 166108-166109, 166111, 166116-166121, 166124, 166127-166131, 166133, 166135, 166138-166142, 166146-166151, 166156-166158, 166160, 166165-166168, 166170-166172, 166175, 166177-166185, 166189-166195, 166198-166203, 166205-166208, 166211-166213, 166215, 166217, 166220, 166223-166225, 166227-166232, 166235, 166239-166241, 166243, 166245-166246, 166251-166252, 166254-166255, 166257-166262, 166266-166267, 166269-166273, 166275, 166277, 166280-166282, 166288-166292, 166297, 166300, 166302, 166304, 166306, 166308-166309, 166311-166312, 166314-166318, 166321-166322, 166327, 166329-166330, 166334-166340, 166342-166347, 166349, 166351, 166353, 166355-166356, 166362-166363, 166367-166376, 166378-166379, 166381-166382, 166387-166390, 166392-166402, 166404, 166410-166411, 166414-166421, 166425, 166428, 166430-166433, 166435-166436, 166438-166442, 166444, 166446-166448, 166452, 166457-166458, 166460-166461, 166463, 166465-166466, 166468-166472, 166474, 166477, 166481-166484, 166486-166489, 166491-166494, 166497-166499, 166505-166506, 166508, 166514-166516, 166518-166520, 166522, 166526-166532, 166535, 166537-166538, 166540, 166543-166546, 166549-166550, 166553, 166555, 166557-166558, 166560-166562, 166565, 166567-166568, 166571-166572, 166574-166597, 166599-166600, 166604-166608, 166610-166611, 166614-166615, 166619-166620, 166622-166625, 166629-166632, 166637, 166639-166640, 166642-166644, 166646, 166650-166651, 166653, 166655-166656, 166658-166663, 166665-166666, 166668-166669, 166671-166672, 166674-166676, 166683, 166685-166693, 166695, 166697, 166700-166702, 166704-166705, 166707-166708, 166711, 166714-166716, 166718, 166720-166722, 166724-166725, 166727-166731, 166733-166738, 166740-166747, 166749-166752, 166755-166760, 166762-166763, 166765-166767, 166769, 166771, 166774, 166780-166784, 166786-166787, 166789, 166791-166795, 166797-166801, 166803, 166805-166806, 166809, 166812-166817, 166820-166823, 166825-166832, 166835, 166837-166840, 166845, 166847-166852, 166855-166857, 166862-166864, 166869, 166873-166879, 166881, 166885, 166887, 166889-166894, 166897-166904, 166906, 166910-166913, 166915-166916, 166918-166919, 166921-166922, 166924-166926, 166928-166929, 166932, 166935-166936, 166938-166940, 166944-166946, 166948-166956, 166958-166961, 166963-166964, 166966-166968, 166970-166972, 166974-166976, 166978-166980, 166982-166990, 166992-166994, 166997, 167001-167002, 167004-167007, 167009-167011, 167013-167017, 167019, 167021-167025, 167027, 167029-167030, 167032-167034, 167036, 167038, 167041-167043, 167047, 167049, 167051-167055, 167057-167066, 167068-167070, 167072, 167075-167076, 167078, 167080-167081, 167084, 167086-167089, 167091-167095, 167098-167101, 167104-167105, 167107-167108, 167110, 167113, 167116-167117, 167120-167121, 167126-167127, 167129, 167131-167134, 167136-167147, 167150-167155, 167157-167159, 167161-167167, 167169-

167171, 167175, 167177, 167179-167184, 167187-167192, 167194, 167198-167210, 167212-167218, 167220, 167222, 167224-167225, 167227, 167231-167232, 167234-167235, 167239-167247, 167250, 167252-167260, 167262, 167265, 167267, 167269-167272, 167274-167275, 167279, 167283, 167285-167291, 167294-167302, 167304, 167307, 167310-167311, 167313, 167317-167329, 167331-167333, 167337-167338, 167340, 167342-167344, 167346-167347, 167352-167353, 167357, 167359-167360, 167362-167366, 167369-167370, 167372-167377, 167381, 167386-167388, 167391, 167394-167397, 167399-167406, 167410, 167412-167414, 167416-167417, 167419, 167421-167423, 167426-167431, 167433-167434, 167438-167439, 167442, 167445-167450, 167452-167454, 167459, 167464, 167471, 167473, 167475-167484, 167486-167488, 167490-167492, 167494-167495, 167497-167500, 167502-167504, 167506, 167509, 167511, 167515-167516, 167519, 167522, 167524-167528, 167530-167532, 167537-167538, 167540-167544, 167549, 167551, 167553-167554, 167557-167559, 167561-167566, 167570, 167572-167573, 167577-167578, 167580-167581, 167588-167589, 167594, 167596-167598, 167600, 167602, 167604, 167606-167609, 167612, 167614, 167617-167618, 167621, 167623, 167628-167631, 167634, 167636, 167638, 167641-167647, 167649-167650, 167652-167653, 167656-167657, 167659-167662, 167664, 167666-167670, 167672-167673, 167675-167680, 167685-167692, 167694-167695, 167697, 167699-167700, 167706-167707, 167711-167712, 167715-167723, 167727-167729, 167732-167733, 167739-167743, 167746, 167749-167751, 167756, 167758-167761, 167763-167768, 167772-167776, 167778-167781, 167784, 167787-167795, 167797-167799, 167802-167803, 167805-167809, 167814-167816, 167819, 167822, 167824-167828, 167832-167833, 167835, 167839-167843, 167845, 167848-167849, 167853, 167855-167860, 167862-167866, 167868-167881, 167886-167890, 167897, 167899-167903, 167906, 167908-167910, 167912, 167920-167925, 167927-167930, 167935, 167941-167942, 167949, 167951-167952, 167958-167963, 167967, 167972-167974, 167976, 167979-167981, 167985, 167987-167991, 167993-168000, 168002, 168004, 168006-168009, 168011-168013, 168015-168016, 168018-168019, 168023-168026, 168028, 168033-168034, 168036, 168040, 168042, 168045, 168047-168049, 168051-168054, 168058-168062, 168064-168078, 168080, 168083, 168085-168087, 168091-168092, 168094-168095, 168097, 168100-168101, 168103-168107, 168109-168112, 168114, 168116-168122, 168124, 168126-168127, 168129, 168131, 168133, 168135, 168138, 168142, 168144-168149, 168153-168161, 168163-168166, 168168, 168170-168173, 168175-168177, 168179, 168182-168186, 168188-168192, 168194-168197, 168200, 168204-168207, 168209, 168211-168212, 168214-168219, 168221-168222, 168224, 168226-168228, 168233-168234, 168236-168239, 168245-168246, 168250-168251, 168253-168257, 168259-168260, 168262, 168265, 168267-168268, 168271, 168274, 168280, 168283-168289, 168291, 168297-168302, 168304-168305, 168307, 168312-168316, 168319-168327, 168329-168330, 168333, 168335-168343, 168345, 168347, 168349-168351, 168355-168361, 168364-168366, 168371-168372, 168375-168376, 168378-168381, 168385-168391, 168394-168401, 168403-168406, 168408-168409, 168411, 168413-168417, 168419-168423, 168425-168426, 168428-168432, 168435-168438, 168442-168444, 168446, 168449-168451, 168453-168454, 168457, 168459-168461, 168464-168465, 168467-168476, 168481-168482, 168484, 168486-168489, 168491-168493, 168495-168498, 168500-168502, 168505, 168509, 168512, 168515-168519, 168524, 168526-168530, 168532, 168534-168535, 168539-168540, 168542-168546, 168548, 168551-168554, 168556-168557, 168559, 168562, 168564-168570, 168572-168575, 168582, 168585-168595, 168597-168598, 168600-168602, 168604-168611, 168613, 168615-168616, 168618-168620, 168622-168626, 168629-168635, 168639-168640, 168642, 168645-168646, 168649-168650, 168653, 168655-168657, 168659-168662, 168664-168666, 168668-168675, 168677, 168679-168680, 168683-168685, 168687, 168691-168692, 168694, 168696-168698, 168700, 168702, 168704-168708, 168710-168712, 168714, 168716, 168718, 168720, 168724-168727, 168729, 168731-168733, 168735, 168737, 168739, 168741-168742, 168744-168745, 168747, 168749, 168752-168754, 168756, 168758-168759, 168761-168767, 168770, 168772-168774, 168777-168778, 168780-168781, 168783-168788, 168790-168793, 168795-168797, 168799-168804, 168807-168808, 168811, 168813, 168815-168823, 168825, 168829, 168834-168837, 168840, 168842-168846, 168848-168849, 168852, 168854, 168856-168857, 168859, 168862-168863, 168866, 168868, 168870, 168872, 168874-168876, 168878-168880, 168882-168883, 168892-168895, 168898, 168901, 168903, 168905-168906, 168909, 168911-168913, 168915, 168921-168924, 168927, 168929-168935, 168937, 168940, 168942-168953, 168955-168956, 168959, 168961, 168964, 168966, 168968, 168971, 168973, 168975, 168977-168979, 168981-168983, 168985, 168987-168991, 168993, 168996-168998, 169000, 169002-169005, 169007, 169009-169012, 169018, 169020-169023, 169025-169026, 169028, 169030-169031, 169036, 169038, 169040-169041, 169043-169044, 169046-169049, 169051-169052, 169054-169058, 169060-169069, 169071-169075, 169078-169080, 169084, 169087-169089, 169091, 169094-169096, 169099-169100, 169106-169120, 169124-169126, 169128-169130, 169132-169133, 169135-169136, 169139-169141, 169143, 169145-169148, 169150, 169152-169156, 169158-169161, 169163, 169169, 169171, 169173-169174, 169176-169177, 169181, 169183-169184, 169186-169187, 169189, 169191, 169195-169203, 169205-169206, 169208-169210, 169212, 169214-169220, 169222-169227, 169229-169230, 169233-169237, 169240-169241, 169244-169250, 169254-169263, 169265-169267, 169269, 169271-169272, 169274, 169276-169277, 169280-169282, 169286-169290, 169292-169294, 169297-169299, 169302-169304, 169306-169307, 169309, 169311, 169313, 169315, 169317-169318, 169323, 169326-169329, 169333, 169335-169338, 169340-169341, 169343, 169345-169347, 169350-169353, 169355-169357, 169359-169365, 169367-169374, 169376-169380, 169383, 169385-169388, 169391, 169393-169399, 169404-169405, 169408-169409, 169411-169414, 169416, 169418-169420, 169422, 169424-169430, 169432-169438, 169442, 169444-169445, 169450-

169455, 169457, 169459-169464, 169466-169469, 169474, 169476, 169479, 169481-169491, 169493-169494, 169496-169497, 169499-169507, 169509, 169511-169518, 169520-169525, 169528-169530, 169532, 169536, 169538-169544, 169547, 169550-169552, 169554-169567, 169569-169571, 169574-169576, 169578-169582, 169585, 169587-169588, 169590-169591, 169593, 169596, 169598-169599, 169601-169602, 169604-169606, 169608-169611, 169615-169619, 169621-169625, 169628-169630, 169633-169638, 169642-169643, 169650-169655, 169657-169659, 169661-169662, 169664-169665, 169667-169672, 169675, 169678-169682, 169684-169685, 169688-169692, 169695, 169697-169702, 169704-169706, 169709-169710, 169712-169714, 169718, 169720-169721, 169723, 169725-169726, 169728-169735, 169737-169739, 169743-169745, 169747, 169750, 169754, 169761, 169768-169772, 169775-169776, 169778-169780, 169786-169799, 169801-169803, 169805-169807, 169809-169814, 169816-169817, 169819, 169821-169822, 169824-169827, 169829-169841, 169843-169847, 169849, 169852, 169854-169858, 169861-169862, 169866-169869, 169872, 169874-169875, 169877, 169879, 169882, 169884-169886, 169888, 169890-169892, 169894-169895, 169897-169898, 169900-169901, 169903-169905, 169909-169910, 169912, 169914-169923, 169925-169927, 169930, 169933-169934, 169936, 169938-169941, 169943-169949, 169951-169952, 169955, 169958-169967, 169970-169977, 169982-169989, 169991, 169993-170001, 170004-170009, 170011-170012, 170014-170020, 170023-170024, 170026-170027, 170029, 170031, 170033, 170035, 170039, 170041-170043, 170045-170050, 170052-170055, 170059-170061, 170063-170065, 170067, 170069, 170072-170073, 170075-170078, 170080-170081, 170083, 170087-170089, 170094-170096, 170098-170099, 170102-170103, 170108, 170111, 170113, 170115-170118, 170120-170125, 170129, 170133, 170135, 170137-170138, 170142-170144, 170149-170152, 170155-170156, 170159-170160, 170162-170164, 170168, 170170, 170172-170173, 170178, 170182, 170185-170186, 170190-170192, 170198-170207, 170210-170211, 170215-170220, 170222-170223, 170226-170227, 170230-170231, 170235-170237, 170239-170241, 170243-170248, 170250, 170252-170253, 170255, 170258-170259, 170262-170264, 170266, 170270, 170273-170278, 170280, 170282-170285, 170287-170292, 170294-170296, 170298, 170300-170301, 170303-170307, 170309-170313, 170315-170318, 170320-170324, 170327, 170330, 170333-170336, 170338-170340, 170342-170343, 170347, 170350-170358, 170360-170361, 170363, 170368-170378, 170380-170383, 170389-170390, 170392-170393, 170395-170398, 170400-170403, 170405-170406, 170408-170412, 170415-170419, 170421, 170424-170425, 170427, 170429-170430, 170433-170437, 170439, 170441-170444, 170447, 170451-170452, 170455, 170458, 170460-170463, 170467-170468, 170470-170475, 170477, 170479, 170481, 170483-170486, 170488, 170491-170492, 170494, 170496-170497, 170499-170501, 170503-170511, 170513, 170515, 170517-170519, 170523-170526, 170532, 170535-170537, 170539-170543, 170545-170546, 170548-170549, 170551, 170553-170557, 170560-170564, 170567-170573, 170577, 170582, 170584-170586, 170588-170589, 170591-170592, 170594-170595, 170598, 170600-170609, 170611, 170613-170614, 170619-170621, 170624, 170626-170629, 170633, 170635-170638, 170640-170641, 170644-170646, 170650-170651, 170653, 170655-170656, 170658, 170661-170666, 170668, 170670-170673, 170677-170679, 170681, 170683-170687, 170689-170690, 170693, 170695-170711, 170713-170719, 170721-170725, 170729-170730, 170734-170739, 170743-170747, 170750, 170753-170759, 170761, 170763-170765, 170767, 170769-170772, 170774-170777, 170779-170788, 170790-170791, 170795-170796, 170798, 170800-170803, 170805-170807, 170810-170813, 170816-170817, 170819, 170821-170823, 170825, 170829, 170831-170832, 170837, 170840, 170845, 170848, 170850, 170855-170857, 170859-170860, 170862-170865, 170867-170874, 170876-170877, 170879-170887, 170891-170893, 170896, 170898, 170900-170902, 170904-170905, 170909-170911, 170913-170914, 170919-170922, 170924-170926, 170929, 170931-170935, 170940, 170942-170943, 170945-170946, 170948-170954, 170956-170958, 170961-170964, 170966-170971, 170974, 170976-170981, 170986-170991, 170993, 170995, 170997, 170999-171004, 171006-171007, 171009-171013, 171020-171025, 171028-171029, 171031-171033, 171035-171036, 171038, 171040-171041, 171043, 171048-171049, 171051-171058, 171061-171062, 171064-171066, 171068-171081, 171083-171084, 171086-171087, 171089, 171092, 171094-171096, 171100, 171102-171107, 171109-171112, 171114-171116, 171118-171119, 171121-171122, 171124-171125, 171128-171130, 171132-171133, 171135-171137, 171139-171140, 171143-171148, 171150-171155, 171158, 171163-171164, 171167, 171171-171182, 171184-171187, 171189-171193, 171196, 171199-171200, 171202, 171204, 171208-171211, 171213, 171216, 171218, 171221-171222, 171224-171226, 171228-171232, 171234, 171236, 171239-171244, 171248, 171250-171253, 171255-171260, 171262-171263, 171267, 171270-171272, 171274, 171276-171280, 171282-171286, 171289-171292, 171296-171297, 171300-171304, 171306-171310, 171312-171313, 171315-171316, 171318-171321, 171323-171330, 171332-171343, 171347, 171350-171352, 171356, 171358, 171362-171370, 171374-171377, 171382, 171384-171387, 171389-171390, 171392-171394, 171396-171402, 171404, 171407-171408, 171411-171418, 171420, 171422, 171424-171427, 171429, 171431, 171433-171434, 171436-171437, 171439-171441, 171444-171448, 171450-171455, 171457-171460, 171463, 171466-171470, 171473, 171475, 171477, 171479-171482, 171484-171487, 171490, 171492, 171494-171496, 171499, 171503, 171506-171507, 171512-171514, 171516-171521, 171523-171526, 171528, 171530, 171533-171535, 171537, 171539-171548, 171551-171554, 171557, 171559, 171561, 171563, 171566, 171568-171570, 171575-171577, 171581, 171584, 171586-171587, 171594, 171596-171604, 171606-171614, 171618-171622, 171625-171627, 171630, 171632-171634, 171637, 171639-171642, 171646, 171649-171656, 171658-171663, 171668, 171670, 171672-171676, 171678, 171683-171685, 171687, 171689, 171692-171693, 171695-171697, 171702-171705, 171707-171709, 171711-171715, 171717-171719, 171723-171724, 171726-171729, 171731-

171736, 171739, 171741-171746, 171748-171751, 171753, 171757-171758, 171760-171767, 171769, 171771, 171775, 171777, 171779, 171782-171785, 171787-171788, 171791-171792, 171795-171797, 171800-171801, 171805-171807, 171810-171820, 171822-171823, 171826-171829, 171833, 171836, 171838-171839, 171841-171844, 171848, 171850, 171855, 171857-171865, 171867, 171871-171872, 171874, 171877-171878, 171880-171881, 171883-171886, 171888-171893, 171895-171899, 171901, 171903, 171905-171907, 171910-171912, 171917-171920, 171924, 171927-171930, 171932-171935, 171937-171945, 171947-171952, 171954, 171956-171958, 171960, 171963, 171965-171966, 171969, 171972-171978, 171980-171985, 171987-171988, 171990-171992, 171994-171995, 171997-172000, 172003, 172005-172007, 172009-172011, 172013-172019, 172021, 172023-172025, 172028-172031, 172033-172036, 172038, 172040-172041, 172043-172044, 172048-172057, 172059-172062, 172065, 172067-172068, 172070-172071, 172073, 172076-172077, 172079-172080, 172082-172083, 172088, 172092, 172094-172097, 172099-172101, 172104-172109, 172111-172112, 172114-172121, 172123-172124, 172127-172129, 172131-172132, 172134, 172136-172137, 172141-172144, 172146-172148, 172150, 172152, 172154, 172156-172161, 172164, 172166, 172169-172170, 172172, 172175-172177, 172179-172183, 172185, 172188-172189, 172191, 172193-172196, 172199, 172205, 172208, 172210-172211, 172213-172219, 172221, 172223-172229, 172233-172237, 172239, 172242-172243, 172245, 172247-172248, 172250, 172252, 172254-172255, 172257-172260, 172262-172265, 172267-172269, 172271-172274, 172276-172277, 172279-172283, 172285, 172287-172292, 172294-172295, 172298-172299, 172301-172308, 172310-172311, 172313-172317, 172320-172321, 172323-172327, 172329, 172331-172334, 172338-172341, 172344-172346, 172348, 172350, 172352-172353, 172355-172356, 172358-172359, 172362-172363, 172365-172366, 172368-172369, 172371-172373, 172375-172376, 172378, 172380-172381, 172383-172384, 172387, 172389, 172391-172394, 172399-172404, 172406, 172410-172412, 172414-172416, 172418, 172420, 172422, 172425, 172427-172431, 172433-172437, 172439, 172443, 172445-172449, 172452-172456, 172458-172462, 172464, 172468, 172470, 172472, 172474-172475, 172481, 172484-172485, 172487-172489, 172492, 172494-172498, 172500, 172504-172505, 172510-172519, 172521, 172523-172525, 172527-172528, 172530, 172534, 172538, 172540-172542, 172545, 172547-172548, 172550-172551, 172554-172555, 172558-172559, 172561-172562, 172566-172568, 172571, 172573-172576, 172578, 172580-172583, 172587, 172589-172591, 172593-172594, 172601-172606, 172609-172613, 172616-172617, 172619-172620, 172622-172628, 172630-172634, 172636, 172638-172642, 172644-172647, 172650-172651, 172653-172655, 172657, 172659-172662, 172667-172671, 172673-172679, 172681-172683, 172686-172690, 172693-172694, 172696, 172699, 172703-172713, 172715-172719, 172721-172725, 172727-172728, 172731-172732, 172736-172740, 172742-172745, 172747, 172751-172754, 172760, 172770-172773, 172775-172778, 172780, 172782-172788, 172790-172796, 172800-172801, 172803, 172805, 172807-172808, 172810-172811, 172813-172814, 172816, 172818, 172820-172833, 172835, 172838, 172842-172845, 172847, 172850-172851, 172853-172854, 172858-172859, 172862, 172864, 172866-172867, 172869, 172873-172878, 172882, 172884, 172886-172889, 172891, 172894-172896, 172900, 172902-172906, 172908, 172910-172914, 172916, 172918-172924, 172927-172928, 172930-172932, 172935-172945, 172947-172948, 172950, 172953, 172956-172964, 172968, 172970-172972, 172974, 172976-172977, 172980, 172982-172988, 172990-172993, 172995-172999, 173001-173004, 173006-173008, 173010-173018, 173021-173028, 173030-173033, 173035, 173037-173040, 173042, 173045-173047, 173049-173050, 173052-173056, 173060-173063, 173066-173075, 173077-173081, 173086-173088, 173090-173091, 173095-173101, 173105-173109, 173111, 173114-173117, 173121-173125, 173128-173131, 173133-173137, 173143-173146, 173148, 173152-173154, 173156-173161, 173163-173168, 173170-173172, 173175-173176, 173178-173180, 173182-173185, 173187-173188, 173190, 173192-173199, 173201, 173203-173204, 173206, 173210-173212, 173215-173216, 173219-173232, 173234-173235, 173237-173239, 173242-173243, 173246-173250, 173252-173256, 173258, 173260, 173262-173271, 173274-173275, 173279-173284, 173286, 173288-173289, 173291, 173293-173294, 173296, 173298, 173300, 173302-173303, 173305-173306, 173308-173309, 173311-173315, 173318-173320, 173323-173330, 173337-173340, 173343-173345, 173348-173349, 173357-173360, 173362, 173366-173369, 173371-173372, 173375-173376, 173378, 173380-173383, 173385-173390, 173392, 173394, 173396, 173402, 173404, 173406-173413, 173415-173416, 173418, 173421-173422, 173425-173427, 173429, 173431-173435, 173437-173443, 173445-173452, 173454-173455, 173458-173461, 173463, 173466-173471, 173477, 173480, 173482, 173484, 173486-173488, 173492-173495, 173501, 173503-173507, 173509-173510, 173518, 173523-173527, 173529, 173531-173533, 173537, 173540-173544, 173547-173548, 173550-173551, 173554, 173557, 173562-173563, 173567-173569, 173572-173573, 173576, 173578, 173581-173589, 173591, 173593-173594, 173596, 173598, 173600-173601, 173603-173604, 173606-173608, 173615, 173617-173626, 173629-173634, 173636-173644, 173652, 173654-173656, 173658, 173660, 173663-173674, 173677, 173679-173680, 173682, 173684-173686, 173689, 173691-173692, 173698-173700, 173705-173708, 173710-173712, 173715, 173717-173720, 173722-173723, 173727-173729, 173731-173733, 173735-173737, 173739, 173741-173742, 173744-173747, 173749, 173751, 173753-173758, 173760-173761, 173765, 173768, 173770-173772, 173774, 173776-173785, 173787-173788, 173792, 173794, 173797-173798, 173800-173801, 173804, 173807, 173809-173812, 173814, 173819-173820, 173822-173829, 173832, 173834-173836, 173838-173840, 173843-173844, 173846-173848, 173851-173852, 173854-173859, 173862, 173864-173866, 173868-173881, 173883, 173885-173899, 173901, 173904-173909, 173912, 173914, 173917-173918, 173920-173925, 173927-173930, 173932-173933, 173936-173937, 173939, 173941-173947, 173951, 173956-173959, 173965-173978, 173980-

173984, 173987, 173989-173992, 173996-173998, 174000-174001, 174003, 174005-174013, 174015, 174021-174022, 174025, 174027, 174030-174031, 174038-174044, 174046-174048, 174050-174054, 174056-174059, 174061-174063, 174065-174068, 174070-174071, 174074, 174078-174080, 174086-174087, 174089-174090, 174092-174095, 174098-174099, 174103, 174105-174107, 174112-174120, 174122, 174125, 174127-174129, 174132-174133, 174135-174143, 174145, 174147-174149, 174152-174155, 174159-174160, 174162-174164, 174168, 174170-174177, 174179, 174182, 174185-174186, 174189, 174191-174195, 174197, 174201, 174204-174205, 174207-174208, 174210, 174213-174216, 174219-174220, 174222, 174224, 174228-174234, 174237-174238, 174240-174241, 174244-174249, 174252-174253, 174255-174259, 174261-174264, 174266, 174269, 174274, 174276, 174279, 174282-174285, 174288-174289, 174291-174295, 174299-174305, 174307-174309, 174312, 174314, 174316-174317, 174319-174325, 174327-174328, 174330-174332, 174335-174338, 174343, 174345-174346, 174350-174352, 174354-174355, 174357-174358, 174360-174363, 174366-174370, 174372-174383, 174385, 174387, 174389, 174391-174396, 174401-174402, 174404-174406, 174408-174410, 174412-174413, 174416-174417, 174419-174421, 174423-174426, 174428-174429, 174433-174437, 174439-174442, 174448, 174454, 174456, 174459, 174462-174463, 174467-174470, 174472-174481, 174483, 174488-174489, 174491-174494, 174496-174504, 174507, 174511-174513, 174517, 174519-174521, 174523, 174525-174529, 174532, 174534-174537, 174540-174543, 174545-174546, 174554, 174556, 174558, 174561, 174563-174566, 174574, 174577-174579, 174583-174584, 174586, 174588-174589, 174592-174600, 174602, 174604-174606, 174608-174609, 174611-174617, 174619, 174622, 174624-174627, 174629, 174631-174634, 174637, 174639-174640, 174642, 174644, 174646-174648, 174652-174656, 174662-174665, 174672, 174675, 174677, 174686-174688, 174690-174692, 174696, 174699-174701, 174703-174715, 174717-174718, 174720-174722, 174725-174733, 174735-174739, 174741-174744, 174746-174748, 174750-174751, 174753-174757, 174759, 174762, 174766, 174768-174771, 174780-174781, 174783-174784, 174786-174787, 174789-174790, 174793, 174795-174800, 174805, 174807-174808, 174810, 174812-174814, 174820, 174823-174825, 174827, 174829-174830, 174832-174833, 174836-174839, 174841-174843, 174847, 174849-174850, 174853-174855, 174859-174860, 174862, 174864-174865, 174867-174868, 174871-174874, 174877-174880, 174882-174884, 174887-174890, 174892, 174895-174897, 174899, 174901, 174906-174912, 174914, 174916, 174919, 174921, 174923, 174926-174933, 174936-174938, 174941, 174943, 174945-174946, 174948, 174950-174960, 174962, 174964-174966, 174974, 174977-174978, 174980, 174982-174983, 174985, 174988-174991, 174993-174995, 174997, 174999, 175001-175002, 175007, 175009-175011, 175013, 175021-175027, 175029, 175031-175034, 175036, 175040-175045, 175048-175049, 175051-175052, 175054-175056, 175059, 175061, 175064, 175066, 175069, 175071-175072, 175074-175081, 175083-175084, 175086-175088, 175090-175092, 175094-175096, 175098, 175100-175102, 175104-175106, 175108, 175110-175112, 175115-175116, 175118, 175120-175122, 175124-175125, 175127-175129, 175132-175134, 175136-175137, 175139-175141, 175143-175144, 175147-175154, 175156-175157, 175160-175161, 175163-175164, 175166-175167, 175169-175176, 175178-175184, 175187, 175191-175193, 175197-175203, 175205, 175207, 175210, 175212-175213, 175216-175220, 175222-175223, 175225, 175227-175234, 175236-175240, 175242-175245, 175247-175254, 175256-175266, 175270-175272, 175274, 175276-175278, 175280, 175282, 175284-175288, 175290-175291, 175293, 175295, 175297-175301, 175303-175304, 175306-175311, 175313-175316, 175318, 175320, 175322-175323, 175327-175331, 175336-175337, 175339-175345, 175348, 175351-175352, 175354, 175356-175359, 175361-175362, 175364-175367, 175370-175372, 175374-175376, 175378-175380, 175382, 175384, 175388-175389, 175391, 175393-175394, 175396-175397, 175399-175400, 175404-175406, 175408, 175411, 175414-175416, 175418-175424, 175426-175427, 175429, 175432-175440, 175444, 175449, 175451-175457, 175459, 175461, 175463, 175467, 175470-175473, 175476-175477, 175481-175483, 175486-175492, 175494, 175497, 175500, 175502-175513, 175516-175520, 175523-175528, 175530-175533, 175536-175538, 175540-175546, 175550, 175555-175557, 175559, 175561, 175563-175572, 175575-175579, 175582, 175584-175590, 175592-175595, 175597, 175599-175603, 175606-175607, 175609-175618, 175621-175627, 175629-175630, 175633, 175636, 175638-175640, 175644, 175646-175651, 175653-175654, 175656, 175658-175660, 175662-175664, 175666-175670, 175677, 175679-175682, 175684-175692, 175695-175702, 175704, 175706-175708, 175711-175712, 175715-175719, 175721, 175724-175727, 175731-175737, 175740, 175742-175750, 175752-175755, 175757-175758, 175760, 175763-175768, 175771, 175774, 175776-175783, 175786-175791, 175794-175795, 175803-175804, 175806-175809, 175815-175817, 175819, 175821, 175824-175828, 175830-175835, 175838-175843, 175848, 175850-175856, 175858-175864, 175868, 175870-175876, 175878, 175880, 175882-175884, 175889-175895, 175897-175899, 175903-175908, 175910-175915, 175918-175921, 175924-175925, 175927-175928, 175934, 175936, 175938-175943, 175946-175948, 175951-175958, 175962, 175964, 175967, 175970-175981, 175983-175996, 175999-176001, 176004-176006, 176008, 176012-176013, 176015, 176019-176021, 176023, 176025-176028, 176030-176033, 176038, 176042-176047, 176049, 176051-176053, 176055-176059, 176061, 176063-176066, 176068-176076, 176079, 176082-176089, 176091, 176095, 176099-176105, 176110-176114, 176118-176119, 176122, 176125, 176128, 176130-176133, 176136-176138, 176140-176143, 176146-176147, 176150-176156, 176158-176161, 176166, 176168, 176171, 176174-176176, 176178-176181, 176184-176191, 176193, 176196, 176199-176202, 176204-176207, 176210, 176212-176213, 176215-176218, 176221-176222, 176227, 176231-176232, 176234, 176237-176238, 176240, 176242-176245, 176247, 176249, 176251, 176255, 176258-176259, 176261, 176263-176267, 176270-176271, 176273-176277, 176280-176282, 176287, 176289, 176291-176298, 176300-176303, 176305-176309, 176313, 176315-176316, 176318-176319, 176323-176325, 176328-176329, 176331-176335, 176339-176340, 176342-176345, 176347, 176349, 176351-176353, 176355-176357, 176363-176368, 176371-176374, 176377-176381, 176383, 176385, 176390, 176392, 176394-176395, 176397, 176399, 176402, 176404-176406, 176411, 176415-176419, 176421-176422, 176424-176433, 176435-176440, 176442-176445, 176447-176449, 176455-176458, 176461-176462, 176464-176466, 176468, 176470, 176473, 176475-176477, 176479, 176482, 176485-176486, 176494, 176496, 176502-176505, 176508-176512, 176514-176518, 176520-176521, 176523-176529, 176531, 176533-176535, 176539-176543, 176545, 176548, 176550-176555, 176557-176558, 176562, 176565-176569, 176571-176574, 176576-176581, 176583-176584, 176587-176588, 176590-176591, 176594-176597, 176599-176606, 176608-176616, 176618, 176621-176622, 176624-176626, 176628-176630, 176632-176635, 176637-176640, 176643-176652, 176654, 176657-176663, 176665-176672, 176677-176679, 176681, 176684-176685, 176692, 176695, 176697-176704, 176708, 176710-176712, 176714, 176716-176718, 176720-176722, 176724, 176727-176732, 176734, 176736, 176739-176741, 176748-176751, 176755, 176757-176758, 176760-176762, 176765-176769, 176771-176772, 176774, 176777-176779, 176781-176792, 176794-176796, 176798-176805, 176808-176812, 176814-176815, 176817, 176820, 176822-176825, 176827-176828, 176830, 176832-176833, 176835-176842, 176844, 176846-176847, 176850, 176854-176855, 176857, 176859, 176861-176863, 176868, 176872, 176874-176876, 176880-176886, 176888-176889, 176898-176903, 176905, 176907-176909, 176911, 176914, 176916-176919, 176921-176923, 176925, 176928, 176930, 176933-176940, 176942-176943, 176945-176946, 176948-176950, 176952-176953, 176956-176959, 176961, 176963, 176966, 176968-176972, 176974-176975, 176977, 176980-176997, 176999-177003, 177006, 177008-177010, 177013, 177015-177018, 177020, 177022, 177024, 177030-177031, 177033, 177035-177036, 177038-177043, 177045, 177047-177050, 177053, 177055, 177057-177064, 177066-177068, 177070-177072, 177074, 177076-177081, 177086, 177089-177093, 177096-177097, 177100, 177107, 177109-177112, 177115, 177117-177118, 177120-177121, 177124-177131, 177133, 177136, 177138-177139, 177141-177145, 177151-177153, 177155-177156, 177159-177163, 177169-177173, 177177-177179, 177183, 177186-177190, 177194-177201, 177214-177215, 177217-177223, 177225-177228, 177230-177232, 177234-177240, 177243, 177246, 177250-177252, 177254-177261, 177263-177265, 177269-177279, 177281, 177283-177284, 177286-177287, 177289-177291, 177294-177296, 177298, 177301, 177303, 177305-177309, 177311-177314, 177316-177317, 177322, 177324-177325, 177327-177328, 177331-177333, 177335-177336, 177341, 177344-177346, 177350, 177356, 177359, 177362-177363, 177366, 177371, 177374-177375, 177377, 177379-177381, 177383-177385, 177387-177388, 177395, 177398, 177401-177409, 177411-177421, 177424-177426, 177429-177434, 177445-177447, 177450, 177453-177454, 177457-177461, 177469-177472, 177474-177476, 177478-177480, 177482-177486, 177493-177495, 177497-177498, 177501-177504, 177507, 177509, 177514, 177518-177519, 177521, 177527-177530, 177532, 177534-177535, 177537, 177539, 177541-177543, 177547, 177549-177550, 177552-177554, 177557-177561, 177565, 177568, 177572-177573, 177577, 177579-177580, 177582-177584, 177586-177588, 177590-177591, 177595-177600, 177602, 177604-177610, 177612, 177615, 177617, 177622-177632, 177635, 177638, 177641-177642, 177644, 177646-177649, 177652, 177654-177655, 177661-177662, 177664, 177666-177672, 177676-177679, 177681-177685, 177688-177689, 177692, 177696-177703, 177706, 177708, 177711-177723, 177725, 177727-177728, 177731-177734, 177739, 177742-177743, 177745, 177748-177753, 177755-177758, 177760-177762, 177764-177767, 177769-177775, 177778-177784, 177786-177789, 177792-177795, 177797-177802, 177805, 177807-177811, 177813-177818, 177820, 177822-177825, 177827-177829, 177831-177832, 177835-177839, 177841-177842, 177844-177845, 177849-177856, 177858, 177860-177861, 177863, 177869-177870, 177872-177873, 177875, 177877, 177879, 177881-177882, 177884, 177886, 177890, 177893-177895, 177898-177899, 177901, 177903-177905, 177907-177908, 177910, 177913-177916, 177918-177921, 177923, 177925-177927, 177930-177935, 177938-177939, 177943, 177946-177953, 177955-177960, 177962-177964, 177966-177970, 177972, 177975, 177977-177982, 177985-177987, 177991-177994, 177997, 177999, 178004-178006, 178008, 178010-178011, 178014, 178017, 178020-178022, 178030-178032, 178034, 178036-178040, 178042, 178046-178053, 178055, 178059-178061, 178064-178065, 178067-178068, 178070-178073, 178075-178077, 178079, 178081-178082, 178085-178086, 178090, 178092-178093, 178095, 178097-178100, 178103-178106, 178108, 178110, 178115-178128, 178130-178132, 178135-178138, 178140-178143, 178145, 178147-178153, 178155, 178158-178159, 178161-178163, 178165, 178167-178168, 178170, 178172-178173, 178175-178176, 178178, 178181, 178183-178188, 178190-178193, 178197-178199, 178204, 178206-178209, 178211-178212, 178214-178218, 178220-178221, 178224, 178226-178230, 178236-178238, 178240, 178242-178245, 178247, 178249-178250, 178252-178256, 178261-178262, 178264-178265, 178267-178269, 178272-178274, 178276-178280, 178283, 178289-178294, 178296-178301, 178305, 178308-178309, 178311, 178314, 178316-178319, 178322, 178324-178325, 178327-178331, 178334, 178337-178338, 178340, 178344-178345, 178347, 178353-178354, 178356-178360, 178363-178365, 178369, 178371-178372, 178374-178378, 178380, 178382, 178385-178386, 178388-178395, 178397-178398, 178400-178401, 178403, 178407-178409, 178411-178413, 178415-178419, 178421-178422, 178424, 178427-178430, 178435, 178438-178440, 178442-178443, 178446, 178448-178450, 178452-178457, 178459-178464, 178470, 178472-178473, 178477, 178479, 178481-178482, 178484, 178490, 178495, 178497-178500, 178503, 178505, 178507-178509, 178511-178512, 178516, 178521, 178524-178529, 178531-178533, 178536, 178539, 178542-178546, 178548, 178550-178551, 178554-178555, 178558, 178560, 178562-178563, 178565-178566, 178568, 178570, 178572-178573, 178576-178579, 178581, 178584-178586, 178589, 178591-178592, 178595-178599, 178605-178611, 178614-178620, 178624-178625, 178629, 178632-178633, 178636, 178638, 178640-178643, 178646, 178648, 178654, 178656-178657, 178660, 178663, 178671-178674, 178676-178680, 178683-178687, 178689-178693, 178696, 178698, 178701-178703, 178705-178711, 178715, 178717-178720, 178722, 178724-178725, 178729-178731, 178734-178739, 178741-178742, 178744-178745, 178748-178749, 178751-178760, 178763-178765, 178768, 178770, 178772, 178777-178780, 178782-178785, 178787-178788, 178792-178794, 178796, 178799-178802, 178804-178806, 178808-178809, 178812, 178820-178821, 178823-178824, 178826-178828, 178830-178831, 178834-178836, 178838-178840, 178842-178846, 178850, 178852, 178854-178857, 178861-178864, 178867, 178872, 178874-178879, 178886-178904, 178906-178907, 178909, 178911-178912, 178914-178918, 178920-178921, 178923-178930, 178932-178933, 178935-178943, 178945, 178947, 178949-178953, 178955, 178957, 178960, 178962-178963, 178968-178977, 178979-178981, 178983-178984, 178988, 178990-178991, 178993-178997, 178999-179003, 179006-179007, 179009-179010, 179013-179021, 179023-179024, 179026-179036, 179041-179044, 179046, 179048-179049, 179051-179058, 179060-179062, 179064-179066, 179068-179070, 179072-179077, 179079-179081, 179083, 179085-179087, 179090-179092, 179094-179095, 179098-179100, 179102-179104, 179106, 179109-179110, 179113-179114, 179116, 179120-179121, 179124, 179127, 179129-179130, 179132-179136, 179138-179140, 179142-179144, 179146-179150, 179152-179157, 179159, 179162-179164, 179166, 179168, 179170-179176, 179178, 179181, 179183-179192, 179198-179200, 179202, 179205-179207, 179211-179213, 179215-179216, 179219, 179223-179228, 179231, 179234, 179236-179238, 179242-179243, 179245, 179248-179250, 179252-179258, 179261, 179263, 179265-179267, 179269-179270, 179272-179277, 179279-179282, 179285-179286, 179288-179290, 179292-179294, 179297-179298, 179300, 179304, 179306, 179309-179310, 179312-179315, 179317-179320, 179324-179325, 179327, 179329-179330, 179333-179334, 179337-179346, 179348, 179350-179355, 179357-179365, 179367, 179369-179371, 179373-179375, 179378, 179381-179383, 179385-179386, 179389-179390, 179392-179393, 179395, 179397-179398, 179400, 179403, 179405-179406, 179408, 179410, 179413-179417, 179420, 179422-179425, 179427-179429, 179433, 179435-179438, 179440-179445, 179451, 179453, 179455-179457, 179460-179466, 179468, 179470, 179472-179474, 179479-179485, 179487-179493, 179495, 179501, 179503-179506, 179508, 179512, 179514-179516, 179518, 179520, 179522-179526, 179528-179538, 179540-179545, 179547-179548, 179552-179555, 179557, 179559, 179561-179568, 179571, 179573-179578, 179580-179582, 179585, 179587, 179591, 179594-179596, 179598-179599, 179601-179603, 179605, 179607-179613, 179616-179620, 179622-179625, 179627-179635, 179638, 179642, 179644, 179648-179651, 179654-179670, 179672-179676, 179678-179681, 179685, 179688, 179690-179692, 179694-179695, 179698-179706, 179709-179712, 179715-179721, 179723, 179725-179726, 179728-179729, 179731-179732, 179734, 179736-179738, 179741-179747, 179749-179756, 179758, 179760-179763, 179765-179766, 179769, 179771, 179773, 179777-179779, 179781-179783, 179785, 179787-179791, 179793-179800, 179803-179806, 179809, 179812, 179814, 179816-179818, 179821-179828, 179830, 179832-179834, 179836-179842, 179844, 179849-179851, 179853, 179857-179858, 179861, 179863-179866, 179868-179869, 179872-179880, 179883-179890, 179892-179897, 179901-179910, 179912-179913, 179915, 179918-179924, 179926, 179929, 179931, 179935-179936, 179939-179941, 179945-179947, 179949, 179952-179955, 179959-179962, 179964, 179966, 179969-179970, 179974-179975, 179978, 179981, 179984, 179989, 179994-179998, 180000-180003, 180006, 180008-180011, 180015, 180017, 180019-180030, 180033-180050, 180053, 180055, 180057, 180059, 180061-180062, 180067-180069, 180071-180072, 180075-180078, 180080-180081, 180083-180085, 180087-180088, 180090-180093, 180095-180099, 180101-180109, 180111-180113, 180115, 180117-180121, 180123-180124, 180126, 180132-180133, 180135-180137, 180140-180141, 180143, 180145, 180147, 180155-180157, 180159, 180161-180164, 180171-180173, 180175-180176, 180178, 180181, 180185, 180187, 180189, 180191, 180197, 180199-180200, 180202-180204, 180207-180209, 180211-180215, 180217-180219, 180221-180223, 180225, 180227-180229, 180232-180233, 180235-180236, 180238-180239, 180242, 180247-180253, 180256-180261, 180263-180264, 180266-180270, 180272-180273, 180275-180278, 180280, 180282, 180284-180296, 180298, 180304-180306, 180308-180311, 180313-180314, 180316-180319, 180321-180322, 180324, 180326-180327, 180330-180333, 180338-180342, 180344-180346, 180349, 180354, 180358, 180363, 180365-180373, 180375, 180377-180378, 180380-180381, 180383, 180386-180388, 180397, 180399-180400, 180403, 180406, 180412, 180414-180415, 180417-180418, 180421-180423, 180427-180428, 180430, 180432-180434, 180437-180438, 180444-180446, 180451-180458, 180461-180463, 180466-180467, 180471-180485, 180488-180489, 180495, 180497-180501, 180503-180504, 180508, 180510-180513, 180515, 180517-180521, 180524-180531, 180534, 180536-180538, 180540-180544, 180546-180547, 180549-180550, 180552-180557, 180559-180560, 180563, 180565-180571, 180573, 180576-180577, 180580-180581, 180583, 180590-180604, 180606-180607, 180609, 180613-180616, 180618-180621, 180623-180625, 180628-180635, 180637-180638, 180641-180645, 180647, 180649-180650, 180652, 180654-180656, 180659-180660, 180662-180663, 180665-180666, 180668, 180671-180674, 180676-180683, 180685-180691, 180693, 180695, 180697-180700, 180702, 180704-180707, 180711-180715, 180719, 180723-180727, 180729, 180731-180734, 180737-180739, 180742-180744, 180746-180753, 180755-180756, 180759-180760, 180762-180763, 180766, 180769-180773, 180777, 180781-180782, 180786, 180788-180790, 180793, 180796-180797, 180804-180805, 180807-180808, 180810-180812, 180816, 180818-180820, 180822-180825, 180827-180828, 180830-180831, 180833, 180835-180836, 180838-180845, 180847-180848, 180852, 180858-180861, 180863-180864, 180868-

180869, 180871-180872, 180876, 180879, 180882-180884, 180886-180887, 180889-180892, 180894-180896, 180898, 180903, 180905-180906, 180910-180911, 180913, 180915-180916, 180919-180920, 180922, 180926, 180929, 180931, 180933, 180936-180938, 180941-180944, 180946-180947, 180953-180958, 180963-180964, 180966-180968, 180970-180974, 180976-180977, 180980-180982, 180986, 180989-180998, 181001-181003, 181005-181006, 181008, 181010-181011, 181013-181023, 181026, 181031, 181033-181034, 181037-181044, 181046-181051, 181053-181056, 181058, 181060, 181063-181065, 181068-181071, 181075-181078, 181080-181086, 181088-181089, 181091-181094, 181097-181098, 181100, 181102, 181104, 181106-181108, 181112-181113, 181115-181119, 181121-181123, 181125, 181129, 181135, 181137, 181139, 181141, 181143, 181147-181149, 181155-181162, 181164, 181166, 181169-181170, 181175-181180, 181182, 181185, 181187-181188, 181193, 181195, 181197, 181199, 181203-181206, 181208, 181210-181211, 181215-181223, 181225-181231, 181233-181239, 181244-181249, 181251-181255, 181258-181261, 181263-181267, 181269-181278, 181280, 181282, 181284, 181286-181287, 181289-181290, 181292-181294, 181298, 181303-181305, 181307-181308, 181310-181326, 181328, 181330-181335, 181337, 181339-181341, 181344, 181346, 181351-181353, 181355, 181359-181360, 181364, 181366-181374, 181376, 181378-181386, 181389, 181391-181393, 181395, 181400-181414, 181417, 181420-181421, 181423-181431, 181433-181436, 181438, 181442-181443, 181445, 181448-181454, 181456-181463, 181465-181475, 181477-181478, 181480-181483, 181486, 181488-181491, 181493, 181495, 181497, 181499-181505, 181507-181509, 181511-181514, 181517-181519, 181523, 181527, 181530-181531, 181535-181536, 181538-181540, 181542, 181545-181549, 181551, 181553-181556, 181558-181560, 181562-181566, 181568-181572, 181574, 181576, 181580-181581, 181583, 181585-181586, 181588, 181590-181591, 181594-181597, 181599-181600, 181602, 181604-181612, 181614-181618, 181620-181623, 181625-181630, 181632-181633, 181635, 181638, 181640-181645, 181648-181649, 181651-181654, 181656-181657, 181662-181667, 181674-181676, 181679-181685, 181687, 181691-181693, 181697, 181699-181701, 181704-181708, 181711-181713, 181717-181723, 181726, 181729-181730, 181732, 181734-181746, 181749-181753, 181757, 181760, 181762-181764, 181767, 181769-181771, 181774-181778, 181783, 181785, 181790-181797, 181799-181801, 181804-181806, 181812-181815, 181817-181818, 181820-181823, 181826-181829, 181831-181836, 181838-181842, 181844, 181847, 181849-181852, 181854-181859, 181861-181868, 181871-181879, 181882-181887, 181891-181896, 181898-181899, 181901-181921, 181923, 181925-181927, 181931-181936, 181938-181939, 181941-181945, 181947-181948, 181950, 181953, 181955-181959, 181962-181968, 181970, 181972, 181974-181975, 181978, 181980, 181982-181983, 181986, 181988, 181990-181991, 181994-181995, 181998-182000, 182002-182005, 182008, 182010-182021, 182023-182027, 182029, 182033, 182039-182043, 182047-182053, 182055-182056, 182059-182060, 182064-182065, 182067-182068, 182071-182073, 182075-182077, 182079, 182084-182085, 182087-182095, 182100, 182102, 182104-182105, 182108, 182110-182112, 182115-182117, 182119-182121, 182123-182137, 182139, 182141-182145, 182147-182155, 182157-182158, 182162, 182164-182165, 182167, 182171, 182173-182174, 182176-182183, 182185, 182187-182190, 182193-182194, 182196-182197, 182205-182212, 182218, 182222-182225, 182229-182231, 182234-182235, 182237-182241, 182243-182246, 182248-182251, 182253-182267, 182269-182270, 182272-182273, 182276-182280, 182282-182285, 182288-182290, 182293, 182295-182297, 182299-182304, 182306, 182308-182311, 182316-182317, 182320, 182322-182323, 182327, 182330, 182332, 182334, 182338, 182341, 182346-182350, 182354-182358, 182360-182363, 182365-182369, 182371-182373, 182375-182377, 182379-182383, 182385-182386, 182388, 182391-182393, 182399, 182401, 182403-182406, 182408-182410, 182412-182413, 182415-182418, 182421-182422, 182424, 182427-182429, 182434, 182436-182437, 182442-182444, 182446-182447, 182450, 182453-182454, 182457, 182459-182462, 182464, 182466, 182469-182472, 182475-182477, 182481-182484, 182486-182487, 182489-182492, 182495-182496, 182498, 182500, 182502-182503, 182505-182512, 182514-182517, 182519-182521, 182524, 182526, 182528, 182530, 182532, 182534, 182536-182537, 182539, 182542-182545, 182547, 182549-182553, 182555-182557, 182560, 182562-182566, 182573-182575, 182577-182581, 182583-182590, 182593, 182595, 182598-182604, 182608-182611, 182613-182624, 182626-182628, 182632-182633, 182635, 182638-182639, 182643-182644, 182646, 182649-182655, 182658-182659, 182662-182665, 182667-182672, 182674-182678, 182680-182700, 182702-182704, 182707, 182709-182714, 182718, 182720-182722, 182724-182726, 182728-182732, 182734-182745, 182749-182753, 182755, 182758, 182760-182763, 182765-182767, 182770-182771, 182773, 182779-182782, 182785, 182788, 182790-182798, 182800-182801, 182805, 182808-182809, 182812-182825, 182828, 182831, 182833-182837, 182841-182842, 182844-182848, 182850, 182852-182854, 182856-182857, 182859-182873, 182875, 182878-182879, 182881-182885, 182889-182890, 182892, 182894-182902, 182904-182905, 182907, 182909-182910, 182912, 182915, 182917-182918, 182920, 182923-182926, 182928, 182931, 182934, 182936, 182939-182946, 182948, 182950-182951, 182954, 182957-182971, 182975-182978, 182980, 182982-182987, 182990, 182992-182993, 182995, 182997-182998, 183001-183005, 183008-183009, 183012-183014, 183016-183019, 183021-183022, 183026, 183028-183030, 183032, 183034, 183036-183037, 183039-183042, 183044-183055, 183058, 183060, 183062-183063, 183065-183069, 183071, 183073-183075, 183078-183080, 183082, 183087, 183089-183091, 183093, 183095, 183098, 183101, 183103-183108, 183110-183116, 183119, 183121, 183124-183125, 183129, 183131-183132, 183134-183139, 183141-183144, 183147, 183149-183154, 183160-183169, 183171-183173, 183180-183181, 183184, 183186-183188, 183190, 183192-183198, 183200-183203, 183207, 183209, 183211-183215, 183217, 183220-183226, 183229-183230, 183232-183234, 183238-183241, 183243, 183249-183251, 183254-

183258, 183260-183261, 183266, 183269, 183272-183274, 183278-183279, 183281-183290, 183292-183293, 183295, 183299-183300, 183304-183306, 183308-183309, 183311, 183314-183325, 183327-183329, 183333-183334, 183337-183338, 183340, 183342-183343, 183347-183349, 183358, 183361-183364, 183366, 183368-183372, 183374, 183376-183377, 183379, 183381, 183385-183386, 183389-183390, 183392-183395, 183397-183398, 183400-183407, 183410-183414, 183417-183421, 183423-183426, 183430, 183433, 183436, 183438-183440, 183442-183445, 183447-183450, 183452-183454, 183456, 183459, 183461-183464, 183467-183468, 183470-183471, 183475, 183477-183479, 183481, 183483, 183485, 183489-183493, 183495-183499, 183501, 183505-183511, 183514, 183516, 183519, 183524, 183528-183535, 183538-183539, 183542-183543, 183545-183550, 183552-183555, 183558-183569, 183571-183578, 183580-183587, 183589, 183591-183597, 183599, 183603-183606, 183608, 183610-183612, 183615-183619, 183621-183623, 183627, 183629-183638, 183640, 183642-183643, 183645-183647, 183650-183652, 183655-183656, 183658-183661, 183664-183665, 183668, 183671, 183674-183684, 183688-183690, 183692-183695, 183699, 183701, 183703, 183706, 183710-183721, 183725, 183727-183735, 183737-183741, 183743, 183748, 183751-183756, 183758, 183761-183762, 183764-183766, 183768-183775, 183778-183780, 183785, 183787-183793, 183796-183803, 183805, 183809-183810, 183816, 183818-183820, 183824, 183826-183839, 183841-183842, 183844-183856, 183858-183860, 183862-183864, 183867-183871, 183873-183874, 183876-183877, 183879-183880, 183882, 183884-183888, 183890-183891, 183894-183895, 183899-183901, 183906, 183908-183912, 183914-183915, 183917-183923, 183928, 183930-183934, 183940-183942, 183945, 183948-183949, 183951-183953, 183955, 183958-183959, 183961-183962, 183964, 183966, 183968-183975, 183977, 183979-183985, 183987, 183990-183991, 183993-183996, 183998, 184000, 184002-184003, 184005, 184010, 184012, 184015-184016, 184019, 184021-184023, 184025, 184027-184033, 184038, 184041, 184043-184050, 184053-184057, 184060-184062, 184069-184078, 184080-184081, 184083-184085, 184087-184089, 184091, 184094, 184096, 184098-184101, 184104, 184107-184112, 184115-184120, 184124-184125, 184128, 184130-184133, 184135-184137, 184142-184147, 184149, 184151, 184153-184157, 184160-184165, 184167-184168, 184170, 184175, 184177, 184179-184182, 184185-184188, 184191-184196, 184198-184204, 184206, 184208-184211, 184213-184216, 184220-184231, 184234, 184236-184237, 184239-184248, 184250-184262, 184264-184265, 184267-184269, 184271-184277, 184282-184294, 184296, 184298-184302, 184304-184307, 184310, 184315-184321, 184323-184335, 184338, 184341-184342, 184344-184345, 184347-184356, 184358-184365, 184367-184368, 184370, 184372, 184375-184377, 184379, 184381-184382, 184384-184386, 184389-184394, 184397-184404, 184406-184408, 184410-184411, 184416-184417, 184419-184425, 184427-184428, 184430, 184432-184433, 184437-184438, 184440-184441, 184444-184447, 184449, 184453, 184455, 184457-184465, 184467, 184469-184471, 184473, 184475, 184477-184478, 184480-184485, 184487-184493, 184495-184496, 184498-184500, 184505, 184508, 184513, 184515-184519, 184521, 184523-184525, 184531-184532, 184534, 184536-184538, 184540, 184550-184551, 184554, 184556-184559, 184563, 184565, 184568, 184570-184573, 184576-184580, 184582, 184584-184596, 184598-184600, 184602-184607, 184612, 184615, 184617-184623, 184625-184627, 184629-184633, 184635-184636, 184638, 184640-184641, 184643-184651, 184653-184654, 184656-184657, 184660, 184662, 184666-184667, 184670-184678, 184680, 184682, 184684-184686, 184689-184691, 184693, 184695-184699, 184701-184704, 184706, 184711-184726, 184729, 184733, 184736-184741, 184743-184746, 184749, 184751, 184753, 184757, 184759-184760, 184762, 184765-184766, 184768-184769, 184772-184776, 184778, 184780-184783, 184785-184789, 184791-184794, 184796-184797, 184799, 184801-184804, 184806-184808, 184813-184814, 184816-184824, 184826-184828, 184831, 184834-184838, 184840-184848, 184852, 184854-184856, 184862-184875, 184879, 184881-184882, 184885-184895, 184897, 184902-184903, 184905-184907, 184909-184912, 184914-184915, 184917-184920, 184922, 184924-184930, 184932-184934, 184937, 184940, 184942, 184944-184947, 184953, 184955-184959, 184961, 184963-184964, 184966-184968, 184971, 184973, 184976, 184980-184981, 184985-184987, 184989-184990, 184992-184995, 185000, 185002, 185004, 185006-185011, 185013, 185015-185017, 185019, 185021-185022, 185026-185043, 185045-185048, 185050-185051, 185055-185056, 185058-185060, 185062-185079, 185081, 185083-185088, 185090-185094, 185096-185098, 185100-185103, 185105, 185107-185108, 185111-185114, 185117, 185120-185123, 185125, 185129-185130, 185134-185139, 185142-185145, 185148, 185150, 185153-185154, 185159-185161, 185163-185164, 185168-185169, 185171, 185177-185181, 185183, 185186-185188, 185191-185196, 185198, 185200-185201, 185204, 185206-185212, 185216-185218, 185225, 185227, 185232-185233, 185235-185236, 185247-185252, 185258-185259, 185265, 185268, 185271-185274, 185276, 185279-185284, 185287-185289, 185291, 185294, 185297-185303, 185305-185307, 185310, 185312, 185314, 185316, 185320-185325, 185327-185333, 185335, 185337, 185344-185345, 185347-185349, 185352-185354, 185356, 185358-185361, 185363-185367, 185369-185380, 185383-185387, 185389-185392, 185396-185404, 185406, 185408-185409, 185411-185421, 185424, 185426-185427, 185429, 185433-185442, 185444-185446, 185448-185452, 185454, 185456, 185458-185459, 185461-185466, 185470, 185472-185476, 185478-185481, 185485-185486, 185490-185491, 185493-185495, 185497-185502, 185504-185511, 185513-185517, 185520-185527, 185529-185530, 185532-185537, 185539, 185541-185542, 185546, 185548-185549, 185551-185552, 185554-185557, 185559, 185561-185566, 185568, 185571, 185574, 185577-185578, 185580-185582, 185584, 185586, 185589-185591, 185593-185601, 185604-185606, 185608-185611, 185614-185621, 185625-185627, 185631, 185635, 185638, 185643-185645, 185647, 185649-185650, 185654, 185656, 185659-185661, 185663-185664, 185667, 185669, 185674-185679, 185683, 185685-185687, 185693-

185695, 185697-185700, 185704-185705, 185707-185711, 185714, 185716-185718, 185721-185724, 185727-185730, 185732, 185737, 185741-185743, 185746, 185748-185752, 185755-185756, 185759-185762, 185764-185766, 185770-185778, 185780, 185782-185788, 185790, 185792-185793, 185795-185796, 185799-185804, 185806-185807, 185809, 185811, 185813-185814, 185816-185817, 185823, 185825, 185827-185840, 185842-185844, 185847-185851, 185853-185854, 185860-185862, 185864, 185874, 185876-185877, 185879-185882, 185887, 185890-185895, 185900, 185904, 185908-185911, 185915-185919, 185922, 185924-185928, 185932-185934, 185937-185941, 185944-185950, 185952-185954, 185957-185959, 185961-185966, 185968-185971, 185973, 185976, 185978, 185981, 185984, 185986-185990, 185993, 185995-185996, 185998, 186000, 186002, 186004, 186008-186009, 186011, 186015-186017, 186021-186023, 186025-186030, 186033, 186035-186038, 186040-186052, 186054, 186056-186060, 186062, 186064-186067, 186070-186076, 186078-186084, 186088-186089, 186092, 186095, 186097-186099, 186102, 186104-186105, 186107-186110, 186112-186114, 186116-186118, 186121-186122, 186127, 186130-186132, 186134-186141, 186143-186145, 186147, 186149-186152, 186155, 186157-186160, 186163-186164, 186166-186171, 186173-186174, 186176-186177, 186180, 186182-186187, 186189-186193, 186195-186208, 186212-186215, 186221-186223, 186225-186227, 186230, 186232, 186238-186240, 186243-186244, 186246-186247, 186249, 186251-186257, 186260, 186262-186263, 186266-186267, 186270-186271, 186273, 186275-186276, 186278-186280, 186282, 186284-186291, 186294-186296, 186298-186303, 186306-186308, 186311-186312, 186314, 186316-186320, 186322, 186324-186330, 186333-186335, 186338, 186341, 186343-186351, 186355-186356, 186358-186359, 186361-186370, 186372-186373, 186375-186382, 186384-186385, 186387, 186389, 186392, 186394-186395, 186397-186399, 186401-186402, 186404-186412, 186414-186415, 186420-186421, 186424, 186426-186431, 186434-186438, 186441-186444, 186447-186449, 186451-186453, 186455, 186457-186458, 186460, 186462-186463, 186466, 186469-186478, 186480, 186482-186483, 186485, 186491, 186495-186498, 186501-186502, 186504-186506, 186508-186509, 186512-186522, 186525, 186530-186531, 186533-186534, 186536-186540, 186542-186544, 186548-186552, 186555-186557, 186559, 186561, 186563, 186566, 186569-186572, 186574, 186576, 186578, 186580-186584, 186587, 186590-186593, 186596, 186599, 186601-186603, 186605, 186607-186611, 186614-186615, 186618-186619, 186621, 186624-186628, 186630-186633, 186635-186640, 186643-186646, 186648, 186652-186653, 186656-186659, 186661-186665, 186668, 186672, 186674-186692, 186694-186698, 186700-186702, 186704, 186707, 186709-186710, 186712-186717, 186719, 186721-186722, 186725, 186727-186728, 186730, 186733-186734, 186737-186740, 186742-186750, 186753-186754, 186756, 186760-186766, 186769, 186773, 186776, 186779-186782, 186785, 186787, 186789-186791, 186793, 186796-186797, 186800, 186802-186803, 186807-186813, 186815-186817, 186821-186822, 186824-186825, 186827-186829, 186839-186840, 186843-186845, 186848-186851, 186856-186857, 186859-186860, 186862, 186864-186866, 186868-186880, 186884-186887, 186889-186893, 186897, 186899, 186901-186903, 186907, 186909-186914, 186916-186919, 186924-186927, 186929-186930, 186932-186933, 186935-186942, 186945, 186948, 186952-186955, 186959-186961, 186963-186966, 186968-186980, 186982-186990, 186992, 186994-186995, 186997-186999, 187001-187002, 187006, 187009-187012, 187015-187016, 187018-187019, 187021, 187023-187024, 187026-187034, 187036-187037, 187039, 187041, 187044-187048, 187051, 187057-187059, 187063, 187068, 187070-187074, 187077-187078, 187080-187081, 187083-187091, 187094-187095, 187098-187102, 187104-187106, 187108, 187111-187115, 187117, 187119-187125, 187127, 187131, 187133-187134, 187136-187137, 187139-187140, 187142, 187144, 187148, 187151-187154, 187157-187167, 187169-187178, 187180-187182, 187186-187196, 187198-187207, 187209-187210, 187213, 187216-187219, 187222-187223, 187225, 187227, 187230-187231, 187233-187239, 187241, 187243-187245, 187250-187258, 187261-187262, 187267-187276, 187278, 187281, 187284, 187287, 187290, 187293-187304, 187309-187312, 187314-187315, 187319-187327, 187329-187332, 187335-187337, 187339-187341, 187344, 187346, 187350-187351, 187354, 187357-187358, 187360, 187364-187370, 187373-187384, 187386-187387, 187390-187394, 187397, 187401, 187404-187405, 187407-187409, 187411, 187413, 187415-187418, 187420, 187423, 187426-187430, 187432-187438, 187441-187445, 187452-187453, 187456-187459, 187463-187466, 187468, 187470-187473, 187475, 187477-187478, 187481-187485, 187487-187490, 187492-187495, 187497-187503, 187509, 187511, 187515-187516, 187518, 187520, 187525, 187528, 187533, 187537-187540, 187544, 187546, 187548-187549, 187552, 187554-187556, 187559-187562, 187564-187565, 187567-187568, 187570-187572, 187574-187579, 187581, 187583-187584, 187587, 187589, 187592, 187597-187603, 187606-187614, 187620, 187622, 187627-187636, 187638, 187647, 187651-187655, 187661-187665, 187668, 187670, 187677, 187681-187685, 187689, 187691, 187693-187694, 187697, 187700, 187702-187703, 187705-187709, 187714, 187716, 187720-187723, 187725, 187729-187732, 187734-187735, 187738-187740, 187744, 187747-187750, 187753, 187755, 187759, 187762-187776, 187778-187779, 187781-187782, 187784-187786, 187788-187792, 187794, 187796-187797, 187799, 187801, 187803-187806, 187811, 187813-187820, 187823-187828, 187830-187831, 187833-187850, 187853, 187855-187859, 187861, 187865-187866, 187872-187874, 187876-187878, 187881-187882, 187884, 187887, 187892-187896, 187899-187900, 187902-187904, 187908-187912, 187914-187917, 187919, 187921-187922, 187925-187936, 187941, 187947-187954, 187956, 187959-187965, 187967-187968, 187970, 187972-187973, 187977-187978, 187980-187981, 187983-187985, 187987-187989, 187992, 187995, 188000-188010, 188012, 188016-188019, 188021-188023, 188026-188028, 188030, 188033-188041, 188043-188045, 188049-188059, 188064-188065, 188067, 188070-188074, 188081-188091, 188093-188096, 188102-188107, 188109, 188111-188112, 188114-188116, 188118-

188123, 188125-188126, 188129-188132, 188134, 188139, 188142-188143, 188149-188151, 188153-188155, 188158, 188161-188162, 188165-188171, 188173-188174, 188176, 188178, 188185, 188192, 188194, 188196-188199, 188201, 188207-188209, 188212-188213, 188215-188220, 188228-188232, 188234-188235, 188237-188244, 188246, 188249-188253, 188260, 188262, 188264, 188266-188272, 188274-188279, 188281-188285, 188287, 188289, 188291-188293, 188295-188299, 188301-188305, 188307, 188313-188316, 188319-188327, 188331-188335, 188338, 188341-188345, 188353-188359, 188361, 188363, 188365-188368, 188372-188373, 188377-188385, 188390-188395, 188397, 188402-188404, 188406-188409, 188411-188413, 188415-188423, 188425-188428, 188430-188432, 188435-188447, 188451, 188453, 188455, 188457-188464, 188466-188468, 188470, 188472-188478, 188480-188481, 188484, 188486, 188490-188492, 188497, 188499, 188501, 188503, 188505-188507, 188509-188510, 188512, 188517-188519, 188521-188527, 188529, 188531, 188535-188540, 188543, 188548-188550, 188553, 188557, 188559-188560, 188562-188567, 188570-188571, 188573, 188575, 188577-188580, 188583-188585, 188588-188589, 188591-188592, 188594-188597, 188600, 188603-188611, 188613-188615, 188617-188621, 188623-188631, 188633, 188635-188639, 188642, 188644-188650, 188652-188659, 188661-188663, 188665-188671, 188673-188674, 188676-188679, 188690, 188692-188695, 188697-188703, 188705-188707, 188709-188715, 188718-188722, 188724, 188726-188727, 188729-188732, 188734, 188736-188742, 188744, 188751, 188753, 188757, 188760, 188762-188763, 188766-188767, 188769-188770, 188773-188774, 188777, 188779-188780, 188785-188786, 188788, 188791, 188793-188798, 188800-188801, 188803-188804, 188806-188811, 188813-188814, 188818-188826, 188828-188829, 188831-188833, 188835-188836, 188838-188840, 188844-188857, 188859-188860, 188862-188870, 188872, 188875-188878, 188880-188883, 188887, 188890-188892, 188894-188895, 188898, 188900, 188902-188904, 188906-188908, 188910-188915, 188917, 188919-188921, 188924-188925, 188927-188929, 188935-188937, 188939-188940, 188945, 188947-188950, 188952, 188954-188955, 188961, 188968, 188970, 188972, 188974-188975, 188983, 188985, 188987, 188993, 188996, 189001, 189003, 189005, 189009, 189011-189018, 189024, 189026-189027, 189029-189030, 189032, 189039-189041, 189049, 189053-189057, 189060, 189062-189066, 189068, 189070, 189074, 189076-189077, 189079, 189081-189089, 189091, 189097-189105, 189107, 189110, 189113, 189115-189116, 189120-189123, 189125-189137, 189139-189140, 189142, 189144-189147, 189149, 189151-189152, 189154-189157, 189161-189163, 189166, 189179-189180, 189182, 189184, 189186-189189, 189192-189193, 189196, 189198, 189200, 189202, 189204, 189206-189211, 189214-189216, 189218-189221, 189223, 189225-189233, 189235-189238, 189243, 189247-189254, 189256-189258, 189260, 189268-189269, 189271, 189273-189276, 189278-189282, 189284, 189287-189290, 189292-189294, 189296-189297, 189300, 189304-189308, 189313, 189317-189319, 189321-189334, 189337-189340, 189343-189345, 189347, 189349, 189359, 189362-189368, 189370-189381, 189384-189391, 189393-189398, 189400-189403, 189407-189409, 189411-189420, 189426-189427, 189429-189430, 189432-189435, 189437-189448, 189453-189455, 189457-189460, 189464, 189467-189470, 189472-189485, 189489, 189491-189498, 189500-189504, 189508-189515, 189517, 189519-189521, 189524-189531, 189535-189536, 189538, 189543-189544, 189550, 189552-189558, 189560, 189563-189564, 189567-189569, 189571-189576, 189583, 189587-189589, 189591, 189594-189599, 189601-189602, 189607-189616, 189620-189622, 189624, 189626-189629, 189631-189634, 189637, 189639, 189642-189645, 189647-189648, 189650-189651, 189653, 189658, 189665, 189669-189670, 189672-189674, 189677, 189680, 189682, 189684-189688, 189693-189694, 189696, 189703, 189705, 189707-189708, 189710-189711, 189714-189725, 189727-189728, 189733, 189735-189742, 189744-189750, 189753-189754, 189759-189760, 189762-189765, 189767-189771, 189773-189774, 189776-189778, 189780, 189782-189787, 189789-189792, 189794, 189796-189797, 189800, 189806, 189808-189809, 189811, 189813, 189816, 189818-189821, 189823, 189825, 189828-189829, 189831-189832, 189834, 189837, 189839, 189842-189844, 189847, 189852-189857, 189860, 189865-189871, 189874, 189876-189883, 189885, 189887-189890, 189892, 189894-189897, 189900-189915, 189917, 189922-189925, 189927-189929, 189931-189933, 189935-189936, 189940-189944, 189946-189947, 189952-189953, 189956-189959, 189964, 189966-189968, 189970-189971, 189974, 189976-189985, 189989, 189991, 189994-189995, 189998-190004, 190006-190013, 190015-190017, 190022-190023, 190026-190027, 190030-190031, 190033-190034, 190036, 190038, 190044-190045, 190047-190050, 190054-190056, 190058-190059, 190062-190064, 190069-190072, 190074, 190078-190080, 190082, 190085, 190087, 190092, 190095, 190097, 190099, 190101-190103, 190108, 190110-190111, 190113, 190117, 190121-190122, 190124-190128, 190130-190135, 190139-190140, 190143-190146, 190151, 190153-190158, 190161, 190163-190164, 190166-190167, 190170-190173, 190175-190179, 190182-190189, 190191-190197, 190199-190201, 190204-190209, 190211-190215, 190217-190218, 190220-190221, 190226, 190228-190232, 190237-190238, 190240-190241, 190243, 190245-190249, 190252, 190254, 190256, 190260, 190262, 190264-190265, 190267, 190270-190272, 190274-190276, 190278-190280, 190284, 190287-190310, 190312, 190316-190318, 190320-190321, 190323-190326, 190329, 190333, 190335-190339, 190344-190346, 190348, 190350, 190353-190356, 190359, 190362-190370, 190373, 190376-190381, 190383-190385, 190387, 190389, 190391-190397, 190399-190401, 190403-190405, 190407-190410, 190412-190417, 190419-190420, 190422, 190425-190429, 190431-190439, 190441, 190443-190447, 190450-190451, 190453-190454, 190456-190458, 190460, 190462, 190464-190468, 190472-190478, 190480-190481, 190484-190491, 190494, 190499-190500, 190504-190505, 190508-190515, 190517-190522, 190524-190527, 190529, 190533, 190535-190538, 190540, 190543-190553, 190555-190564, 190566, 190568-190574, 190576-190581, 190584-190589, 190592, 190602-190609, 190611, 190614, 190620, 190622, 190624-190626, 190630-190633, 190635, 190638, 190641-190642, 190644, 190647-190650, 190652, 190655, 190659-190661, 190663, 190665-190668, 190670, 190674-190675, 190679-190682, 190684-190689, 190695-190702, 190704-190707, 190709-190711, 190714, 190716, 190718-190721, 190723-190724, 190728, 190730-190731, 190734, 190740, 190743-190745, 190751-190753, 190756-190760, 190763, 190765-190766, 190768-190769, 190774-190775, 190777-190778, 190780-190781, 190783, 190785-190787, 190789-190798, 190801, 190804-190808, 190810-190812, 190815-190818, 190820, 190822-190827, 190833, 190835-190840, 190842-190846, 190848-190850, 190853-190859, 190861-190863, 190871-190876, 190878-190880, 190882-190885, 190887, 190891, 190893-190894, 190896, 190898-190906, 190908, 190915, 190918-190921, 190925-190927, 190929, 190932-190935, 190938-190940, 190942, 190944-190952, 190954-190958, 190960-190963, 190965-190966, 190968-190969, 190973-190974, 190978, 190984-190987, 190989-190991, 190994-190997, 191002, 191004-191010, 191012, 191014-191017, 191021-191029, 191031-191032, 191034, 191039-191040, 191042, 191044-191045, 191049, 191053-191054, 191057, 191059, 191061, 191063-191064, 191066, 191071, 191073-191074, 191078-191079, 191081, 191084, 191087, 191089-191090, 191093-191095, 191097-191099, 191102-191109, 191111-191114, 191116-191118, 191121, 191128-191129, 191132-191133, 191140, 191143, 191147, 191150, 191155-191157, 191162-191164, 191166-191170, 191173-191176, 191178-191181, 191183-191186, 191188-191192, 191194-191198, 191201, 191203, 191205-191209, 191211, 191213, 191217-191218, 191225-191226, 191229, 191231-191232, 191234, 191237-191238, 191240-191243, 191245, 191247, 191251, 191254-191255, 191261, 191263-191264, 191266-191267, 191269-191271, 191273-191274, 191276, 191278-191279, 191281-191285, 191287, 191289, 191294, 191296, 191299-191300, 191302, 191304, 191307-191308, 191312-191317, 191320-191321, 191325-191327, 191329-191332, 191334-191335, 191338, 191340, 191343, 191345, 191347-191348, 191350, 191354-191355, 191357-191358, 191360-191361, 191365-191367, 191369-191371, 191373, 191375, 191377-191379, 191383-191388, 191390, 191393, 191396-191401, 191403, 191405, 191408, 191411-191412, 191416, 191419, 191421-191424, 191426-191429, 191432-191434, 191437, 191439-191440, 191446-191447, 191449-191451, 191453, 191456-191458, 191460, 191462-191465, 191470-191479, 191481, 191484, 191486, 191489-191491, 191494, 191496, 191499, 191502-191505, 191507-191508, 191510-191517, 191519, 191521-191523, 191526-191530, 191532-191535, 191537-191539, 191541-191544, 191546, 191548-191551, 191553, 191555-191566, 191568, 191572, 191575-191584, 191586-191587, 191590, 191595-191601, 191603, 191605-191607, 191609, 191611, 191614-191615, 191620-191628, 191630, 191632, 191634, 191636-191637, 191639, 191642-191645, 191650-191658, 191661-191663, 191669, 191671-191674, 191676, 191678, 191680, 191682-191688, 191690-191694, 191696, 191698-191699, 191702, 191705-191707, 191710-191712, 191715-191716, 191718, 191722, 191724-191730, 191732-191733, 191738, 191740, 191742-191744, 191747-191749, 191752-191755, 191757, 191759-191761, 191763-191766, 191768-191771, 191773, 191775-191783, 191785-191786, 191788, 191790, 191793-191796, 191798-191801, 191803-191806, 191809-191812, 191815, 191818-191819, 191821, 191823, 191831-191832, 191834-191843, 191846-191847, 191849-191850, 191854-191855, 191858, 191860-191861, 191863-191868, 191870, 191872-191878, 191880-191881, 191884, 191886-191888, 191891, 191895, 191897-191899, 191901-191905, 191908, 191911, 191914-191916, 191918, 191920, 191924-191927, 191930-191931, 191934-191940, 191943, 191945-191946, 191948, 191950-191952, 191954-191955, 191958, 191960-191974, 191977-191993, 191995-191996, 191998-192000, 192006, 192008-192009, 192013, 192016-192019, 192021, 192023-192025, 192027, 192029-192033, 192038, 192041, 192045-192047, 192050, 192052-192053, 192055-192057, 192060-192061, 192063-192064, 192066-192070, 192074-192075, 192077-192079, 192083, 192085-192087, 192089-192093, 192095-192096, 192098, 192100-192101, 192103-192105, 192107, 192110-192121, 192124, 192130-192133, 192135-192138, 192140-192150, 192152-192157, 192160, 192163-192164, 192166-192170, 192174-192175, 192177-192179, 192181-192187, 192190, 192192, 192194-192199, 192202, 192205, 192208, 192210-192211, 192213-192214, 192216-192219, 192222-192226, 192231-192232, 192235-192239, 192242-192246, 192248, 192250-192255, 192257, 192259-192260, 192262, 192265, 192267, 192269, 192271, 192273-192275, 192277-192282, 192284-192292, 192294, 192296-192298, 192300-192304, 192306, 192308-192310, 192312-192313, 192315, 192317, 192319-192328, 192330-192333, 192338-192340, 192342, 192344-192346, 192348, 192350, 192353, 192355, 192357, 192359-192360, 192362, 192365, 192369-192371, 192373, 192376-192382, 192384, 192386-192388, 192390-192392, 192394-192397, 192399-192404, 192406-192410, 192412-192414, 192417-192421, 192423-192424, 192427-192428, 192431-192439, 192441, 192443-192445, 192447-192448, 192451-192455, 192458-192461, 192463-192470, 192474, 192476, 192479-192482, 192484-192490, 192492-192493, 192496, 192502-192507, 192510, 192513, 192515, 192518-192522, 192524, 192526-192527, 192532-192536, 192538, 192541-192546, 192552-192555, 192557, 192559, 192561-192565, 192568, 192574-192581, 192583, 192586-192587, 192591-192592, 192595, 192598-192604, 192606-192608, 192611, 192615-192619, 192621-192627, 192633, 192635-192637, 192639-192640, 192643, 192647-192653, 192655-192659, 192663-192666, 192668-192670, 192673-192682, 192684-192685, 192687, 192689, 192691-192693, 192695-192696, 192699, 192703, 192706-192708, 192711-192714, 192717-192721, 192725-192733, 192735, 192737, 192739-192741, 192746, 192748, 192750, 192758, 192760, 192762-192767, 192770-192772, 192774-192776, 192778-192781, 192783, 192785-192787, 192789-192793, 192795-192796, 192799-192803, 192806, 192808-192813, 192816-192822, 192824, 192827-192829, 192832, 192834-192837, 192844, 192846, 192849-192854, 192856-192859, 192862, 192864, 192867-192868, 192870-192871, 192876-192878, 192880-192883, 192885, 192888-192894, 192897, 192900-

192906, 192909, 192915-192918, 192920-192921, 192923-192927, 192929-192931, 192933-192934, 192936-192937, 192939-192941, 192944, 192947-192959, 192962-192964, 192966-192967, 192969-192970, 192973-192977, 192979-192988, 192990, 192994-192997, 193000, 193002, 193005-193006, 193008, 193010, 193012-193015, 193017, 193019-193020, 193022-193025, 193028-193029, 193031-193037, 193039, 193041-193042, 193045, 193047, 193050, 193052, 193054-193055, 193057-193058, 193060, 193063-193068, 193071-193072, 193074, 193076-193077, 193079-193082, 193085, 193087, 193089, 193091, 193093-193100, 193103, 193105-193106, 193109-193110, 193113-193115, 193117, 193119, 193121-193124, 193126, 193128-193129, 193132-193137, 193139, 193144, 193146, 193151-193152, 193155, 193157, 193160-193163, 193167-193168, 193170, 193172-193173, 193175-193177, 193181-193182, 193185-193191, 193193-193195, 193197, 193199-193201, 193203-193204, 193211-193213, 193215-193217, 193219-193220, 193223, 193225-193228, 193230-193235, 193237, 193239, 193243, 193245, 193247-193250, 193252-193264, 193267-193269, 193272-193274, 193276, 193278, 193281, 193284-193286, 193290, 193294, 193296-193297, 193300-193301, 193305, 193307, 193309, 193313-193314, 193316-193322, 193324-193326, 193329, 193332, 193334, 193338-193350, 193352, 193354-193359, 193362, 193364, 193366-193370, 193374-193376, 193379-193380, 193382-193385, 193387-193389, 193391-193392, 193394, 193396, 193399-193400, 193402-193403, 193405-193406, 193408, 193410-193411, 193414, 193416, 193418, 193420, 193423-193425, 193427-193429, 193432, 193434-193436, 193438-193439, 193445-193448, 193450, 193453, 193456-193460, 193462, 193465-193466, 193472-193473, 193480-193481, 193484-193485, 193488-193491, 193493-193499, 193502-193503, 193506, 193509-193510, 193512-193517, 193522-193525, 193528, 193530-193532, 193535-193541, 193545-193547, 193550-193554, 193557, 193559-193562, 193564-193568, 193571, 193573-193575, 193578-193579, 193582-193583, 193585-193587, 193589, 193591-193593, 193595-193597, 193599-193601, 193603-193604, 193608-193610, 193613-193619, 193622-193625, 193629-193630, 193633-193634, 193639-193646, 193648-193657, 193659, 193662, 193664-193665, 193668-193669, 193671-193681, 193683, 193685-193686, 193688-193689, 193691-193694, 193696-193701, 193703-193704, 193706, 193709-193712, 193714-193718, 193720-193722, 193725-193727, 193729-193736, 193739-193742, 193745, 193747, 193749-193753, 193756-193758, 193760-193764, 193766-193790, 193792-193793, 193795-193797, 193799-193807, 193809-193810, 193814, 193816-193817, 193819-193821, 193824, 193826-193831, 193834-193837, 193839, 193843, 193845-193847, 193849-193851, 193853, 193855-193857, 193859, 193863-193867, 193869-193872, 193875-193878, 193880-193882, 193884-193887, 193889, 193891-193892, 193895-193896, 193899-193901, 193905-193906, 193908-193909, 193913-193914, 193917, 193922-193924, 193927, 193929-193931, 193933, 193935, 193937-193939, 193941-193946, 193948-193953, 193955-193956, 193958-193960, 193962, 193964-193965, 193967, 193970-193972, 193974-193976, 193979-193981, 193985-193986, 193988, 193990-193995, 193998, 194003-194008, 194011-194012, 194014, 194017-194019, 194021-194023, 194025-194030, 194032-194044, 194047-194049, 194051, 194053-194056, 194060, 194062-194064, 194066-194069, 194071-194074, 194076, 194080-194083, 194085-194090, 194093, 194096, 194098-194102, 194104-194106, 194109, 194112, 194114, 194117, 194119-194121, 194124, 194127, 194130-194134, 194137-194140, 194142, 194144-194145, 194152-194153, 194156-194162, 194164-194167, 194169-194170, 194172-194176, 194178-194180, 194182-194183, 194185-194188, 194190-194192, 194194, 194196-194200, 194202, 194204-194205, 194207, 194209, 194211-194215, 194218, 194221-194222, 194224-194225, 194227, 194229-194230, 194232-194233, 194235-194237, 194239-194243, 194245-194246, 194253-194254, 194263, 194268-194270, 194272, 194274, 194276, 194278, 194280-194293, 194296, 194300, 194303, 194305, 194307, 194309, 194312, 194314-194316, 194319-194321, 194325-194327, 194330-194331, 194333-194341, 194344-194347, 194349, 194351, 194353-194354, 194357-194362, 194366, 194369-194371, 194373, 194375-194376, 194378-194381, 194384-194389, 194391-194395, 194398, 194400, 194402-194409, 194411, 194414-194417, 194421, 194423, 194425-194428, 194430-194436, 194441, 194443-194447, 194449-194452, 194455-194456, 194458, 194460-194463, 194467-194471, 194473-194474, 194477-194480, 194482-194485, 194487-194488, 194490, 194492, 194495-194500, 194502-194505, 194507-194509, 194511, 194513-194514, 194516-194521, 194523-194526, 194528-194532, 194536, 194542-194543, 194548-194550, 194553-194556, 194559-194561, 194563-194565, 194567-194569, 194571, 194573-194574, 194578-194579, 194581-194582, 194584-194585, 194591-194597, 194599, 194601, 194603-194608, 194612-194618, 194621-194629, 194631-194632, 194634-194638, 194641-194647, 194649-194657, 194660-194669, 194672, 194675-194681, 194684, 194686-194691, 194693-194696, 194698-194699, 194701, 194704-194710, 194712-194713, 194716-194718, 194720-194727, 194729-194731, 194734-194737, 194739-194743, 194746, 194750, 194752-194758, 194760-194765, 194769-194771, 194773-194779, 194781-194786, 194790-194791, 194793, 194795, 194797-194798, 194800-194802, 194806-194807, 194809-194810, 194813-194816, 194823, 194825-194826, 194829, 194833-194834, 194836, 194843-194845, 194847, 194849-194850, 194854-194855, 194857-194858, 194864-194866, 194868, 194870, 194873-194876, 194878, 194880-194881, 194883, 194885, 194889-194891, 194895-194896, 194898-194899, 194903-194905, 194907, 194909, 194911, 194915-194916, 194920, 194922, 194924-194926, 194928-194930, 194933-194934, 194936, 194940-194941, 194943, 194945-194948, 194954-194958, 194960, 194965, 194967-194969, 194971-194982, 194985, 194987-194989, 194991, 194993, 194995-195002, 195004-195012, 195015-195019, 195021-195024, 195026, 195028, 195030-195032, 195034, 195036-195037, 195039-195040, 195045, 195049-195062, 195064-195065, 195068-195072, 195074-195077, 195079, 195085-195087, 195089-195090, 195092, 195095, 195101-195103, 195105, 195107, 195111-195116, 195120, 195123-195125, 195127-195131, 195134, 195136, 195139-195142, 195146-195150, 195153-195156, 195159-195160, 195166-195170, 195172, 195175, 195177-195178, 195181, 195185-195187, 195189-195190, 195192-195193, 195196, 195198-195211, 195213, 195215-195224, 195226-195228, 195230-195234, 195238-195247, 195250-195252, 195254-195256, 195258-195259, 195261-195264, 195268-195269, 195272, 195274-195276, 195279-195280, 195283, 195285, 195288-195291, 195293-195295, 195297, 195299, 195302-195303, 195307, 195309-195310, 195312-195314, 195316, 195318-195319, 195321-195322, 195329, 195334-195337, 195339-195347, 195350-195352, 195354-195357, 195359-195365, 195368-195370, 195372-195376, 195379-195381, 195384, 195387-195388, 195390-195393, 195397-195400, 195403, 195406-195409, 195412, 195414-195419, 195421-195422, 195425-195426, 195428-195430, 195432, 195434, 195438, 195441-195446, 195449-195450, 195452, 195454, 195456-195461, 195463-195465, 195469-195473, 195477-195478, 195480, 195482, 195484-195486, 195488-195492, 195494-195496, 195498-195501, 195503, 195505-195506, 195508, 195511-195512, 195515-195519, 195524-195527, 195539, 195541, 195543-195546, 195548-195550, 195552-195556, 195559, 195561, 195564-195566, 195568, 195572-195575, 195577-195578, 195580-195582, 195584-195587, 195590, 195592-195594, 195596, 195598-195606, 195612-195614, 195617, 195622-195624, 195627-195628, 195630-195632, 195634-195635, 195637, 195639-195649, 195651-195652, 195654, 195662, 195665-195671, 195673, 195675, 195678-195679, 195681, 195683-195686, 195688-195693, 195695-195709, 195712, 195716, 195718-195719, 195721-195723, 195725, 195727, 195731, 195733-195734, 195736-195741, 195743-195744, 195748-195758, 195760-195761, 195764-195770, 195773-195774, 195776, 195778, 195780, 195782, 195785, 195787-195791, 195793-195794, 195797, 195799-195803, 195805-195811, 195813-195814, 195816, 195820-195821, 195823-195824, 195831, 195833-195839, 195841-195853, 195857-195862, 195864, 195866, 195869-195876, 195878, 195881, 195887, 195891-195895, 195897-195899, 195903-195904, 195907-195908, 195910, 195913-195917, 195920-195921, 195923, 195925-195928, 195930, 195932-195934, 195936, 195938-195940, 195942-195946, 195948, 195950-195951, 195953-195957, 195959, 195961-195962, 195964, 195967-195968, 195972-195973, 195975, 195977, 195979-195980, 195982-195983, 195985-195986, 195988, 195990, 195993-195994, 195996, 195998-195999, 196003, 196006-196010, 196012-196014, 196016-196017, 196019-196020, 196023-196024, 196029-196030, 196032-196034, 196036-196040, 196042, 196044-196049, 196052-196059, 196062-196065, 196067-196069, 196072-196077, 196079-196080, 196084-196086, 196088-196089, 196092, 196095-196096, 196099-196103, 196108-196109, 196111-196112, 196114-196115, 196119-196123, 196125-196126, 196128, 196130-196138, 196140-196148, 196153, 196155, 196157, 196159-196169, 196171-196173, 196176-196180, 196182-196185, 196187-196195, 196197-196199, 196201, 196203, 196206-196208, 196210, 196212, 196214-196221, 196223-196229, 196231, 196233, 196235-196238, 196240, 196242-196243, 196245, 196247, 196249-196250, 196253, 196255, 196258-196262, 196264-196268, 196270, 196272-196273, 196279-196280, 196284-196285, 196287, 196289-196291, 196293-196302, 196304, 196308-196309, 196311-196319, 196323-196324, 196326-196333, 196335-196337, 196339-196340, 196342-196345, 196347-196352, 196355-196363, 196365-196366, 196368-196370, 196372-196376, 196378-196388, 196390-196391, 196393-196398, 196400-196402, 196404-196408, 196410, 196412-196417, 196421, 196423, 196425-196426, 196429-196435, 196437, 196440-196447, 196450-196451, 196453-196456, 196458-196462, 196464-196465, 196468-196474, 196476, 196479-196485, 196492, 196495-196496, 196499, 196503-196504, 196506, 196508, 196510-196511, 196514-196518, 196521-196524, 196526-196527, 196529, 196531-196532, 196535-196536, 196538-196542, 196544, 196546-196550, 196552-196555, 196557-196559, 196561-196562, 196564, 196566-196568, 196570, 196576-196579, 196582, 196584, 196586-196587, 196590-196597, 196599, 196602, 196606, 196609-196612, 196617-196622, 196624-196626, 196628-196630, 196633-196635, 196637-196638, 196641, 196643, 196645-196647, 196651, 196653-196654, 196656, 196660, 196662, 196664-196666, 196669-196671, 196673-196674, 196676, 196681, 196685-196687, 196689-196690, 196693-196695, 196697, 196702-196706, 196710, 196712-196713, 196718-196719, 196724, 196726-196727, 196731-196733, 196735, 196737-196738, 196740-196741, 196743-196747, 196749, 196751, 196756-196757, 196759-196760, 196762-196765, 196768-196769, 196772, 196775-196776, 196778-196779, 196781, 196783-196784, 196786-196792, 196794-196795, 196797, 196799-196807, 196809, 196812, 196814, 196816-196824, 196830-196831, 196834, 196836, 196839, 196842-196844, 196846-196851, 196853, 196855-196857, 196859, 196863-196869, 196874-196876, 196878-196879, 196881-196883, 196885, 196888, 196893-196898, 196900-196905, 196908-196913, 196915-196916, 196918, 196921, 196923, 196925-196929, 196934-196935, 196941-196945, 196948, 196951, 196955, 196957-196959, 196962-196968, 196970, 196977, 196983-196988, 196990-196997, 196999-197003, 197006, 197009-197012, 197017-197026, 197028-197035, 197037-197041, 197044, 197046-197048, 197052-197053, 197056-197057, 197059-197060, 197064-197065, 197067, 197070-197071, 197073-197074, 197078-197080, 197084-197087, 197089-197090, 197094-197095, 197097, 197099, 197102-197105, 197107, 197110-197111, 197113-197114, 197116-197119, 197122-197123, 197125-197126, 197130-197131, 197133-197139, 197141-197142, 197144-197148, 197150-197153, 197155, 197157-197160, 197163, 197166-197169, 197172-197173, 197175, 197181-197184, 197186-197189, 197191-197192, 197196, 197198-197200, 197204-197206, 197208-197209, 197211, 197213-197214, 197216-197218, 197220, 197222, 197224, 197226-197228, 197230-197232, 197235-197238, 197240, 197242-197243, 197251-197257, 197262-197265, 197268-197270, 197272-197273, 197276-197278, 197280, 197283-197284, 197287, 197290, 197293-197299, 197302, 197304, 197306-197307, 197309-197321, 197323-197324, 197326-197330, 197333, 197335-197339, 197341, 197344-197346, 197350-197363, 197367-197372, 197374-

197377, 197379-197380, 197386-197387, 197390, 197394-197398, 197400, 197402-197403, 197405-197406, 197408, 197410-197411, 197413-197414, 197419-197420, 197422, 197425-197426, 197428, 197430-197431, 197433-197436, 197439-197440, 197443, 197445-197447, 197449-197450, 197452, 197454-197455, 197457-197459, 197462-197497, 197499-197501, 197503-197504, 197506-197509, 197512, 197514, 197516, 197518-197520, 197525-197527, 197531-197537, 197539-197540, 197542-197547, 197549-197554, 197556-197559, 197561-197562, 197565-197567, 197570-197576, 197578-197580, 197582, 197584-197589, 197593-197600, 197602, 197605-197611, 197613, 197616-197619, 197622-197626, 197628-197632, 197634, 197636-197638, 197640, 197642-197643, 197646-197647, 197649-197652, 197656-197657, 197660-197664, 197666-197667, 197670-197671, 197674-197676, 197679, 197682, 197685-197688, 197690-197697, 197700-197701, 197706-197708, 197710-197714, 197717, 197720-197722, 197725-197727, 197729, 197731-197732, 197734, 197736-197737, 197740-197747, 197749, 197752-197755, 197758-197765, 197767-197768, 197770, 197772, 197774, 197778-197780, 197782, 197787-197790, 197792, 197794, 197796-197798, 197800, 197803-197812, 197814, 197816-197822, 197824-197827, 197830-197831, 197834-197835, 197837-197838, 197840-197842, 197844-197849, 197852, 197854-197855, 197857-197858, 197860-197861, 197863-197864, 197866-197868, 197872-197874, 197877-197880, 197882-197888, 197890-197891, 197897-197898, 197900-197902, 197904, 197906-197907, 197909, 197911-197913, 197915-197916, 197918-197919, 197921, 197924-197925, 197927, 197930-197936, 197941, 197944-197950, 197953-197954, 197956-197958, 197960-197962, 197964-197965, 197967-197968, 197971-197972, 197977-197978, 197980-197982, 197984-197985, 197987-197992, 197999-198003, 198006-198014, 198016-198018, 198021, 198023-198031, 198033-198038, 198041-198043, 198047-198050, 198054, 198056-198058, 198060-198061, 198063-198068, 198071-198072, 198074-198075, 198079, 198082, 198084, 198087-198089, 198094, 198096, 198099, 198102-198106, 198108, 198110-198112, 198115, 198118-198119, 198122, 198126-198127, 198130-198132, 198134, 198136-198138, 198140-198147, 198149, 198151, 198153, 198155, 198157, 198160, 198162, 198164-198165, 198168-198169, 198171, 198177-198178, 198182, 198184, 198186, 198191-198196, 198198, 198201-198203, 198206, 198208, 198210-198212, 198214-198221, 198228-198230, 198233-198234, 198236, 198245, 198249, 198253, 198256, 198258-198259, 198261-198264, 198267-198268, 198270-198271, 198274, 198276, 198279, 198281, 198286, 198288, 198290, 198293, 198296, 198301-198302, 198304, 198306, 198311, 198315-198317, 198320, 198322-198324, 198326, 198329, 198331-198332, 198336, 198338, 198341-198342, 198346, 198357, 198359, 198361, 198363-198364, 198367-198369, 198371, 198373, 198376, 198379, 198381-198387, 198389, 198391, 198394, 198396, 198398-198399, 198401-198406, 198408-198410, 198412-198417, 198419, 198422, 198429, 198431-198434, 198437-198441, 198443-198445, 198448-198453, 198456, 198458, 198460-198464, 198469, 198471-198472, 198474-198480, 198484, 198487-198488, 198490-198491, 198494, 198496-198497, 198499, 198502, 198506, 198509-198510, 198514-198515, 198520-198522, 198524-198526, 198528, 198530-198533, 198543-198544, 198549, 198554, 198556-198559, 198561, 198565-198568, 198570, 198572, 198575, 198577, 198584-198585, 198591-198592, 198594-198595, 198598, 198600-198601, 198605-198606, 198611-198613, 198616, 198619, 198621, 198623-198626, 198628-198629, 198632-198635, 198637, 198640-198641, 198643-198644, 198646-198647, 198650-198652, 198654, 198657-198658, 198660, 198663, 198665, 198667, 198669-198673, 198675-198678, 198680-198685, 198687, 198689, 198691-198693, 198695, 198700, 198702-198703, 198705-198718, 198720-198723, 198725-198726, 198728, 198730-198738, 198741-198742, 198745, 198749, 198754, 198757-198766, 198768-198769, 198772-198776, 198778-198779, 198783, 198798-198803, 198809-198811, 198813, 198815-198820, 198823, 198825-198832, 198835, 198837-198839, 198843-198845, 198851, 198860, 198862, 198864-198865, 198867-198872, 198874, 198876, 198878, 198880, 198882-198891, 198896, 198899-198900, 198903-198906, 198912, 198914-198919, 198921-198924, 198931-198937, 198940, 198944, 198947-198949, 198951-198955, 198957, 198959, 198961, 198965, 198967-198972, 198975, 198977, 198979-198982, 198986, 198989, 198993-198996, 198998, 199001, 199003-199004, 199006-199009, 199013, 199015-199016, 199018-199020, 199022, 199024, 199026, 199028-199032, 199034, 199039-199041, 199043-199044, 199046-199051, 199053-199059, 199062, 199064, 199066-199067, 199069, 199073-199075, 199077, 199082-199083, 199085-199086, 199089, 199092-199095, 199097, 199100, 199105, 199107-199108, 199110, 199112-199114, 199116-199117, 199120-199123, 199125, 199127-199129, 199132-199133, 199135-199137, 199140, 199145, 199148-199152, 199155-199157, 199159, 199164-199167, 199171-199174, 199176, 199180-199182, 199184-199185, 199192, 199196-199201, 199205-199208, 199212, 199215, 199217-199218, 199221-199222, 199228, 199231, 199235, 199237, 199240, 199242, 199244, 199246, 199248-199249, 199251, 199253-199256, 199258-199261, 199263-199264, 199267, 199269-199270, 199272-199274, 199276, 199278, 199280-199281, 199283-199289, 199304, 199307-199308, 199310, 199312, 199315-199316, 199318, 199321, 199324-199325, 199327-199328, 199335-199341, 199344-199347, 199350-199357, 199364, 199373, 199375-199381, 199383, 199385, 199393-199402, 199406, 199408-199409, 199412, 199414-199417, 199419-199421, 199423-199424, 199426-199427, 199430-199432, 199436-199441, 199444-199446, 199451-199453, 199455-199456, 199458-199464, 199466, 199468, 199471-199474, 199476, 199478, 199483-199486, 199488, 199490, 199493-199499, 199502-199505, 199507, 199511, 199515-199519, 199521-199525, 199527-199529, 199531-199532, 199534, 199536-199543, 199548, 199551, 199553-199555, 199557-199559, 199562-199565, 199568, 199570, 199572, 199574-199575, 199578, 199581, 199585-199586, 199589-199591, 199593-199594, 199597-199598, 199601, 199603-199604, 199610-199611, 199614, 199616, 199618, 199622-199623, 199625-199627, 199629, 199631, 199633-199635, 199637, 199639-199642, 199645, 199648, 199650-199654, 199656-199658, 199660, 199666-199668, 199671-199673, 199678-199679, 199681-199683, 199687-199690, 199693, 199696, 199698-199702, 199704, 199707-199708, 199710, 199712-199717, 199721-199722, 199728-199733, 199735-199739, 199744-199745, 199749, 199751-199752, 199754-199756, 199760-199763, 199765, 199768, 199770, 199772-199775, 199778, 199781, 199784-199789, 199791, 199796-199798, 199800, 199802-199809, 199813-199814, 199821-199822, 199824, 199827, 199829-199830, 199836, 199838, 199842, 199847-199850, 199852, 199854-199856, 199858-199859, 199861-199865, 199867-199870, 199872-199874, 199877, 199881-199886, 199888-199892, 199896-199917, 199919, 199924-199925, 199927, 199929-199938, 199940-199942, 199944-199949, 199951-199952, 199954, 199958, 199961-199962, 199967-199971, 199973-199976, 199978, 199980-199981, 199984-199986, 199989-199990, 199993, 199995-199999, 200002-200008, 200010-200011, 200013, 200015-200016, 200020, 200022-200023, 200026-200035, 200037, 200039, 200041-200044, 200046-200048, 200050, 200052-200056, 200058-200060, 200062-200066, 200068-200069, 200071-200072, 200075, 200077, 200082, 200087, 200092-200093, 200095, 200097-200099, 200102, 200105, 200107-200109, 200113, 200117, 200123, 200125, 200131-200132, 200134, 200136-200138, 200140, 200143, 200145, 200151-200155, 200159-200165, 200168-200172, 200174-200175, 200179-200180, 200182-200185, 200187, 200191-200197, 200199, 200203, 200206, 200208, 200210-200212, 200217-200220, 200222-200225, 200227-200229, 200234-200238, 200240, 200246, 200248-200251, 200255-200259, 200261, 200263-200264, 200266, 200269, 200271-200275, 200277-200285, 200287, 200289-200294, 200297, 200299, 200302-200307, 200310-200324, 200328, 200333-200335, 200338, 200341-200344, 200347-200352, 200355, 200357-200359, 200361-200365, 200369, 200375, 200377-200379, 200381-200383, 200388-200395, 200399-200400, 200404-200405, 200407-200410, 200412-200413, 200416-200418, 200420-200423, 200425-200428, 200431-200432, 200435-200437, 200439, 200441, 200443-200445, 200447-200448, 200453, 200456-200457, 200459, 200462, 200464-200469, 200471-200472, 200475-200477, 200479, 200482, 200484-200485, 200488, 200490-200495, 200498-200503, 200505-200508, 200510, 200512-200515, 200517, 200519-200520, 200522, 200524-200525, 200528-200541, 200543, 200547-200548, 200551-200553, 200558-200565, 200568-200571, 200573-200577, 200579-200583, 200585, 200589-200592, 200594-200595, 200597-200601, 200603-200606, 200609-200613, 200615-200617, 200619, 200621-200623, 200625, 200629, 200631, 200634, 200636, 200639-200643, 200649, 200652-200654, 200656, 200660-200664, 200666-200667, 200669, 200671-200672, 200674-200677, 200679-200682, 200684, 200686-200687, 200689-200692, 200694-200701, 200703-200704, 200706, 200708-200712, 200715-200718, 200720, 200724-200725, 200731-200736, 200738, 200740, 200742, 200744, 200746, 200748-200750, 200752-200762, 200764, 200767, 200769-200772, 200775-200776, 200778, 200781-200782, 200784, 200786-200791, 200793, 200795-200798, 200804, 200808-200809, 200811-200812, 200814, 200816-200822, 200824-200825, 200827-200830, 200832, 200834, 200838, 200840, 200844, 200846, 200849, 200855-200856, 200867, 200870, 200872-200873, 200875, 200878-200880, 200882-200884, 200887-200889, 200893, 200898, 200900-200903, 200909, 200911, 200916-200917, 200919, 200921-200927, 200929-200930, 200933-200934, 200936, 200938-200945, 200949, 200952, 200958-200961, 200964, 200967, 200969, 200971-200972, 200975, 200977-200980, 200985, 200987-200989, 200992-200993, 200995, 200999-201003, 201006-201014, 201016, 201018-201024, 201027-201028, 201030, 201034-201040, 201043, 201047-201048, 201050-201059, 201061-201066, 201068, 201073-201074, 201076, 201078-201079, 201081-201083, 201085-201087, 201089-201093, 201095-201097, 201099, 201101-201102, 201104-201106, 201109, 201111-201113, 201116-201117, 201121, 201125-201126, 201128-201135, 201137-201138, 201140-201141, 201143-201145, 201148-201152, 201154, 201156-201157, 201162, 201164, 201168, 201170-201174, 201176, 201179-201185, 201188-201189, 201191, 201193-201194, 201198-201201, 201203-201204, 201206-201207, 201211, 201215, 201217-201218, 201221-201222, 201224, 201227-201228, 201231-201234, 201237-201238, 201240-201242, 201246-201257, 201261, 201267-201271, 201274, 201276-201277, 201279, 201282-201284, 201287-201293, 201297-201300, 201302-201303, 201307-201310, 201312, 201314-201315, 201317, 201319, 201321-201323, 201327, 201329-201330, 201332, 201334-201342, 201344-201347, 201349-201350, 201352-201353, 201355-201359, 201361-201363, 201365-201366, 201368-201369, 201372-201378, 201381-201382, 201384-201385, 201387, 201389-201390, 201392-201405, 201407-201409, 201411-201413, 201415, 201418-201421, 201425-201427, 201429-201435, 201437, 201440-201443, 201446-201447, 201450-201451, 201454-201460, 201462-201463, 201465-201467, 201470, 201473-201478, 201480-201481, 201483-201484, 201488, 201490-201491, 201493-201496, 201498-201500, 201502-201505, 201508, 201511-201513, 201515-201518, 201525, 201528-201529, 201532-201533, 201536-201537, 201539-201540, 201542-201549, 201551, 201553-201555, 201557, 201559-201560, 201562, 201569-201571, 201575-201578, 201580, 201583-201588, 201590-201596, 201598, 201600-201603, 201605, 201608, 201615, 201618-201624, 201627, 201629-201630, 201633, 201635, 201637, 201639-201641, 201643-201646, 201648-201650, 201652-201658, 201660, 201664, 201667-201671, 201673-201679, 201682, 201684, 201686-201691, 201694-201695, 201703-201707, 201709-201710, 201714-201720, 201722, 201724, 201728-201730, 201733, 201735-201747, 201749, 201751, 201753, 201757-201759, 201761, 201768-201769, 201771-201774, 201776, 201779-201781, 201783-201784, 201788-201790, 201792-201801, 201803-201806, 201809-201810, 201812-201813, 201819-201822, 201824, 201826-201827, 201830, 201832, 201837-201838, 201841-201845, 201847, 201850-201853, 201855, 201857, 201860-201862, 201864-201868, 201870, 201873-201875, 201877-201879, 201881-201885, 201888-201889, 201893-201896, 201899-201900, 201902, 201904-201905, 201907, 201909-201911, 201913-201916, 201919, 201921-

201922, 201926, 201928, 201932-201934, 201937-201938, 201942-201943, 201945-201948, 201951, 201953, 201956-201957, 201959-201961, 201964, 201966-201968, 201970-201972, 201974-201979, 201981, 201986-201991, 201993-201995, 201998, 202001-202002, 202005-202006, 202008-202009, 202011, 202013, 202017, 202019-202022, 202024-202026, 202028, 202032-202033, 202035, 202039-202041, 202043-202044, 202046, 202050, 202053-202054, 202058-202063, 202065-202066, 202068, 202070, 202072, 202075-202082, 202084-202085, 202088, 202090, 202096, 202098-202106, 202109-202112, 202115-202116, 202118, 202122-202123, 202125, 202129, 202133, 202138, 202140, 202144-202146, 202149, 202153, 202158, 202160-202164, 202166, 202169, 202171-202180, 202183-202186, 202189-202195, 202201, 202203-202206, 202208-202211, 202216-202217, 202219-202221, 202225-202231, 202233, 202235-202238, 202240-202242, 202247-202251, 202253-202254, 202256, 202258-202263, 202267, 202270-202271, 202273-202276, 202280, 202284-202289, 202291-202296, 202298, 202301-202307, 202309-202310, 202312-202327, 202329, 202331-202332, 202334-202336, 202338, 202341-202343, 202345, 202347-202352, 202355-202357, 202361, 202365-202366, 202368, 202370, 202372, 202374-202379, 202381-202384, 202386, 202389-202402, 202405, 202408-202409, 202411-202416, 202418-202427, 202429-202432, 202435-202440, 202444-202445, 202447, 202449-202450, 202452-202456, 202459-202460, 202462, 202464, 202466-202467, 202469-202470, 202472-202475, 202477-202482, 202484-202486, 202488-202494, 202496, 202498-202500, 202503, 202509-202511, 202513-202515, 202517-202518, 202520, 202523-202529, 202533, 202535, 202537-202544, 202546, 202548-202554, 202556, 202558-202566, 202568-202569, 202571-202577, 202580-202584, 202587, 202590, 202592-202595, 202597, 202604, 202609, 202612, 202614, 202616, 202620-202624, 202629-202635, 202639, 202641, 202643, 202645, 202647, 202654, 202657, 202659-202661, 202664, 202666, 202669, 202671-202672, 202675, 202677, 202679-202684, 202687-202688, 202692-202695, 202697-202700, 202702, 202704-202705, 202707-202712, 202718, 202720-202721, 202723, 202726-202728, 202730-202735, 202737-202739, 202744, 202746, 202748, 202750-202751, 202754, 202756-202758, 202761-202764, 202767-202768, 202770, 202772-202773, 202777, 202779-202781, 202783, 202785-202787, 202789, 202795-202809, 202815-202816, 202818, 202820, 202824, 202828, 202830-202831, 202836-202837, 202839-202845, 202851-202856, 202859, 202862-202870, 202873, 202875-202882, 202887, 202890-202892, 202894-202899, 202901, 202904-202908, 202912-202917, 202920-202926, 202928-202933, 202939-202942, 202946-202953, 202958, 202960-202962, 202964-202965, 202968, 202970, 202972, 202974, 202976-202980, 202983-202988, 202990-202991, 202993-202995, 202998-202999, 203001-203007, 203009-203011, 203014-203016, 203018, 203020-203023, 203025-203028, 203031-203035, 203037-203041, 203046-203055, 203057-203062, 203069, 203071-203072, 203074-203075, 203077-203082, 203084-203085, 203087-203091, 203093, 203100-203102, 203105-203111, 203115-203120, 203124, 203126-203128, 203130, 203132, 203134-203136, 203138-203140, 203143, 203145, 203147-203152, 203155-203156, 203161-203162, 203164, 203166-203167, 203169-203171, 203175, 203177, 203179-203183, 203185-203188, 203191-203198, 203200-203206, 203208-203209, 203211-203212, 203215, 203218-203219, 203222, 203226, 203228, 203230-203232, 203235-203238, 203243-203249, 203252-203253, 203255-203256, 203259-203265, 203268, 203270, 203274-203276, 203278-203288, 203290-203291, 203294-203295, 203297, 203299-203300, 203303, 203306-203314, 203316, 203320-203321, 203325-203328, 203330-203332, 203334-203336, 203338-203339, 203341-203347, 203349-203350, 203354-203358, 203360-203361, 203363-203366, 203372, 203375, 203377-203379, 203381-203384, 203387-203392, 203394, 203402-203404, 203406-203407, 203410-203412, 203414, 203416-203418, 203422-203424, 203431, 203433-203436, 203439-203445, 203448, 203450, 203452-203457, 203459-203460, 203463-203466, 203469-203473, 203475-203478, 203482-203483, 203490, 203493-203495, 203500-203502, 203504-203506, 203508-203515, 203517-203520, 203522, 203526-203528, 203530, 203532, 203535-203538, 203540-203541, 203543-203544, 203547-203550, 203552-203555, 203557, 203559-203560, 203563, 203565-203567, 203570, 203573-203574, 203578-203579, 203583-203589, 203591, 203596, 203598-203601, 203605, 203607, 203609-203615, 203617-203620, 203622, 203624-203625, 203628-203629, 203632-203636, 203638-203645, 203648-203653, 203655, 203657-203660, 203662-203665, 203667-203672, 203674, 203676-203680, 203683, 203685, 203687-203690, 203693-203695, 203699-203704, 203706, 203708, 203710-203712, 203715-203716, 203719-203721, 203723-203726, 203729-203731, 203733-203741, 203744-203745, 203747-203750, 203753-203760, 203762-203763, 203765-203766, 203768-203772, 203774-203776, 203778-203779, 203781-203785, 203787, 203791, 203793-203795, 203799-203800, 203802-203803, 203806, 203808-203809, 203811-203812, 203814, 203816-203817, 203820, 203822-203824, 203828-203829, 203831-203833, 203835, 203837-203841, 203843, 203845-203850, 203852-203854, 203856, 203864-203866, 203869-203876, 203878-203880, 203882, 203885-203888, 203892-203894, 203896-203897, 203903-203904, 203910-203914, 203917-203918, 203920-203922, 203924-203926, 203929, 203931-203933, 203936, 203938-203939, 203941-203942, 203946-203951, 203953-203959, 203967-203978, 203981-203982, 203985, 203988, 203990-203991, 203993, 203995, 203998-204000, 204002-204006, 204008-204010, 204015-204018, 204020-204021, 204025-204029, 204031-204032, 204035, 204039, 204041-204043, 204045-204046, 204049-204052, 204056-204065, 204070, 204073, 204076-204077, 204080-204082, 204084-204089, 204092-204114, 204117-204121, 204123-204124, 204127, 204129-204133, 204135-204155, 204157-204167, 204169-204172, 204174, 204177, 204182-204186, 204188-204190, 204192, 204194-204195, 204198, 204200-204206, 204208-204209, 204211-204216, 204218, 204221, 204223, 204225, 204227, 204229-204235, 204237-204244, 204246-204248, 204251-204254, 204256-204257, 204260-204262, 204264-204266, 204268-204269, 204271-204292, 204294, 204296-204297, 204300, 204303-204308, 204311-204312, 204314-204315, 204317-204324, 204326-204328, 204330-204332, 204334, 204336, 204338-204339, 204342, 204346-204348, 204351-204358, 204364-204366, 204368-204374, 204377-204379, 204382-204384, 204386-204387, 204389-204391, 204393-204399, 204401-204406, 204408-204411, 204414-204415, 204417-204423, 204429-204430, 204432-204439, 204441-204442, 204444-204446, 204448-204450, 204452-204453, 204456, 204458-204471, 204473, 204475, 204477, 204479-204481, 204483, 204485-204489, 204491-204493, 204495-204497, 204499-204500, 204502, 204505-204506, 204508-204513, 204515-204520, 204522-204530, 204536-204537, 204541-204542, 204545-204546, 204553-204555, 204559-204562, 204564, 204567, 204569-204583, 204588-204604, 204606-204607, 204609, 204613-204619, 204621-204623, 204626-204629, 204631, 204633, 204635-204636, 204638-204648, 204653-204657, 204659-204660, 204662, 204664-204671, 204673-204674, 204676-204687, 204689-204690, 204698, 204700-204710, 204712-204713, 204715-204716, 204718-204719, 204721-204723, 204725, 204727-204730, 204732-204733, 204735, 204738-204739, 204742-204744, 204746, 204748-204754, 204756-204757, 204759, 204761-204762, 204764, 204766-204767, 204772-204775, 204777-204779, 204781-204788, 204791-204792, 204794, 204796-204805, 204809, 204811-204813, 204815, 204818-204822, 204824-204825, 204828-204833, 204835, 204837-204841, 204846-204850, 204852-204854, 204856-204858, 204860-204868, 204872-204874, 204877-204879, 204882-204883, 204885-204889, 204891, 204893-204897, 204899-204901, 204903, 204905, 204907-204908, 204910-204912, 204914-204919, 204921, 204923, 204926, 204928, 204930, 204933-204935, 204937-204949, 204951, 204953-204957, 204959, 204962-204966, 204968, 204970, 204972-204974, 204976-204979, 204981-204986, 204988, 204994-205000, 205005, 205009, 205012-205014, 205016-205018, 205020, 205022-205023, 205028-205032, 205034-205036, 205038, 205041-205043, 205045-205052, 205054-205057, 205060, 205068, 205070, 205072-205073, 205077, 205083, 205086-205094, 205097-205099, 205101-205107, 205111-205114, 205116-205118, 205121-205124, 205126-205128, 205130-205131, 205136, 205138-205147, 205149, 205151, 205153, 205156, 205159, 205163-205164, 205167-205170, 205173, 205175, 205178-205179, 205182, 205184-205185, 205187-205189, 205191-205192, 205195, 205199, 205201-205203, 205205, 205207-205208, 205211, 205213-205217, 205219-205221, 205223-205224, 205230-205231, 205233-205237, 205241, 205243-205246, 205250-205263, 205266, 205268, 205270-205272, 205274-205276, 205278-205279, 205283-205284, 205286-205289, 205291, 205295-205296, 205298, 205300-205302, 205306-205307, 205309-205311, 205313-205314, 205316, 205320, 205322-205323, 205325-205326, 205328-205330, 205333-205338, 205342, 205344, 205347-205349, 205351-205356, 205358, 205360, 205363, 205366-205374, 205377, 205379-205385, 205389-205399, 205403, 205413-205422, 205424, 205427, 205429, 205433-205437, 205439-205449, 205452-205455, 205457-205458, 205460, 205462, 205464, 205466, 205468-205473, 205476-205481, 205483, 205486-205490, 205492-205500, 205503-205509, 205514-205515, 205517-205520, 205522, 205525-205526, 205530, 205532-205541, 205543, 205545, 205549, 205553-205557, 205560, 205562, 205570-205576, 205580-205582, 205584, 205586-205590, 205595, 205599, 205603, 205605-205607, 205609-205610, 205612, 205614, 205616-205618, 205620-205622, 205624-205629, 205633, 205635-205644, 205646, 205648, 205650, 205652, 205657-205661, 205663-205667, 205669, 205672-205673, 205675-205676, 205678-205685, 205687, 205695, 205697-205698, 205701, 205705, 205707-205711, 205714-205719, 205721-205725, 205727-205729, 205731, 205740-205745, 205747-205749, 205751-205755, 205757-205760, 205763, 205765-205772, 205774-205775, 205777-205778, 205780-205784, 205786-205788, 205795-205796, 205798, 205800-205804, 205806-205812, 205814-205816, 205819, 205821-205830, 205833, 205835-205837, 205839-205840, 205842-205843, 205845, 205847, 205849-205853, 205856, 205859-205864, 205867-205872, 205876, 205878-205880, 205884-205885, 205887-205892, 205894-205895, 205897, 205900, 205902-205904, 205906-205908, 205910-205913, 205915-205925, 205928, 205931-205934, 205937-205949, 205951-205953, 205956, 205959, 205962-205965, 205968, 205971-205972, 205974, 205978, 205980-205981, 205985, 205989-205993, 205996-205998, 206000, 206003-206005, 206007-206014, 206016-206018, 206020, 206022-206025, 206027, 206029-206035, 206037, 206039-206042, 206044-206045, 206047, 206049, 206051-206052, 206054-206056, 206058-206059, 206062-206063, 206068, 206070, 206073, 206075-206078, 206081-206082, 206085-206087, 206089-206090, 206094-206095, 206097-206098, 206100-206106, 206108, 206110, 206114-206118, 206122-206128, 206130-206131, 206134-206140, 206142-206145, 206147-206153, 206157, 206160-206161, 206163-206167, 206169-206176, 206179-206180, 206182, 206187-206193, 206195-206197, 206199, 206203-206209, 206211, 206213-206214, 206216, 206218-206219, 206221, 206223-206224, 206226, 206228, 206231, 206233-206235, 206237-206238, 206240, 206242-206243, 206245, 206248, 206250-206251, 206254-206261, 206264-206266, 206270, 206272-206276, 206283-206285, 206287-206290, 206295, 206297-206300, 206303-206304, 206307, 206311-206315, 206317-206318, 206321, 206323-206324, 206326, 206328, 206331, 206335-206340, 206343-206344, 206346-206348, 206351, 206354, 206358-206364, 206366-206377, 206379-206382, 206384-206385, 206388-206390, 206392, 206396, 206398-206399, 206401-206403, 206405-206407, 206409-206411, 206413-206419, 206423-206425, 206427-206431, 206435-206436, 206439-206444, 206446-206449, 206451-206452, 206457-206465, 206472, 206475-206476, 206479-206484, 206486-206497, 206500-206507, 206509, 206511-206512, 206514-206521, 206523, 206525-206535, 206537-206539, 206541-206542, 206544-206545, 206547-206548, 206551-206553, 206555-206562, 206564-206569, 206576-206578, 206581, 206584-206585, 206587-206590, 206593, 206598-206612, 206617-206636, 206642, 206645, 206647, 206651-206655, 206657-206658, 206660-206664, 206666-206667, 206669-206671, 206673-206674, 206676-206677, 206680, 206682-206690, 206692, 206694, 206696, 206699, 206701, 206703-206705, 206707-206708, 206710-206715, 206717, 206719-206728, 206732, 206734, 206736-206739, 206741, 206744-206745, 206747, 206749-206750, 206752-206757, 206759, 206761-206762, 206764, 206766-206767, 206769-206770, 206772-206773, 206775-206778, 206783-206789, 206791-206792, 206794-206797, 206799, 206801-206804, 206810-206811, 206813-206815, 206817-206818, 206820-206821, 206823-206826, 206829-206832, 206835-206837, 206841-206844, 206846-206850, 206852-206855, 206857-206862, 206864, 206866-206871, 206873, 206876, 206879-206881, 206883-206884, 206886-206889, 206891, 206893-206894, 206896-206899, 206901-206903, 206905-206909, 206911-206912, 206914-206915, 206917-206922, 206925, 206931, 206935-206936, 206938-206939, 206941, 206944-206951, 206953-206955, 206958-206959, 206961-206962, 206965-206966, 206970, 206973, 206975-206976, 206978, 206980-206981, 206986, 206989-206996, 206999-207000, 207004-207009, 207011-207013, 207015-207016, 207018, 207020-207030, 207032, 207035-207036, 207038, 207040, 207042, 207044-207050, 207055-207058, 207061, 207064-207065, 207067-207069, 207071-207072, 207074-207079, 207081-207082, 207084-207088, 207091-207094, 207096-207099, 207101-207102, 207105, 207107, 207109-207110, 207112-207114, 207116-207122, 207125-207126, 207128-207129, 207131-207138, 207143-207145, 207147-207150, 207152-207164, 207168-207172, 207175-207179, 207182, 207185-207186, 207188-207189, 207200-207201, 207203-207205, 207207, 207209-207210, 207212-207215, 207217, 207220, 207223-207225, 207227, 207229-207233, 207235-207236, 207239-207240, 207242-207247, 207252, 207255, 207258, 207261, 207266, 207269-207278, 207283-207291, 207293, 207295-207296, 207298-207303, 207306-207307, 207309-207312, 207315, 207317, 207319, 207321-207330, 207332-207341, 207343, 207345-207346, 207350-207358, 207360-207361, 207364-207370, 207373, 207377-207380, 207382, 207385, 207387, 207389, 207392-207394, 207396, 207398-207400, 207402-207410, 207412-207413, 207415-207417, 207420, 207423-207424, 207426-207428, 207430, 207432-207434, 207437-207439, 207446-207447, 207449-207453, 207457, 207460-207464, 207467, 207469-207470, 207472-207477, 207479, 207481-207483, 207486-207487, 207489, 207494-207495, 207499, 207503, 207505-207508, 207510-207511, 207515-207516, 207521, 207525-207530, 207532, 207535-207542, 207544-207547, 207550-207551, 207553, 207555, 207560-207561, 207565-207567, 207569, 207574, 207578-207582, 207585, 207588-207592, 207594, 207596, 207599, 207604-207607, 207609-207610, 207612-207614, 207616-207619, 207621-207622, 207624-207628, 207633-207638, 207640, 207642-207644, 207646-207651, 207653-207654, 207656, 207658-207662, 207664-207681, 207683-207690, 207692-207697, 207700-207704, 207706-207709, 207711-207713, 207716-207728, 207730-207733, 207735-207744, 207747, 207749, 207751-207757, 207759-207763, 207765-207773, 207776, 207778-207780, 207782-207788, 207791-207794, 207798-207804, 207806-207809, 207811-207816, 207819-207820, 207823, 207826-207827, 207829, 207832-207836, 207838, 207840-207844, 207846-207849, 207851, 207853-207857, 207859-207861, 207864-207868, 207870, 207873-207876, 207878-207888, 207891, 207894-207895, 207898-207899, 207901-207905, 207907, 207910-207916, 207919, 207921-207924, 207927, 207931, 207933, 207935-207938, 207941-207942, 207944-207945, 207950-207955, 207957-207958, 207961-207965, 207967, 207969, 207971-207973, 207977-207980, 207982, 207984-207986, 207988-207989, 207993-207998, 208001-208003, 208005, 208007, 208009-208010, 208012, 208014-208016, 208018, 208020, 208022-208024, 208026-208029, 208032, 208037-208038, 208041, 208043-208051, 208055-208063, 208066-208070, 208073-208074, 208076-208081, 208083-208086, 208089, 208091-208094, 208096, 208100, 208103-208109, 208112-208117, 208119-208123, 208125-208127, 208129-208130, 208134, 208137-208147, 208150, 208152-208157, 208160-208164, 208166-208167, 208170-208171, 208173-208174, 208176-208179, 208182, 208184-208185, 208187, 208190, 208192, 208195, 208197-208199, 208201-208203, 208205-208206, 208208, 208210-208211, 208213, 208215-208216, 208219-208220, 208224-208226, 208228-208233, 208235-208238, 208241-208243, 208245, 208248, 208250-208257, 208259-208264, 208266-208269, 208271-208272, 208274-208276, 208278, 208280, 208282-208283, 208288-208291, 208294-208296, 208298-208299, 208302-208303, 208305-208323, 208326, 208330-208331, 208333-208335, 208338, 208340-208341, 208343-208349, 208351, 208354, 208357-208358, 208360-208361, 208363-208370, 208373-208376, 208378-208380, 208382-208387, 208390-208395, 208397, 208399, 208403-208404, 208407-208414, 208417-208420, 208422-208425, 208427-208433, 208435-208437, 208442-208444, 208447, 208449-208451, 208453, 208455-208457, 208459-208461, 208465, 208468-208471, 208473-208480, 208483-208486, 208488, 208491-208493, 208495-208497, 208499-208508, 208510, 208515-208516, 208518-208522, 208524, 208527, 208529, 208532-208537, 208540-208546, 208548-208552, 208555-208556, 208558-208559, 208561-208564, 208566, 208570, 208573-208577, 208580, 208582-208583, 208585, 208588, 208591, 208596-208597, 208599-208602, 208605, 208607, 208609, 208612-208627, 208630-208632, 208634, 208638-208640, 208647-208652, 208654-208655, 208657, 208660-208662, 208666-208667, 208669-208670, 208672-208673, 208675-208678, 208680, 208682-208684, 208686-208696, 208700-208702, 208704, 208707, 208711-208712, 208714-208716, 208719, 208723-208731, 208735-208736, 208739-208740, 208746-208747, 208749-208754, 208756-208761, 208763-208764, 208766-208771, 208774-208779, 208781, 208784-208786, 208789-208792, 208794-208796, 208798, 208803, 208806-208810, 208812, 208814-208817, 208820, 208822-208824, 208828-208829, 208832, 208834, 208836, 208838-208845, 208849, 208854-208855, 208857, 208859-208860, 208862-208873, 208875, 208877-208879, 208885-208887, 208889-208896, 208898-208900, 208902-208903, 208905-208907, 208909, 208911, 208914-208916, 208920-208922, 208924-208925, 208927-208929, 208932-208933, 208935-208936, 208941-208942, 208945, 208947, 208949, 208951-208953, 208956, 208959, 208961, 208965, 208967-208969, 208972, 208976-208978, 208983-208984, 208988, 208990, 208992, 208995, 208997, 209001, 209003, 209005-209008, 209010-209011, 209015-209016, 209018, 209021, 209023-209024, 209026, 209030-209031, 209034, 209036-209045, 209047, 209050, 209052-209055, 209057, 209059-209062, 209064, 209066-209068, 209070-209073, 209075, 209080, 209082, 209088-209094, 209096, 209098-209105, 209109, 209113-209114, 209120-209124, 209126, 209129-209135, 209137, 209140, 209142-209153, 209156, 209158-209160, 209162-209163, 209166-209168, 209171-209179, 209182, 209184-209185, 209187, 209190, 209193, 209195, 209198-209199, 209201-209202, 209204-209205, 209207-209208, 209213, 209215-209220, 209222, 209231-209232, 209235, 209238-209242, 209244-209250, 209252-209253, 209257-209258, 209266-209271, 209274, 209276, 209279, 209282, 209285, 209288-209291, 209293-209294, 209296-209302, 209305-209306, 209309-209312, 209314-209322, 209327-209329, 209331-209338, 209340-209342, 209345-209348, 209352, 209355, 209357-209358, 209360-209363, 209365-209372, 209380-209383, 209386-209388, 209390-209391, 209393, 209395, 209403-209404, 209406, 209408, 209412-209414, 209416-209418, 209420, 209423, 209426, 209428, 209430-209431, 209433-209435, 209437-209439, 209441-209442, 209444-209445, 209447-209451, 209453, 209455-209456, 209458-209461, 209463, 209465-209469, 209472-209476, 209478-209480, 209482, 209487, 209490, 209495-209498, 209500-209504, 209506-209507, 209510, 209513, 209515, 209518-209519, 209521, 209523, 209525-209531, 209534-209535, 209537-209539, 209541-209542, 209544-209545, 209547-209549, 209553, 209555-209556, 209558-209561, 209563-209568, 209570-209572, 209574, 209576-209577, 209579-209580, 209587-209588, 209590, 209594-209596, 209598, 209603, 209605, 209607-209612, 209615, 209617-209619, 209621-209623, 209625-209626, 209629-209630, 209632, 209634-209644, 209649-209652, 209654, 209656-209659, 209661-209662, 209666-209672, 209677-209680, 209682, 209684-209686, 209688-209690, 209692, 209695-209697, 209699, 209702-209703, 209705, 209707-209709, 209711, 209713-209714, 209716-209717, 209721, 209723, 209727, 209729-209731, 209733-209740, 209742-209745, 209747-209750, 209752, 209754-209755, 209757-209758, 209761-209766, 209768, 209770-209778, 209780, 209783-209788, 209791-209793, 209796-209798, 209800, 209802-209804, 209807-209816, 209819, 209822-209827, 209829-209832, 209835, 209837-209841, 209843-209847, 209849-209855, 209858-209859, 209862-209864, 209866-209872, 209874-209875, 209877-209878, 209880-209884, 209888, 209890, 209892-209893, 209897-209899, 209901-209903, 209906-209907, 209910-209913, 209915, 209917, 209920-209944, 209946-209949, 209952-209954, 209956-209958, 209961-209962, 209965, 209967-209971, 209973-209976, 209978-209979, 209981, 209983, 209985-209993, 209995-209999, 210001, 210003, 210008-210022, 210024, 210026-210031, 210034-210035, 210038-210039, 210041-210043, 210048-210050, 210052-210054, 210056-210057, 210059-210060, 210062-210069, 210071, 210073, 210077-210080, 210083-210084, 210086, 210088-210092, 210094-210098, 210100, 210102-210106, 210108-210110, 210112-210113, 210115-210119, 210124-210127, 210129, 210131, 210133, 210135, 210137, 210139-210140, 210142-210143, 210145, 210147-210148, 210153-210158, 210160-210161, 210163-210169, 210171-210172, 210179-210183, 210185, 210187-210188, 210190-210198, 210201-210203, 210205-210207, 210209-210210, 210214, 210217, 210219, 210223-210228, 210232-210234, 210238, 210240-210251, 210253-210258, 210261, 210264, 210266-210267, 210269-210272, 210274, 210276-210280, 210283, 210286, 210289, 210293-210297, 210302-210303, 210305, 210307, 210309-210310, 210312-210313, 210315-210319, 210321-210322, 210324-210325, 210327-210335, 210338-210341, 210344-210345, 210347, 210349-210350, 210354, 210356-210363, 210365-210366, 210370, 210373-210375, 210378, 210381-210383, 210387, 210389-210390, 210392, 210394-210396, 210400, 210402-210406, 210408, 210411, 210413-210422, 210424-210426, 210428-210431, 210433, 210435-210438, 210440, 210443, 210445, 210447-210449, 210451, 210453-210455, 210461, 210472, 210474-210477, 210484-210487, 210490-210493, 210495-210498, 210502-210503, 210508, 210510-210515, 210517-210529, 210531, 210533-210534, 210536-210539, 210544-210546, 210548, 210553-210554, 210556, 210558-210559, 210562, 210564, 210567-210571, 210573, 210576-210581, 210583-210589, 210595-210601, 210603, 210605, 210608, 210611-210613, 210615-210619, 210624-210626, 210629, 210631-210632, 210634-210636, 210638-210643, 210645, 210647-210649, 210651-210660, 210662, 210664, 210667-210672, 210674, 210676, 210678-210679, 210681, 210683, 210685-210687, 210689-210694, 210696, 210698, 210701-210702, 210704-210708, 210711, 210713-210714, 210717-210723, 210725-210746, 210748-210755, 210757-210760, 210763-210764, 210766, 210768, 210770, 210772-210778, 210781-210784, 210786, 210788-210793, 210795-210802, 210806-210807, 210809-210819, 210822-210824, 210826-210836, 210838-210839, 210841, 210843-210844, 210846-210847, 210849, 210857-210864, 210867, 210873-210877, 210879-210882, 210888, 210890, 210892, 210894, 210900, 210902-210908, 210913, 210915-210918, 210920, 210923, 210928-210934, 210936-210937, 210939-210941, 210943-210946, 210950, 210954-210959, 210961-210963, 210966, 210968, 210970, 210974, 210976-210977, 210980-210982, 210985, 211000-211001, 211004-211010, 211013, 211015-211020, 211022, 211025-211027, 211030, 211032-211037, 211039-211040, 211042, 211044-211047, 211049-211057, 211059-211065, 211067-211069, 211071, 211077, 211079, 211081-211084, 211086, 211089-211092, 211094, 211096-211097, 211100-211105, 211108-211114, 211117, 211119-211120, 211123-211127, 211129-211130, 211132-211133, 211135-211137, 211139-211142, 211145, 211150-211154, 211156, 211158, 211162, 211164, 211167-211173, 211178-211181, 211183-211188, 211196, 211198-211200, 211203-211204, 211206-211207, 211210-211211, 211213-211215, 211217-211219, 211222-211226, 211229-211232, 211235-211240, 211244, 211246, 211248, 211250, 211252-211270, 211272-211275, 211278-211279, 211282-211295, 211297, 211299-211300, 211302-211303, 211305, 211308, 211310-211313, 211315-211318, 211321-211331, 211333, 211335, 211337, 211339, 211341-211345, 211347, 211349-211360, 211362-211365, 211367-211368, 211370-211376, 211379-211382, 211384, 211386, 211388-211391, 211393-211396, 211398-211399, 211402-211403, 211405-211414, 211416-211427, 211429, 211433-211437, 211439, 211441-211449, 211451-211465, 211471-211474, 211478, 211480-211484, 211486-211487, 211490-211491, 211493-211501, 211504-211506, 211510-211513, 211515-211518, 211520, 211522-211532, 211534-211538, 211540-211544, 211546, 211550, 211552-211553, 211555-211556, 211558-211560, 211562-211565, 211567-211568, 211570, 211572-211574, 211576, 211578, 211582-211590, 211592, 211594-211597, 211600, 211603-211609, 211611, 211613-211616, 211618, 211620-211624, 211626-211628, 211633-211635, 211637, 211639, 211642-211645, 211648-211649, 211651-211652, 211655-211656, 211658, 211660-211676, 211681, 211683-211684, 211686-211688, 211691-211692, 211695-211702, 211704, 211706, 211715-211720, 211722-211723, 211726-211727, 211729, 211731, 211733-211735, 211737-211754, 211757-211768, 211771-211777, 211779-211780, 211783-211790, 211792-211794, 211798-211802, 211804-211806, 211808, 211810, 211812-211819, 211823-211824, 211827-211831, 211836, 211839-211841, 211844, 211847, 211851-211857, 211859-211864, 211866-211867, 211869, 211871, 211874, 211878, 211881, 211885-211886, 211888, 211891-211892, 211894-211896, 211898-211901, 211906-211907, 211909-211915, 211917-211920, 211922, 211924-211928, 211931, 211933-211935, 211937-211939, 211941, 211944-211946, 211948, 211950, 211954-211959, 211961-211966, 211968-211970, 211972, 211974-211975, 211977, 211979, 211981-211982, 211984-211985, 211988-211992, 211994-211995, 211998, 212000-212002, 212004, 212006-212007, 212009-212011, 212015, 212017-212022, 212029-212030, 212033-212041, 212043-212046, 212048-212050, 212052-212062, 212064, 212066-212068, 212070-212072, 212074-212075, 212078, 212080-212081, 212083-212085, 212088-212090, 212092, 212096-212100, 212102-212104, 212107-212108, 212110-212111, 212113-212114, 212116, 212118-212119, 212121-212123, 212125-212130, 212132, 212134-212137, 212141-212142, 212144-212147, 212150-212151, 212153, 212155, 212158-212159, 212162-212163, 212165-212166, 212168-212174, 212177, 212179-212180, 212184-212185, 212195-212199, 212201-212203, 212207-212208, 212210-212211, 212213-212215, 212217-212218, 212221-212223, 212225, 212228-212231, 212233, 212235, 212237, 212243-212244, 212248, 212250-212251, 212253, 212259, 212261-212263, 212265-212266, 212268-212269, 212272, 212274, 212277-212279, 212282-212285, 212287-212288, 212290-212292, 212295-212297, 212299-212305, 212307-212308, 212310-212330, 212332-212335, 212338-212349, 212352-212355, 212359, 212361-212362, 212365-212366, 212368-212374, 212376, 212378-212392, 212394, 212396-212400, 212405-212408, 212413-212430, 212435, 212438-212439, 212442-212448, 212450-212451, 212454, 212456-212459, 212461-212463, 212468-212471, 212473, 212475-212476, 212478, 212480, 212482, 212490, 212492-212498, 212501-212506, 212510, 212512-212519, 212522-212523, 212525-212526, 212529, 212532-212534, 212538, 212541-212542, 212544-212545, 212547-212548, 212550, 212553, 212556-212559, 212562, 212564-212569, 212571-212581, 212583, 212585, 212587-212588, 212590-212591, 212593-212595, 212598, 212600-212604, 212606-212608, 212611, 212613, 212615-212619, 212624-212635, 212637-212639, 212644-212645, 212649, 212652, 212655, 212657-212658, 212660, 212663, 212668, 212671, 212673, 212676-212677, 212679-212683, 212689-212693, 212695, 212699, 212701-212702, 212704-212706, 212708-212723, 212726, 212728, 212730, 212733, 212737, 212740-212745, 212748, 212750-212751, 212753-212755, 212758-212759, 212761-212763, 212765-212773, 212777, 212780-212781, 212784, 212792-212793, 212796, 212798-212803, 212805-212806, 212809-212815, 212817, 212822-212823, 212825, 212827, 212832-212834, 212840-212842, 212844-212846, 212850-212852, 212855, 212859-212860, 212862-212867, 212874-212875, 212878, 212880, 212885, 212887, 212890, 212897, 212901-212903, 212910, 212914, 212919, 212921-212927, 212935, 212937-212944, 212947, 212950, 212957, 212960-212961, 212963, 212970, 212972, 212976, 212980, 212986-212993, 212995-212998, 213000-213004, 213016-213023, 213027-213028, 213030-213032, 213034-213043, 213045-213049, 213051-213052, 213055-213056, 213059-213060, 213062, 213064, 213066, 213068, 213070-213072, 213074-213079, 213081-213082, 213085-213097, 213100, 213102, 213105, 213107-213116, 213118-213121, 213123, 213126, 213129, 213131-213132, 213134-213135, 213137-213143, 213146, 213153-213158, 213160-213166, 213169-213171, 213174-213175, 213177-213183, 213185-213186, 213188, 213190, 213192, 213197-213203, 213206-213209, 213211-213212, 213214-213215, 213218-213220, 213222-213223, 213225-213231, 213233, 213235, 213238-213239, 213242, 213246-213255, 213258-213262, 213264-213268, 213270-213271, 213273-213276, 213278-213282, 213284-213285, 213287-213288, 213291-213292, 213295, 213297, 213299-213304, 213306-213309, 213311, 213313-213319, 213321-213323, 213326-213337, 213339, 213343-213346, 213348-213354, 213356-213357, 213362-213365, 213367-213372, 213374-213380, 213382, 213384, 213386-213387, 213393, 213395-213398, 213402-213403, 213405, 213408, 213410-213412, 213415-213416, 213419, 213421-213422, 213424-213426, 213429-213432, 213435, 213437-213438, 213440, 213442, 213444-213445, 213447, 213451-213453, 213457-213461, 213463-213465, 213468-213473, 213476-213479, 213482, 213484, 213486-213487, 213489-213490, 213494-213496, 213498, 213501-213503, 213505, 213507-213508, 213512-213515, 213517-213518, 213521, 213524-213528, 213530-213542, 213544-213550, 213552-213557, 213559, 213564-213566, 213568, 213571-213576, 213583-213584, 213586-213588, 213590-213594, 213597-213598, 213601, 213604, 213606, 213609-213610, 213612, 213614-213617, 213621-213622, 213625-213626, 213628-213629, 213632-213634, 213636-213639, 213643-213644, 213648, 213650-213654, 213657-213658, 213665, 213667, 213669-213671, 213673-213674, 213676-213678, 213680-213681, 213683-213685, 213687-213689, 213692, 213695-213698, 213701, 213704, 213706, 213712, 213716-213718, 213721-213732, 213739-213745, 213747, 213749-213755, 213757-

213760, 213765-213767, 213769, 213772-213773, 213776-213778, 213780-213786, 213788-213789, 213791-213795, 213797-213798, 213800-213810, 213812, 213814, 213816-213818, 213822-213825, 213827, 213831-213832, 213836-213837, 213840, 213842-213853, 213855-213858, 213860, 213862-213863, 213866-213868, 213870-213871, 213873, 213875-213876, 213879-213880, 213882-213884, 213886, 213888-213890, 213892-213893, 213896-213898, 213900-213904, 213906, 213909-213918, 213920-213922, 213925-213930, 213933, 213937, 213940-213946, 213948-213960, 213962, 213964, 213967-213970, 213972, 213974, 213976, 213979-213981, 213983-213987, 213989, 213991-213997, 214003, 214006-214007, 214009, 214012-214015, 214019-214021, 214023-214027, 214030-214031, 214034-214039, 214041-214044, 214047-214050, 214053-214054, 214057, 214060, 214062-214064, 214067-214068, 214070-214088, 214091, 214094, 214097, 214099, 214101, 214104, 214107-214109, 214112, 214115-214116, 214118-214124, 214127, 214129, 214131-214132, 214134, 214137-214139, 214141, 214143, 214145-214148, 214150, 214153, 214157, 214160-214161, 214163-214166, 214168-214170, 214172-214176, 214178, 214180-214181, 214183-214187, 214190-214191, 214197, 214199-214201, 214204, 214206-214208, 214210-214212, 214214-214215, 214217, 214219-214222, 214225-214240, 214246-214249, 214251-214252, 214254, 214260-214261, 214264-214272, 214274-214278, 214281, 214283-214284, 214287-214289, 214291-214297, 214299-214300, 214302, 214304-214306, 214308-214310, 214313-214316, 214319-214320, 214322-214323, 214325, 214328, 214330, 214333-214334, 214336, 214338-214344, 214346, 214350-214353, 214355, 214359-214361, 214366-214368, 214371-214372, 214374, 214376, 214378, 214381-214385, 214389-214391, 214394, 214398, 214402, 214404-214406, 214408-214409, 214411, 214413, 214415-214419, 214421-214422, 214426-214428, 214431-214432, 214434-214435, 214438, 214442, 214444, 214447, 214452, 214457, 214459, 214462-214463, 214466-214471, 214473-214474, 214477, 214479, 214481-214482, 214484-214487, 214489-214493, 214495-214499, 214502-214503, 214505, 214508-214516, 214519, 214521-214523, 214525-214526, 214529-214533, 214535, 214539-214543, 214546-214549, 214552-214553, 214555, 214558-214562, 214564-214566, 214569, 214572, 214574, 214576-214577, 214580, 214582-214583, 214586-214587, 214593-214595, 214599-214600, 214602-214605, 214607, 214609-214610, 214612-214615, 214618, 214621-214623, 214625, 214627-214628, 214631, 214634-214636, 214638, 214640-214641, 214646-214653, 214655-214664, 214666-214668, 214670, 214672-214674, 214676-214677, 214681-214685, 214687, 214691, 214694-214695, 214697, 214699, 214701, 214703-214704, 214709-214714, 214716-214718, 214720-214721, 214723-214724, 214726-214727, 214733, 214735-214736, 214739, 214741-214745, 214749, 214751-214754, 214756-214760, 214763-214764, 214766-214769, 214771-214775, 214779, 214781-214789, 214791, 214793-214796, 214798, 214800, 214802-214803, 214805, 214807-214816, 214819-214821, 214823, 214827, 214829-214832, 214834, 214836-214837, 214840-214842, 214844, 214848-214849, 214851-214858, 214860-214864, 214866-214870, 214873, 214876-214878, 214882-214886, 214888-214890, 214892-214893, 214896, 214900-214904, 214906-214908, 214910-214920, 214924, 214926, 214929-214930, 214935, 214938, 214940-214942, 214945-214951, 214953-214958, 214960, 214962, 214966, 214968, 214971, 214976, 214980-214982, 214984-214987, 214989, 214991-214995, 214997-215002, 215004-215005, 215007, 215010, 215013, 215019-215020, 215022-215024, 215028-215029, 215032, 215036-215037, 215041, 215045, 215049-215056, 215058-215063, 215066-215072, 215074, 215076, 215078-215079, 215081, 215084-215092, 215097, 215100, 215102-215106, 215111, 215113, 215115, 215118, 215122-215123, 215125, 215127, 215130-215131, 215133, 215135-215141, 215143, 215145, 215147-215148, 215150-215157, 215159-215163, 215165-215168, 215170-215171, 215179, 215182-215184, 215186-215188, 215190-215193, 215195-215197, 215199-215201, 215203-215206, 215208-215213, 215220, 215222-215225, 215227-215238, 215240, 215242-215247, 215251-215252, 215254-215258, 215261-215262, 215264, 215267-215269, 215271-215276, 215278, 215280, 215282-215284, 215286, 215288, 215290, 215294-215297, 215299, 215304-215306, 215309-215311, 215313-215314, 215316, 215321-215322, 215324, 215328, 215330-215332, 215337-215340, 215343-215344, 215346-215349, 215351, 215356-215357, 215360, 215362-215370, 215372-215373, 215375-215377, 215381-215388, 215390-215392, 215394, 215396-215398, 215401, 215403-215410, 215412-215416, 215419-215420, 215422-215426, 215428-215434, 215436, 215439, 215441, 215444-215447, 215449, 215451, 215454-215456, 215460-215463, 215465-215469, 215473, 215475-215480, 215484-215485, 215487-215488, 215491-215495, 215497-215502, 215504-215508, 215511-215512, 215514-215519, 215522-215523, 215527, 215529, 215531-215533, 215535-215541, 215543, 215545-215552, 215554, 215556, 215561, 215563, 215565-215566, 215568, 215570-215573, 215575-215577, 215579-215580, 215582-215587, 215589, 215592-215594, 215599-215600, 215602-215603, 215606, 215609-215610, 215612-215613, 215615-215616, 215618-215619, 215623, 215626-215627, 215629-215630, 215635-215639, 215641, 215645-215646, 215648-215652, 215654-215656, 215658, 215660-215661, 215665-215668, 215670-215676, 215678, 215681, 215683, 215685-215687, 215690-215692, 215694-215695, 215697-215699, 215701, 215703, 215705-215713, 215715-215717, 215720-215723, 215725-215728, 215730-215732, 215734, 215739, 215741-215742, 215744-215746, 215748-215749, 215753, 215760-215766, 215769-215770, 215772, 215775-215778, 215780-215787, 215789-215792, 215794, 215800-215801, 215805, 215807-215808, 215810, 215813-215814, 215816, 215822-215823, 215825, 215829-215831, 215835-215836, 215839-215840, 215842, 215846, 215848-215849, 215851, 215853, 215855, 215857-215858, 215863-215868, 215871-215873, 215875, 215877-215879, 215881, 215883-215886, 215892-215893, 215897-215903, 215905, 215909-215910, 215913, 215916, 215918, 215920, 215925-215927, 215931-215932, 215934-215935, 215943-215948, 215950, 215952, 215955-215956, 215958-215959, 215961-215967, 215970-215971, 215973, 215978-215981, 215984, 215986, 215988-215991, 215994, 215996-215998, 216000-216001, 216004-216006, 216008-216014, 216017-216020, 216022-216026, 216028-216031, 216033-216045, 216048, 216050-216052, 216055-216057, 216059, 216063-216064, 216066, 216068-216073, 216078, 216081, 216083, 216085, 216087-216090, 216092, 216096, 216098, 216101-216102, 216105-216106, 216108-216109, 216112, 216114-216115, 216117, 216120-216121, 216125, 216127-216129, 216135-216137, 216139-216142, 216146, 216149, 216151-216152, 216154-216155, 216157, 216161, 216164, 216170, 216172, 216174-216175, 216179, 216183-216184, 216186-216188, 216191, 216195-216200, 216202-216203, 216210, 216212-216213, 216215-216217, 216221-216222, 216224-216226, 216228-216229, 216231-216233, 216239-216242, 216244-216245, 216248-216249, 216253-216263, 216265-216274, 216279-216281, 216283-216288, 216291-216299, 216301, 216305, 216307-216313, 216316, 216319, 216323, 216325-216326, 216329-216330, 216336-216339, 216343-216344, 216346, 216349, 216351-216356, 216358-216359, 216364, 216366, 216368-216369, 216374-216377, 216379-216389, 216391, 216395-216399, 216402-216403, 216406-216407, 216411-216412, 216414, 216416-216424, 216426-216427, 216431-216433, 216435-216439, 216442-216446, 216449-216454, 216456, 216458-216467, 216470, 216473-216474, 216476-216481, 216483, 216485-216486, 216488-216491, 216493-216496, 216498-216499, 216501-216503, 216505, 216507-216508, 216512, 216515, 216518, 216520, 216526, 216528, 216531-216535, 216538-216543, 216546, 216549-216556, 216558-216559, 216561, 216565-216566, 216568, 216570-216571, 216573-216576, 216578, 216580, 216583, 216585, 216587-216593, 216596-216597, 216601-216605, 216610-216612, 216614-216619, 216622-216626, 216629, 216631, 216633-216636, 216639-216641, 216645-216646, 216648-216652, 216654-216655, 216658-216660, 216662-216663, 216665-216674, 216677-216683, 216685-216689, 216691-216700, 216703-216706, 216710-216714, 216716, 216718-216726, 216728, 216730, 216732, 216734, 216736, 216738-216739, 216741-216743, 216745-216746, 216749, 216751-216752, 216754-216758, 216764, 216767-216769, 216771, 216773, 216775, 216779, 216783-216787, 216789, 216791-216793, 216798-216799, 216803-216805, 216807-216809, 216813-216816, 216818-216819, 216822, 216824-216825, 216828, 216831-216833, 216835-216836, 216838-216839, 216843-216844, 216846-216849, 216851, 216853, 216856-216858, 216861, 216863-216865, 216870, 216872-216874, 216876-216877, 216879-216883, 216887-216891, 216893-216894, 216896-216906, 216908, 216911-216915, 216918-216920, 216922-216923, 216926, 216929, 216932, 216937, 216939-216942, 216944, 216950-216955, 216958-216961, 216963, 216965, 216968-216972, 216974, 216976-216978, 216980-216983, 216985-216987, 216989-216993, 216995, 216999-217001, 217003-217004, 217006, 217009-217010, 217012-217013, 217015, 217017, 217022-217026, 217028-217032, 217034-217035, 217037, 217039-217040, 217042, 217045-217049, 217051, 217053-217054, 217057-217063, 217065-217066, 217068-217070, 217073, 217076, 217080, 217082-217085, 217089, 217091, 217093, 217099-217102, 217104-217107, 217109, 217111-217117, 217119-217121, 217124-217127, 217130-217133, 217136, 217138, 217141-217142, 217145, 217147, 217149-217153, 217155-217159, 217161-217168, 217170-217171, 217173-217182, 217192-217193, 217196, 217198, 217201, 217203, 217205-217208, 217211-217212, 217215, 217217, 217219, 217221, 217223-217225, 217229, 217231-217239, 217241-217245, 217247, 217249, 217253-217254, 217256, 217261, 217263-217264, 217266-217268, 217270, 217272-217282, 217284, 217288, 217291-217297, 217299-217304, 217307, 217309-217313, 217315-217317, 217319, 217322, 217327-217336, 217338-217342, 217346-217352, 217354, 217356-217357, 217359, 217361, 217363-217369, 217371-217373, 217377, 217379-217384, 217387-217388, 217390-217392, 217394-217396, 217398-217399, 217401-217408, 217410, 217412, 217414-217415, 217417, 217419, 217421-217425, 217428-217430, 217432-217437, 217439, 217441-217442, 217444-217448, 217452-217456, 217458-217469, 217471-217473, 217475-217479, 217481-217482, 217484-217485, 217487-217488, 217492, 217494-217500, 217502, 217505-217506, 217509, 217512-217518, 217521-217527, 217529-217531, 217533-217535, 217537, 217539-217540, 217543, 217545-217547, 217551, 217554-217555, 217557, 217559-217561, 217566, 217570, 217576-217577, 217579-217585, 217587-217590, 217592-217593, 217595-217596, 217601-217611, 217613, 217616-217618, 217620-217621, 217623, 217626, 217631, 217633, 217635-217636, 217641-217645, 217647-217651, 217653-217658, 217660-217661, 217663, 217665-217666, 217670-217673, 217677, 217679-217680, 217683-217692, 217694, 217697-217705, 217707-217710, 217712-217714, 217716, 217725, 217731-217737, 217739, 217741-217744, 217746-217747, 217749, 217753, 217758, 217761-217762, 217765-217767, 217769-217771, 217773-217777, 217782, 217784, 217786-217790, 217792-217799, 217803, 217806-217809, 217811-217812, 217817-217820, 217822-217826, 217830-217832, 217834-217836, 217839-217841, 217845-217846, 217849, 217853, 217856-217857, 217859-217860, 217862-217867, 217872-217885, 217888, 217891, 217894-217899, 217901, 217904-217906, 217909, 217911-217914, 217917-217920, 217922, 217924-217926, 217929-217931, 217933, 217937-217938, 217940-217945, 217947, 217949, 217955-217970, 217972-217973, 217975, 217977, 217981-217982, 217984-217985, 217989-217991, 217994-217995, 217998, 218001, 218004, 218007, 218009-218010, 218012, 218014, 218016, 218018, 218021, 218023-218027, 218029-218030, 218032, 218034-218036, 218039, 218041-218044, 218046-218047, 218049, 218051-218052, 218055, 218058, 218060, 218062-218065, 218068, 218070-218075, 218077-218078, 218087, 218090, 218095-218099, 218101-218107, 218111-218112, 218114, 218116, 218122-218124, 218128, 218130-218136, 218138-218139, 218142-218145, 218148-218151, 218153, 218155-218157, 218159-218161, 218163, 218165-218168, 218171, 218173-218174, 218176-218179, 218182-218188, 218190-218197, 218205, 218207-218208, 218214-218217, 218219, 218223, 218225-218226, 218228, 218230, 218233-218234, 218239-218241, 218243-218251, 218253, 218255, 218257, 218261, 218264-218267, 218269-218272, 218274-218275, 218277-

218280, 218282-218283, 218286-218288, 218290, 218293, 218296-218302, 218304-218306, 218308, 218310-218311, 218314-218317, 218320-218322, 218325-218328, 218331-218332, 218334-218335, 218338-218340, 218345, 218347, 218350-218352, 218355-218357, 218361-218362, 218364, 218366-218367, 218369-218372, 218374, 218376-218377, 218380-218382, 218384, 218386-218390, 218392, 218396, 218401, 218403, 218405, 218409-218413, 218415-218418, 218422-218424, 218427-218429, 218431-218433, 218435-218436, 218438, 218440-218441, 218444-218446, 218448-218450, 218455, 218458-218463, 218465-218468, 218470-218471, 218473-218474, 218477, 218479, 218481, 218483, 218485-218489, 218492, 218494-218496, 218499-218501, 218503-218504, 218506-218508, 218510, 218512-218515, 218517, 218520, 218523, 218525-218533, 218536-218537, 218539-218540, 218543, 218547-218553, 218557, 218559-218561, 218565-218566, 218569-218570, 218572, 218574-218575, 218577-218589, 218591, 218593-218594, 218596, 218598-218600, 218602, 218605, 218607, 218611-218615, 218617, 218619, 218621-218622, 218625-218626, 218628-218633, 218636, 218638-218639, 218641, 218643, 218645, 218648-218649, 218651, 218653-218658, 218660, 218662-218666, 218668-218669, 218673-218677, 218679, 218681-218686, 218688-218690, 218695, 218698-218700, 218702, 218705, 218707, 218709-218710, 218712, 218714-218716, 218718, 218723-218726, 218728-218729, 218731-218733, 218736-218741, 218744-218745, 218747, 218750-218754, 218756-218758, 218760, 218762-218763, 218765-218768, 218772-218776, 218780, 218782-218786, 218788-218791, 218793-218799, 218801-218802, 218804, 218806-218810, 218812, 218814-218815, 218817, 218819-218821, 218823, 218825-218826, 218832-218833, 218835, 218837-218838, 218840-218843, 218845-218848, 218851, 218853-218855, 218857-218858, 218863-218871, 218873-218876, 218880-218881, 218884, 218890, 218892, 218894, 218896-218898, 218900, 218902-218904, 218906, 218908-218909, 218911-218912, 218915-218916, 218918, 218920-218921, 218923, 218927, 218929, 218931, 218937-218938, 218940-218941, 218947-218948, 218951, 218954-218955, 218960, 218964-218968, 218970, 218972, 218974-218975, 218978, 218980, 218982-218987, 218990, 218993, 218998, 219006, 219008, 219012-219013, 219015-219016, 219020-219029, 219031-219035, 219040, 219043, 219045-219048, 219056-219057, 219059-219064, 219067-219071, 219073-219077, 219079, 219081, 219083-219085, 219089-219090, 219092, 219094, 219096-219098, 219103, 219105, 219108, 219111-219112, 219115, 219117-219120, 219122-219127, 219130, 219133, 219135-219140, 219142-219145, 219148, 219154-219156, 219158, 219166, 219168-219170, 219173-219177, 219180-219181, 219188, 219190, 219192-219214, 219217, 219221, 219223-219224, 219226, 219228, 219231-219232, 219235-219236, 219239-219240, 219242, 219245-219246, 219248-219255, 219257-219262, 219264-219265, 219267, 219269, 219272-219273, 219275-219281, 219283, 219285-219286, 219288-219293, 219297, 219301, 219305-219306, 219308-219314, 219318, 219321-219322, 219324-219326, 219328-219330, 219332-219334, 219336, 219338, 219341, 219344-219353, 219355-219357, 219359-219365, 219368-219372, 219375-219377, 219379-219380, 219386, 219388-219392, 219395-219399, 219401-219402, 219405, 219407-219418, 219420-219422, 219424, 219426-219428, 219430, 219432, 219434-219437, 219441, 219445, 219448-219449, 219451-219452, 219454, 219456-219457, 219460-219467, 219469, 219473-219475, 219477, 219479-219480, 219482-219485, 219489, 219491-219492, 219494-219500, 219503-219504, 219506, 219508, 219513, 219516-219517, 219522-219523, 219525-219532, 219534-219539, 219541, 219544, 219549, 219554, 219556, 219560-219562, 219564-219572, 219575, 219581-219586, 219592-219596, 219602-219603, 219605-219606, 219610-219611, 219614-219621, 219623, 219625, 219627, 219632, 219634-219636, 219638-219639, 219641-219644, 219648-219650, 219652-219659, 219664-219670, 219672, 219676-219681, 219684-219687, 219689-219690, 219692, 219694-219695, 219698, 219700, 219703, 219705-219708, 219711-219712, 219715-219717, 219719-219724, 219726, 219728, 219730-219732, 219734-219744, 219747-219748, 219754-219756, 219759-219763, 219765-219769, 219771-219772, 219775-219777, 219779, 219782, 219785-219787, 219789, 219791, 219793-219795, 219798-219799, 219802-219805, 219807, 219809-219812, 219814, 219819-219824, 219829-219835, 219837-219840, 219842-219844, 219846, 219848-219852, 219856-219860, 219862-219867, 219870-219871, 219873-219886, 219889, 219891-219893, 219895, 219897, 219899-219900, 219903-219912, 219914-219917, 219920-219922, 219924-219926, 219928, 219930-219932, 219935-219938, 219940-219941, 219943-219948, 219951-219953, 219955-219957, 219959, 219961-219963, 219965-219969, 219971-219980, 219983, 219985-219988, 219990-219991, 219994, 219996, 219998-220001, 220003, 220007, 220009-220010, 220012, 220014, 220016, 220018, 220020-220030, 220034, 220036-220038, 220040-220041, 220043, 220046, 220049-220057, 220059, 220061-220064, 220066-220073, 220075-220078, 220080-220088, 220090-220092, 220094-220097, 220101, 220103, 220105-220106, 220108-220112, 220114-220121, 220123-220131, 220133-220136, 220138-220144, 220146, 220148-220150, 220152, 220154-220155, 220157-220161, 220164-220169, 220172, 220175, 220177, 220180-220184, 220186-220198, 220200-220201, 220203-220205, 220209-220212, 220214-220220, 220222, 220224, 220226-220235, 220237-220239, 220241-220248, 220250-220251, 220253-220254, 220256-220258, 220262-220263, 220266-220268, 220270, 220273, 220276-220282, 220284-220285, 220287, 220290-220294, 220297-220298, 220300-220304, 220309-220310, 220312, 220316, 220318, 220321-220325, 220327-220328, 220330-220331, 220333, 220336-220339, 220341, 220343-220347, 220349-220356, 220358, 220360, 220362-220367, 220369-220373, 220376-220377, 220380-220385, 220387-220392, 220394, 220396-220401, 220403-220405, 220407, 220410-220414, 220416-220417, 220425, 220427-220432, 220435-220436, 220438-220442, 220444-220445, 220447-220452, 220456, 220458-220462, 220464-220467, 220469-220470, 220474-220477, 220479, 220482-220488, 220490-220491, 220493, 220495-220496, 220498, 220500-220502, 220504, 220507-220521, 220523, 220525-220526, 220530, 220532, 220534, 220536-220541, 220544, 220547-220549, 220551-220555, 220557-220566, 220569-220573, 220575-220576, 220578-220581, 220583-220598, 220600-220602, 220604-220608, 220610, 220612-220614, 220616-220619, 220622-220623, 220625, 220628-220631, 220633-220634, 220638, 220640-220646, 220649-220652, 220654, 220657-220663, 220666-220667, 220670, 220672-220673, 220676-220678, 220682-220684, 220686, 220690, 220698, 220702-220703, 220705-220706, 220708-220711, 220714, 220720-220721, 220725, 220728-220731, 220734, 220738-220742, 220745-220748, 220750, 220752-220753, 220755-220756, 220758-220771, 220774, 220777, 220779, 220782, 220784-220785, 220788-220790, 220793, 220796-220798, 220801, 220804-220809, 220812-220813, 220816-220820, 220823-220824, 220826, 220829-220831, 220833-220834, 220837, 220843-220844, 220848-220849, 220855, 220858, 220862-220863, 220867, 220870, 220872, 220874-220877, 220879, 220881-220883, 220885, 220887-220888, 220891, 220893-220898, 220900, 220903, 220906, 220908, 220910-220911, 220914-220915, 220922-220925, 220929-220932, 220934-220937, 220939-220943, 220945-220946, 220948-220949, 220951-220952, 220954-220957, 220959-220960, 220964-220965, 220968-220970, 220972-220973, 220975-220976, 220978-220981, 220983, 220985-220991, 220993-220999, 221001-221005, 221008, 221011-221013, 221016, 221018-221021, 221023, 221029-221035, 221037-221042, 221044-221046, 221050-221051, 221053-221054, 221057, 221060, 221067-221071, 221073-221080, 221082, 221084, 221088-221089, 221091, 221093, 221096, 221098-221099, 221101, 221104, 221106-221107, 221109-221112, 221114-221128, 221130-221133, 221135-221136, 221138-221142, 221148-221149, 221152-221153, 221155-221156, 221160-221162, 221164-221169, 221172, 221174-221175, 221177-221180, 221184-221189, 221191, 221193-221194, 221196, 221199-221201, 221203-221207, 221209-221210, 221215, 221218, 221222, 221224, 221227-221228, 221230, 221232-221234, 221236-221239, 221241, 221243-221246, 221249-221250, 221252-221255, 221257, 221260-221262, 221264-221269, 221272-221276, 221278, 221281-221288, 221290-221292, 221295-221296, 221298, 221301-221302, 221304-221305, 221307-221314, 221316-221317, 221319-221322, 221325-221326, 221328-221331, 221333, 221336, 221339-221341, 221344, 221346-221347, 221349-221353, 221355, 221359-221361, 221361-221369, 221371-221372, 221374, 221376-221381, 221385-221393, 221395, 221398-221399, 221402, 221404, 221406, 221409-221414, 221416-221423, 221426-221427, 221429-221434, 221436-221443, 221445, 221447-221449, 221451-221453, 221455-221456, 221458-221461, 221463-221465, 221467, 221471, 221474, 221477, 221479-221485, 221487-221491, 221496-221498, 221500-221503, 221505, 221510, 221517, 221519-221523, 221525-221531, 221536-221542, 221544, 221547, 221552, 221557-221559, 221561, 221568-221570, 221572, 221576, 221579-221582, 221584, 221586, 221588-221591, 221593-221596, 221598-221605, 221607-221610, 221613, 221619-221620, 221622-221624, 221626-221627, 221630-221631, 221633, 221635-221636, 221639, 221641, 221643-221650, 221652-221654, 221656-221657, 221660, 221662, 221664-221670, 221672-221673, 221675-221679, 221681, 221684-221690, 221692, 221694, 221697-221698, 221700, 221705-221706, 221708-221709, 221711, 221713-221719, 221721, 221723, 221729-221737, 221739, 221741-221747, 221749-221758, 221760-221767, 221770-221773, 221775, 221778-221779, 221786-221789, 221792, 221796, 221800-221801, 221803, 221805, 221808-221810, 221812, 221814-221816, 221818-221820, 221822-221823, 221826-221827, 221831-221833, 221836-221838, 221841, 221844-221847, 221851, 221854, 221858-221859, 221861-221863, 221866-221870, 221872, 221875, 221881, 221885-221887, 221889, 221891-221893, 221898-221906, 221908, 221911-221912, 221914, 221916-221920, 221923, 221926, 221928-221930, 221936-221937, 221940-221941, 221944, 221947, 221950-221951, 221953, 221956, 221960, 221962-221964, 221968, 221970, 221972, 221975-221978, 221980, 221984-221987, 221991-221992, 221994-221998, 222002, 222006-222008, 222012-222014, 222016, 222019, 222021-222028, 222030-222031, 222033, 222044, 222047-222048, 222050, 222054-222056, 222067-222068, 222071, 222073-222075, 222081, 222084, 222086, 222088, 222091-222094, 222096-222097, 222099-222100, 222102, 222105, 222107-222108, 222110-222111, 222113-222115, 222118-222120, 222122-222123, 222125-222128, 222130-222133, 222135-222136, 222138, 222142, 222147-222148, 222150-222152, 222154-222156, 222159-222161, 222163, 222165, 222167-222169, 222171, 222173-222175, 222178-222184, 222186-222192, 222194-222198, 222201-222202, 222204-222205, 222207-222208, 222211-222219, 222221-222223, 222225, 222230, 222233, 222236-222240, 222242-222252, 222254-222255, 222259-222260, 222263-222272, 222274-222279, 222281-222295, 222297-222299, 222301-222303, 222305-222314, 222316-222320, 222322-222324, 222326, 222330, 222333, 222337, 222340-222341, 222346-222347, 222349-222354, 222357-222358, 222360-222361, 222365, 222368, 222370-222371, 222373-222376, 222378-222382, 222384-222387, 222391, 222393-222394, 222397-222398, 222404, 222406, 222409-222415, 222421-222422, 222424, 222429-222434, 222436-222437, 222439, 222443-222444, 222446, 222453, 222456-222466, 222468-222469, 222476-222490, 222492-222493, 222495-222497, 222503-222504, 222506-222511, 222513, 222515-222520, 222523, 222525-222527, 222530-222531, 222533, 222535, 222537-222538, 222542, 222544, 222546-222549, 222553, 222557-222558, 222561-222566, 222568-222573, 222575, 222578-222582, 222584-222585, 222587, 222589-222591, 222593, 222596-222598, 222603, 222613-222614, 222618-222620, 222622, 222624-222625, 222627-222628, 222631, 222633-222636, 222638-222639, 222641-222642, 222644-222647, 222651-222652, 222654-222657, 222659-222661, 222663, 222665-222667, 222669-222670, 222674, 222677-222679, 222681, 222683-222684, 222686, 222688, 222690-222696, 222700-222701, 222703, 222705, 222707-222708, 222712-222723, 222727, 222730, 222732, 222735-222736, 222738-222741, 222743-222745, 222749-222752, 222754-222757, 222759, 222764-222765, 222771-222772, 222779-222780, 222783, 222786, 222789, 222792-222793, 222796, 222802, 222805-222808, 222811, 222813, 222816, 222818-222823, 222825, 222827-222828, 222832-222833, 222835-222836, 222840-222848, 222853-222860, 222863-222864, 222866-222868, 222870-222871, 222873-222881, 222884-222887, 222889-222890, 222893-222894, 222896-222901, 222903, 222908-222910, 222912, 222914-222915, 222917-222918, 222927-222928, 222930, 222932-222933, 222935-222936, 222940, 222944-222945, 222947-222951, 222953-222954, 222957-222959, 222961-222962, 222966-222968, 222974-222975, 222977, 222979, 222983-222987, 222990-222994, 222997-222998, 223000-223002, 223004, 223007, 223009-223010, 223013, 223016, 223027-223028, 223030-223033, 223035-223036, 223038, 223043, 223048, 223050, 223052-223053, 223055-223056, 223058-223059, 223061-223071, 223076, 223078, 223082, 223087-223092, 223095-223097, 223099, 223102-223107, 223109-223110, 223116, 223118-223119, 223123, 223126-223127, 223131-223133, 223137-223146, 223148-223152, 223154, 223158, 223161-223162, 223167, 223169-223173, 223175, 223177, 223179-223183, 223185-223186, 223189-223197, 223199-223204, 223207-223210, 223212-223213, 223215-223216, 223218-223221, 223226-223232, 223234-223239, 223242-223244, 223246, 223251, 223253-223254, 223256-223257, 223259-223260, 223262-223264, 223266-223268, 223272-223277, 223281-223283, 223287-223289, 223291, 223293-223295, 223298-223300, 223302-223303, 223305-223306, 223308, 223310-223312, 223314-223315, 223317, 223319-223320, 223322, 223324-223329, 223333-223334, 223337-223338, 223342, 223350-223351, 223354-223355, 223357-223361, 223363, 223365, 223367-223377, 223381, 223384-223385, 223389, 223401-223403, 223406-223407, 223409, 223411, 223417, 223419, 223421-223424, 223432-223433, 223436-223439, 223443-223449, 223451, 223453-223456, 223458, 223462-223464, 223467-223475, 223478, 223484-223486, 223489-223492, 223498, 223502-223504, 223506-223507, 223509, 223511-223513, 223515-223522, 223524, 223528-223540, 223544, 223547-223548, 223550-223551, 223553-223556, 223558-223562, 223564-223565, 223567-223568, 223571, 223573-223575, 223578-223579, 223581-223583, 223585, 223587-223590, 223594, 223598, 223600-223603, 223606, 223608, 223610-223617, 223619, 223621-223622, 223625, 223627-223630, 223632-223633, 223637-223638, 223640-223643, 223646, 223648-223652, 223655-223656, 223659-223662, 223664-223665, 223667-223687, 223691, 223695-223700, 223702-223706, 223708-223710, 223712, 223714, 223718-223720, 223724-223729, 223731-223732, 223734-223738, 223740, 223742-223745, 223747-223748, 223750-223763, 223767-223768, 223770, 223772, 223775-223776, 223778-223779, 223782, 223784-223789, 223791, 223794, 223798, 223800, 223802-223803, 223805-223807, 223809, 223811-223813, 223815, 223817, 223819-223820, 223823-223825, 223827, 223829-223831, 223833, 223835-223839, 223844, 223852, 223854-223857, 223859-223865, 223867-223871, 223873-223874, 223876-223877, 223879-223880, 223883, 223885, 223888, 223892-223894, 223896-223897, 223900-223902, 223904-223907, 223910, 223912-223916, 223918-223924, 223926, 223933-223936, 223939, 223941-223949, 223952, 223954-223955, 223957-223960, 223962-223963, 223965-223969, 223972-223973, 223975, 223977, 223979-223980, 223982, 223985-223989, 223991, 223993, 223995-223996, 223998-224005, 224007-224008, 224010-224013, 224015, 224018-224019, 224022-224026, 224028, 224030-224031, 224033-224036, 224038, 224042, 224044-224051, 224054, 224056-224060, 224062-224063, 224065-224068, 224073-224074, 224076, 224078-224084, 224086, 224090-224091, 224096-224110, 224114-224120, 224122, 224124-224130, 224134, 224136-224138, 224140-224141, 224143-224144, 224148-224150, 224152, 224154-224156, 224158-224162, 224168-224169, 224171-224174, 224176-224177, 224179-224181, 224186, 224189, 224191, 224197, 224200, 224203-224205, 224207-224209, 224213-224215, 224220-224224, 224226, 224231, 224235, 224239-224240, 224244-224246, 224248-224253, 224255, 224257, 224259-224263, 224265-224267, 224269, 224271, 224276-224277, 224280-224282, 224284-224286, 224289-224291, 224294-224295, 224297-224301, 224303-224306, 224308, 224310-224312, 224317-224321, 224323, 224326-224329, 224332-224338, 224340-224343, 224345-224349, 224351-224355, 224357-224360, 224364-224367, 224369-224375, 224381, 224384-224386, 224388-224390, 224392-224394, 224396, 224400-224402, 224409, 224413-224417, 224420-224423, 224426, 224428-224431, 224433, 224435-224438, 224440-224441, 224444, 224446-224449, 224452-224454, 224456-224462, 224464, 224467, 224469-224473, 224475, 224478-224479, 224481-224482, 224484, 224486-224491, 224493, 224497, 224500-224501, 224503, 224506, 224509-224511, 224513-224523, 224525-224526, 224528-224529, 224531, 224535, 224537-224538, 224540-224542, 224544-224556, 224558, 224561-224563, 224566-224572, 224575-224577, 224580-224581, 224583-224592, 224594-224595, 224597-224601, 224603-224607, 224609, 224611, 224613, 224615-224618, 224626-224627, 224629-224631, 224634-224638, 224640, 224645-224651, 224653-224658, 224661-224663, 224665-224666, 224668, 224670, 224672-224679, 224681-224684, 224686, 224688-224689, 224691-224702, 224704, 224706-224712, 224716-224717, 224719-224722, 224725-224730, 224732-224733, 224735-224737, 224741-224745, 224747-224750, 224752, 224754, 224761-224762, 224764-224771, 224773, 224775-224781, 224783, 224787, 224790-224802, 224804-224810, 224812-224813, 224815-224816, 224818-224826, 224829-224830, 224833-224838, 224841, 224844-224845, 224851-224859, 224861-224862, 224865-224866, 224868, 224870, 224872-224876, 224879-224888, 224891, 224893, 224895-224896, 224898, 224902, 224905-224906, 224908-224919, 224921, 224924-224928, 224931-224932, 224935-224937, 224939-224946, 224949-224950, 224952, 224955, 224957, 224959, 224961, 224963-224964, 224966-224968, 224972-224974, 224978-224987, 224989-225000, 225002, 225004-225008, 225010-225012, 225015, 225017, 225020-225028, 225030-225032, 225034-225036, 225038, 225043-225048, 225050-225052, 225054-225058, 225060-225063, 225065, 225067-225069, 225072-225073, 225076-225077, 225079, 225081-225083, 225085, 225087, 225089, 225091-225092, 225096-225101, 225103-225105, 225107, 225110-225112, 225114, 225116-225118, 225120-225126, 225129, 225131, 225133-225141, 225143-225144, 225148-

225154, 225157-225158, 225160-225169, 225173-225175, 225177-225178, 225181, 225184-225185, 225187-225191, 225193-225197, 225200-225201, 225204, 225207, 225210, 225212-225214, 225218, 225223-225236, 225238-225239, 225242-225243, 225245-225247, 225258-225260, 225262, 225264-225268, 225270-225273, 225275-225277, 225279-225281, 225283, 225285, 225287, 225293-225295, 225297, 225299-225301, 225304-225306, 225308, 225310-225311, 225313, 225316-225317, 225320, 225322-225324, 225326-225331, 225334, 225338-225339, 225342, 225344-225349, 225353, 225355-225362, 225367, 225369-225375, 225377-225382, 225384-225389, 225391-225392, 225394-225397, 225399, 225403-225413, 225415, 225419-225421, 225423-225424, 225427-225431, 225434-225437, 225440-225442, 225444-225446, 225449-225455, 225457-225463, 225466-225468, 225470-225471, 225474-225477, 225479-225488, 225490-225491, 225494-225495, 225497-225499, 225502-225503, 225505-225510, 225513-225516, 225521, 225523-225526, 225528-225529, 225534-225536, 225538-225539, 225543-225546, 225548, 225550-225551, 225553-225554, 225556, 225558-225559, 225561-225565, 225567-225569, 225572-225577, 225579-225590, 225594, 225597-225599, 225602, 225604-225606, 225609-225612, 225618-225620, 225623-225626, 225628-225629, 225631-225633, 225636-225641, 225643-225649, 225652-225653, 225655-225656, 225662-225665, 225667, 225669, 225671, 225673-225676, 225679-225682, 225684, 225689-225692, 225694-225701, 225704, 225706, 225708-225710, 225712, 225714-225717, 225720, 225722-225724, 225726-225727, 225731-225734, 225736-225740, 225742, 225745-225746, 225748-225750, 225752-225753, 225757, 225761, 225764, 225766-225775, 225777-225781, 225783, 225789-225790, 225792-225794, 225797-225806, 225808, 225811-225813, 225815, 225818-225821, 225824, 225826-225827, 225829-225830, 225832-225836, 225838-225839, 225841-225854, 225857-225859, 225861-225862, 225864, 225867, 225869, 225871-225872, 225874-225878, 225881, 225884-225889, 225894-225897, 225899-225901, 225903-225906, 225910-225911, 225914-225925, 225931, 225935-225936, 225939, 225942-225943, 225945-225949, 225951-225953, 225955-225960, 225962, 225964, 225966-225967, 225969, 225971-225976, 225978-225990, 225992-225997, 226000-226009, 226011-226016, 226018-226032, 226035-226036, 226045-226057, 226059-226060, 226062, 226064-226067, 226071, 226073-226076, 226078-226097, 226099, 226101-226106, 226109-226115, 226117, 226119, 226121-226122, 226124-226130, 226132, 226134-226138, 226141-226144, 226146, 226148, 226150, 226153, 226155-226157, 226159-226161, 226163-226164, 226166-226167, 226169-226173, 226175, 226177, 226181-226183, 226186-226187, 226189, 226191-226203, 226206, 226209-226214, 226216-226220, 226222-226225, 226228-226232, 226234-226236, 226239-226244, 226247-226248, 226250, 226252, 226255-226258, 226260, 226262-226265, 226267-226270, 226272, 226274-226276, 226278-226282, 226284, 226286-226287, 226289, 226291-226292, 226295-226300, 226302-226304, 226306-226309, 226311-226312, 226314-226317, 226322-226326, 226329-226341, 226343-226347, 226349-226351, 226353, 226355-226365, 226367-226372, 226374-226375, 226377-226381, 226383, 226386-226391, 226393-226396, 226398-226399, 226401, 226403-226406, 226409-226411, 226413-226417, 226419, 226421, 226423-226436, 226438, 226441-226444, 226446-226448, 226451-226454, 226456, 226458-226461, 226463-226465, 226467-226469, 226472, 226474-226479, 226481, 226483-226494, 226496-226499, 226501-226502, 226504-226505, 226507, 226509-226522, 226525-226530, 226533, 226535-226537, 226540-226544, 226546, 226550-226553, 226555, 226557-226559, 226561-226564, 226566, 226568, 226573-226576, 226582-226585, 226587-226598, 226600, 226602, 226605, 226608-226618, 226620-226621, 226627-226636, 226639-226643, 226645-226647, 226649-226650, 226653, 226656-226668, 226671-226673, 226675-226682, 226684-226686, 226688, 226691-226692, 226694, 226698, 226700-226705, 226707-226710, 226712, 226714-226715, 226717-226724, 226726-226728, 226730-226731, 226734, 226737-226744, 226746-226750, 226752, 226754-226756, 226758-226766, 226769, 226772-226773, 226775, 226778, 226780-226782, 226785-226792, 226794-226800, 226807-226809, 226812, 226814-226824, 226826, 226828-226830, 226833, 226836, 226840-226847, 226850, 226853-226858, 226861-226863, 226865-226872, 226874-226876, 226880, 226882, 226885-226888, 226891-226893, 226896-226897, 226899, 226901, 226903, 226905, 226908-226910, 226912, 226914, 226917-226918, 226920, 226922, 226925-226928, 226930, 226933-226942, 226944, 226947-226949, 226951, 226953-226954, 226956, 226958-226959, 226961-226962, 226968-226973, 226977, 226982-226983, 226988-226992, 226997, 227000-227003, 227005-227006, 227008-227014, 227017, 227019-227020, 227022, 227027, 227030-227036, 227038, 227040, 227043, 227046, 227049-227050, 227052-227056, 227060-227063, 227065-227068, 227070, 227072, 227074, 227076-227079, 227081-227085, 227087, 227093, 227096, 227099-227102, 227104-227106, 227111-227112, 227114-227119, 227121, 227124, 227132-227134, 227137, 227140, 227142, 227145-227146, 227148-227152, 227155-227156, 227160-227163, 227167-227168, 227170-227174, 227178-227179, 227182, 227185-227188, 227190-227191, 227193, 227198, 227200, 227203, 227207-227208, 227210, 227213-227216, 227218, 227220, 227222-227226, 227228-227230, 227232-227234, 227237-227245, 227249-227250, 227256, 227258-227261, 227264-227266, 227268-227270, 227272, 227274-227277, 227279-227281, 227284, 227286, 227288-227298, 227301-227302, 227305, 227308-227311, 227315, 227317, 227319, 227321, 227323, 227325, 227327, 227329-227331, 227333, 227335, 227337-227341, 227343, 227345-227353, 227355, 227358-227359, 227361-227368, 227371, 227373-227376, 227379-227382, 227384, 227386-227387, 227389, 227391, 227393, 227396-227401, 227406-227409, 227413, 227415, 227417-227419, 227422, 227425-227426, 227428, 227430-227432, 227434-227435, 227437-227439, 227441-227442, 227444-227446, 227450-227451, 227454, 227456-227457, 227459-227460, 227464-227469, 227472-227476, 227480, 227482-227483, 227485, 227487-227490, 227493-227495, 227497-227498, 227500, 227502, 227504-227510, 227513-227516, 227521-227523, 227525-

227527, 227529-227531, 227535, 227538-227540, 227543-227544, 227547-227549, 227551-227552, 227554, 227556-227557, 227561, 227566-227567, 227569, 227572-227574, 227576, 227578-227581, 227583, 227585-227586, 227590, 227592-227593, 227595, 227598-227601, 227606-227607, 227609-227621, 227623-227626, 227628, 227630-227635, 227637-227641, 227644, 227646-227649, 227651-227663, 227665-227666, 227668-227669, 227671-227672, 227674-227675, 227677, 227681-227684, 227686-227688, 227691-227692, 227694, 227696, 227700-227702, 227706-227709, 227711, 227714-227717, 227719, 227721-227724, 227728, 227731, 227735-227736, 227738-227740, 227744-227745, 227747, 227749, 227751-227752, 227754-227755, 227757, 227759-227762, 227764, 227766-227770, 227772, 227775, 227778, 227781-227782, 227784, 227786-227788, 227790-227798, 227801-227804, 227807-227808, 227814, 227816-227819, 227821-227834, 227839-227840, 227842, 227844-227851, 227853-227854, 227858-227865, 227869-227874, 227876, 227881-227882, 227884-227885, 227889-227894, 227897-227905, 227909-227910, 227913-227917, 227920-227921, 227924-227926, 227928-227929, 227932-227934, 227936, 227938-227939, 227941, 227943-227945, 227951, 227953, 227955-227957, 227959, 227961-227963, 227966-227967, 227969, 227972-227975, 227978-227982, 227984, 227987-227988, 227990-227994, 227996-227999, 228001, 228011-228012, 228014, 228023, 228025, 228027-228029, 228033-228034, 228037-228038, 228040-228048, 228050, 228052-228055, 228057-228060, 228062-228073, 228076-228080, 228082, 228084-228085, 228091, 228093-228095, 228099-228100, 228102-228115, 228117, 228120, 228125-228127, 228131-228133, 228135, 228137-228147, 228149, 228152-228154, 228156-228162, 228164-228167, 228170-228174, 228176, 228178, 228182-228184, 228186, 228188-228194, 228196-228198, 228200-228201, 228203-228204, 228206-228208, 228210-228215, 228217-228219, 228221-228226, 228228, 228230-228231, 228233-228234, 228236, 228239, 228246-228250, 228252-228253, 228263-228267, 228270, 228272-228276, 228278-228279, 228281-228283, 228285-228296, 228301-228302, 228308, 228310-228312, 228314, 228320, 228322-228326, 228328, 228330-228333, 228335, 228337, 228339, 228342, 228345-228347, 228354-228360, 228362-228364, 228367-228371, 228374-228379, 228381-228383, 228385-228387, 228391, 228394, 228397-228398, 228401, 228406, 228408, 228413-228417, 228424-228425, 228427, 228429, 228436-228439, 228444-228445, 228447, 228449, 228451, 228454-228456, 228459-228461, 228463-228466, 228468-228469, 228471-228473, 228475-228476, 228478, 228480, 228483-228484, 228486-228488, 228490, 228492, 228494-228499, 228501, 228504, 228506, 228510-228511, 228513-228515, 228518, 228520, 228523-228526, 228529, 228531, 228533-228535, 228542, 228544, 228548, 228550-228554, 228556, 228558, 228563, 228565-228572, 228574-228575, 228578, 228584, 228587, 228590-228591, 228593, 228595-228597, 228603, 228607, 228610-228613, 228617-228619, 228621-228622, 228624-228625, 228627-228628, 228630, 228633-228634, 228636-228637, 228639, 228641, 228643-228644, 228646, 228648-228654, 228656, 228658, 228662-228664, 228667-228674, 228677, 228680, 228684-228685, 228688, 228691-228696, 228698-228699, 228703, 228705, 228709, 228711, 228715-228716, 228718-228719, 228723-228724, 228729, 228732, 228734-228736, 228738-228739, 228741-228748, 228750-228751, 228756-228761, 228763, 228765, 228767-228769, 228772-228774, 228776, 228779-228783, 228788-228789, 228791-228794, 228796-228801, 228806, 228809-228812, 228815-228816, 228818, 228820, 228822-228824, 228826-228829, 228831, 228833, 228835-228836, 228839-228845, 228847, 228850-228851, 228857, 228859-228861, 228863, 228865-228869, 228872-228879, 228881-228888, 228890-228895, 228898, 228901, 228903-228905, 228907-228908, 228910-228911, 228913-228914, 228916-228917, 228919, 228921, 228923-228926, 228928-228934, 228936, 228938-228941, 228946, 228948, 228950-228951, 228953, 228956, 228958-228960, 228962-228964, 228968-228972, 228974-228978, 228980-228985, 228988, 228990, 228992, 228994-228998, 229000-229004, 229006-229012, 229015, 229019, 229022-229024, 229026-229027, 229029, 229034-229036, 229038-229039, 229042-229043, 229045-229046, 229048, 229050-229055, 229057, 229059-229060, 229062, 229064-229066, 229068, 229070-229072, 229075-229076, 229079, 229082-229083, 229085, 229087-229091, 229093-229094, 229096, 229099, 229101, 229103-229109, 229111-229112, 229114-229115, 229121, 229124, 229127, 229130-229133, 229135, 229141-229146, 229148, 229150, 229152, 229154-229155, 229157-229160, 229164-229166, 229169-229175, 229177-229182, 229184-229187, 229190, 229194, 229196-229204, 229206, 229208, 229210, 229214-229215, 229219-229221, 229224-229226, 229229-229231, 229233, 229236-229237, 229239-229247, 229250-229254, 229257, 229259, 229262-229277, 229279-229280, 229283-229286, 229288-229289, 229292-229293, 229295, 229297-229303, 229305, 229312, 229314-229316, 229318-229319, 229321-229325, 229327, 229332-229334, 229336, 229339, 229343-229347, 229349, 229351, 229356-229358, 229362-229363, 229365-229366, 229368-229371, 229373-229376, 229380-229381, 229383-229385, 229387, 229389-229390, 229392, 229394, 229397-229400, 229402-229403, 229405, 229407-229409, 229413-229422, 229425-229430, 229433, 229435-229436, 229438-229439, 229441-229442, 229445-229454, 229456-229457, 229459-229460, 229463-229471, 229473-229474, 229476-229479, 229481-229482, 229484-229485, 229488, 229490-229491, 229496-229499, 229501-229506, 229508, 229510, 229512-229522, 229524-229527, 229529, 229531-229532, 229534-229536, 229538, 229540-229541, 229544, 229547, 229549-229554, 229556, 229558-229559, 229561-229564, 229566, 229568-229569, 229571, 229573-229574, 229576-229584, 229586-229589, 229591-229592, 229594-229595, 229598-229602, 229604, 229608, 229610-229612, 229614-229616, 229618, 229620, 229628-229637, 229639-229640, 229642-229643, 229645-229657, 229660-229666, 229668-229674, 229677-229681, 229683-229684, 229686-229689, 229691, 229694-229695, 229699-229701, 229703-229707, 229709-229712, 229716-229720, 229722-229729, 229731-229734, 229736-229737, 229739, 229742, 229744, 229747, 229749-229750, 229752-229753, 229755-229759, 229761-229762, 229765-229772, 229774-229775, 229777, 229780, 229783-229784, 229787, 229790-229791, 229795-229804, 229806, 229809, 229811-229812, 229816, 229818, 229820, 229822, 229824-229827, 229829, 229834, 229840-229842, 229844-229845, 229847, 229849-229854, 229856-229858, 229860-229862, 229864-229865, 229867-229869, 229872-229874, 229876, 229879-229880, 229882-229895, 229897-229900, 229902, 229904-229905, 229908-229912, 229914-229917, 229919-229924, 229926-229927, 229929-229945, 229949, 229952-229955, 229958-229962, 229964, 229967-229968, 229970-229971, 229973-229974, 229979, 229982, 229984-229986, 229988-229993, 229997-229999, 230003-230011, 230014-230017, 230020-230021, 230027, 230029, 230031-230032, 230034-230036, 230038, 230040, 230043-230045, 230047-230048, 230051-230052, 230054-230063, 230067, 230070-230071, 230074-230078, 230080, 230083-230084, 230086-230091, 230093, 230095-230096, 230099-230100, 230104-230107, 230109-230110, 230112, 230116-230118, 230121, 230123, 230125, 230127-230130, 230132-230136, 230140-230142, 230144-230148, 230151-230152, 230154, 230156, 230160-230163, 230165-230168, 230171-230174, 230176-230184, 230187, 230190-230192, 230195-230197, 230199, 230201-230204, 230206, 230209-230210, 230212-230213, 230215, 230220-230223, 230225-230226, 230228-230230, 230232, 230236-230240, 230242, 230244-230245, 230247-230255, 230257-230259, 230266-230267, 230269-230270, 230273-230275, 230279, 230282-230283, 230288, 230290-230291, 230293-230296, 230298-230302, 230304-230305, 230311, 230318-230319, 230322-230327, 230330, 230333-230334, 230337, 230344-230345, 230348-230352, 230355-230356, 230361-230369, 230371, 230373, 230375, 230377, 230386, 230388, 230391-230394, 230401-230407, 230409-230410, 230412, 230414-230416, 230418-230423, 230425, 230427-230432, 230435, 230438-230448, 230455-230457, 230459, 230461-230465, 230471, 230473-230474, 230476-230477, 230479, 230481-230482, 230488-230491, 230493-230494, 230496-230499, 230502-230503, 230505-230511, 230513, 230516-230517, 230519-230522, 230525, 230527, 230530-230533, 230539, 230543-230545, 230547, 230549-230556, 230558-230561, 230564-230565, 230570, 230573, 230577, 230580, 230582-230586, 230589, 230594, 230596-230601, 230603-230604, 230608, 230611-230612, 230615, 230618, 230621-230625, 230627, 230629, 230631, 230636, 230639, 230642-230644, 230647, 230649, 230655, 230657-230658, 230660, 230662-230667, 230669, 230672-230676, 230679, 230681, 230684, 230688-230689, 230692, 230696-230697, 230699, 230701-230705, 230707, 230709-230710, 230712-230716, 230718-230724, 230726-230727, 230729-230730, 230732, 230734, 230736-230738, 230741, 230744-230747, 230750-230752, 230754-230755, 230758-230759, 230761-230764, 230766-230769, 230771-230773, 230778-230782, 230784-230792, 230795, 230797-230800, 230803-230816, 230819, 230823, 230825, 230827, 230833, 230836-230837, 230839-230840, 230842-230845, 230847-230848, 230850-230853, 230856-230857, 230859-230860, 230862, 230864-230866, 230868-230869, 230871-230876, 230878-230884, 230886-230890, 230893, 230896, 230899-230901, 230903-230907, 230909-230910, 230914, 230917-230921, 230923-230924, 230926-230931, 230933-230934, 230936, 230940-230944, 230946-230953, 230955-230962, 230964, 230966, 230968, 230975-230977, 230979-230985, 230992-230994, 230996, 230998-231001, 231003-231005, 231007-231008, 231011, 231013-231014, 231016-231018, 231020-231024, 231026-231028, 231030, 231032-231033, 231035-231040, 231042-231043, 231045, 231047, 231049-231051, 231054-231057, 231060, 231062, 231069-231076, 231083-231087, 231089-231090, 231093, 231098-231103, 231105-231109, 231111, 231113-231116, 231118, 231120, 231122, 231124-231125, 231127-231129, 231133-231134, 231136-231139, 231143-231147, 231150, 231152-231162, 231164, 231166-231168, 231170, 231173-231181, 231183, 231185, 231187, 231189, 231192-231197, 231199-231201, 231203, 231205, 231208-231210, 231212-231216, 231219-231224, 231226-231228, 231230-231231, 231233-231238, 231240-231249, 231252-231253, 231256-231259, 231262, 231264, 231267-231269, 231271-231272, 231274-231279, 231281-231283, 231285, 231288, 231290-231295, 231297, 231300-231302, 231304-231305, 231307, 231310-231312, 231314-231315, 231317-231320, 231329-231331, 231334-231341, 231343-231346, 231348-231354, 231356-231359, 231361-231364, 231367, 231374, 231379-231382, 231386-231389, 231394, 231396, 231399-231400, 231403-231407, 231409-231413, 231415-231417, 231419, 231421, 231423, 231425-231426, 231429-231430, 231432-231433, 231437-231444, 231446, 231448-231452, 231454, 231456-231465, 231468-231469, 231471-231472, 231474, 231476-231479, 231481-231482, 231484-231486, 231488, 231490-231491, 231494, 231497-231505, 231508-231509, 231511-231513, 231515-231519, 231522-231523, 231527-231528, 231530-231533, 231539-231540, 231543-231544, 231549-231552, 231554-231557, 231560-231561, 231563-231569, 231572-231573, 231576-231584, 231586-231602, 231604-231606, 231608-231610, 231612-231620, 231622, 231624, 231626-231627, 231629-231633, 231635-231646, 231649-231660, 231663-231664, 231666-231668, 231671, 231674, 231678, 231680, 231682-231684, 231686-231689, 231694-231696, 231698, 231700, 231703, 231705-231708, 231711-231712, 231714, 231716, 231718-231722, 231725-231734, 231738, 231741-231742, 231746-231747, 231749-231753, 231755-231760, 231763-231765, 231768-231769, 231773-231778, 231780-231790, 231792, 231795, 231799, 231801-231805, 231808-231809, 231811-231812, 231816-231819, 231821, 231823-231825, 231827, 231829-231830, 231834, 231837-231838, 231840-231850, 231853-231855, 231859-231860, 231863-231864, 231866-231869, 231871, 231873-231875, 231877-231878, 231880-231881, 231884-231898, 231900-231901, 231903, 231905-231907, 231909-231914, 231917-231918, 231920-231932, 231934-231952, 231955-231956, 231958-231959, 231961-231962, 231965, 231967-231968, 231970-231974, 231976, 231978-231979, 231982-231986, 231989-231990, 231992-232000, 232002-232003, 232005, 232007, 232009-232014, 232016-232018, 232020-232030, 232032-232034, 232039-232056, 232058-232067, 232069, 232071-232075, 232079-232081, 232083-232087, 232089-232091, 232095-232099, 232102-

232107, 232109-232111, 232114, 232116-232117, 232119-232121, 232126-232128, 232130-232133, 232135, 232137, 232140-232143, 232151-232156, 232158-232161, 232163, 232165-232166, 232170-232173, 232177-232178, 232180, 232182-232184, 232186-232187, 232190, 232192-232193, 232196-232197, 232200-232201, 232204-232208, 232210-232211, 232213-232214, 232216, 232218, 232221, 232223, 232227-232235, 232237-232239, 232241, 232244-232252, 232254, 232256, 232258, 232260, 232267-232268, 232270-232272, 232274-232278, 232280-232283, 232286, 232289-232295, 232297-232299, 232303-232305, 232307-232309, 232311-232312, 232314-232322, 232324-232325, 232328-232330, 232332, 232336, 232338-232339, 232341, 232344-232348, 232350, 232353-232355, 232360, 232365, 232369-232371, 232375-232379, 232383, 232385-232387, 232389-232391, 232393-232399, 232403, 232405-232406, 232408, 232410, 232416-232421, 232423-232428, 232430-232432, 232434-232436, 232438, 232441-232442, 232444, 232448-232451, 232456-232460, 232462-232464, 232466-232467, 232471, 232474, 232476-232480, 232482-232484, 232486-232494, 232496-232499, 232501-232502, 232504, 232506, 232508-232511, 232514-232516, 232518-232522, 232527-232530, 232533-232538, 232540, 232542, 232548-232549, 232551-232552, 232555, 232557-232571, 232573, 232575-232576, 232578, 232581, 232583, 232585-232587, 232589-232591, 232594, 232596, 232598-232599, 232601, 232604-232610, 232612-232616, 232618-232624, 232627-232631, 232633-232634, 232637, 232639, 232641, 232643-232647, 232651-232652, 232654-232657, 232659-232663, 232665-232668, 232670-232675, 232677, 232679, 232682, 232684-232691, 232693-232694, 232696-232703, 232705-232706, 232709-232721, 232723-232729, 232733-232734, 232737-232740, 232742, 232745-232746, 232748, 232750, 232752-232753, 232756-232757, 232759, 232761, 232763-232764, 232766-232769, 232773-232775, 232777-232780, 232783-232789, 232792, 232795-232803, 232808, 232810-232811, 232816-232818, 232821, 232824-232826, 232834-232835, 232837-232842, 232844, 232849-232850, 232852, 232855, 232858, 232860, 232865-232873, 232875-232876, 232882-232884, 232887-232888, 232890-232891, 232895-232896, 232899-232901, 232903, 232906, 232908-232922, 232924-232927, 232929, 232931, 232933-232934, 232936, 232939, 232941, 232943, 232946-232949, 232954-232959, 232961-232967, 232969-232972, 232975-232979, 232981-232982, 232985, 232987-232988, 232990, 232992-232993, 232995, 232997-233006, 233008-233009, 233013, 233018, 233020, 233022-233030, 233032, 233034, 233036, 233038-233039, 233043-233046, 233050-233064, 233067-233073, 233075-233077, 233082-233083, 233088-233089, 233092-233095, 233098, 233100-233101, 233104-233105, 233110-233112, 233114-233115, 233117, 233119-233120, 233122-233140, 233142, 233145-233149, 233153-233156, 233161-233164, 233166-233169, 233171, 233175-233178, 233180-233181, 233183, 233186, 233188-233190, 233193-233197, 233199, 233201-233203, 233205-233206, 233208, 233210-233211, 233213, 233215-233217, 233219, 233221-233222, 233225-233226, 233228, 233233, 233235-233236, 233241, 233243, 233245-233248, 233250-233251, 233255, 233257, 233263-233265, 233269, 233273-233274, 233278, 233280, 233283, 233286-233287, 233289, 233291, 233293, 233297, 233300, 233303, 233308-233309, 233311-233315, 233320-233321, 233325, 233327-233334, 233337, 233342, 233344, 233346, 233349, 233352-233354, 233357-233361, 233363, 233367, 233369, 233371-233373, 233376-233381, 233383-233385, 233387, 233389, 233392-233393, 233395, 233397-233399, 233402, 233404, 233406-233407, 233410-233411, 233413-233415, 233417, 233420-233421, 233423, 233427, 233430, 233432-233433, 233436-233437, 233441, 233443-233445, 233449-233450, 233452-233453, 233455-233458, 233466, 233468, 233470-233471, 233475-233476, 233478-233481, 233483-233487, 233489-233491, 233493-233495, 233497, 233499-233500, 233503-233509, 233512-233515, 233517-233524, 233527-233528, 233533-233534, 233536, 233540, 233542-233543, 233545, 233547-233548, 233550-233554, 233556-233558, 233560, 233562-233563, 233566-233568, 233570-233571, 233574-233577, 233579, 233582-233586, 233590, 233592, 233595-233607, 233611, 233615, 233617-233623, 233628-233630, 233632-233640, 233643, 233645-233646, 233648-233649, 233651-233653, 233655-233656, 233658-233665, 233668, 233670, 233672-233675, 233677, 233679-233681, 233683-233685, 233687-233690, 233692-233693, 233695-233698, 233701, 233704, 233708, 233713-233718, 233720, 233723, 233725-233726, 233728-233729, 233731-233733, 233736-233740, 233744-233745, 233747, 233749-233750, 233752, 233755-233757, 233759, 233761-233764, 233766-233767, 233769-233771, 233773-233774, 233777, 233780-233782, 233784, 233786-233787, 233789, 233791-233793, 233795-233798, 233802-233805, 233807-233809, 233811-233812, 233814, 233816, 233818-233822, 233825-233828, 233837-233838, 233840, 233842, 233844-233845, 233849, 233852-233861, 233863-233864, 233867-233873, 233878-233884, 233888, 233890-233892, 233894, 233897-233901, 233903-233912, 233914-233918, 233920-233921, 233924, 233930, 233932-233939, 233941-233943, 233949-233951, 233955-233959, 233961-233962, 233966-233968, 233970-233971, 233974, 233978, 233982-233984, 233986, 233989, 233991-233993, 233995, 233997, 234002, 234005-234006, 234009, 234012-234014, 234017, 234024-234025, 234027-234031, 234034-234035, 234037-234041, 234043-234045, 234047-234049, 234051, 234053, 234056, 234058-234059, 234063-234065, 234067, 234069-234071, 234074-234079, 234081-234083, 234085-234087, 234090, 234094, 234097, 234099, 234101-234103, 234112, 234115, 234117-234120, 234124-234125, 234127, 234132-234140, 234143-234144, 234146, 234148, 234150, 234152, 234156-234160, 234162, 234164-234168, 234170, 234174, 234178-234182, 234184, 234186, 234192, 234195, 234197, 234199, 234201, 234203-234212, 234214, 234218-234220, 234225-234228, 234232-234234, 234244-234250, 234252-234257, 234259, 234262, 234264, 234267, 234269, 234272-234274, 234276-234287, 234289, 234293-234297, 234300-234301, 234303-234304, 234306-234307, 234309, 234312-234314, 234317-234320, 234322-234324, 234327-234328, 234331-234332, 234334-234337, 234339, 234341, 234343-234344, 234346-234349, 234351, 234353-234354, 234356, 234358, 234360, 234362, 234364-234376, 234378-234382, 234384-234386, 234388, 234394-234399, 234401-234403, 234405, 234407-234412, 234416-234423, 234425-234431, 234433, 234435, 234439, 234441-234442, 234444-234446, 234448, 234451, 234454, 234456-234457, 234459-234460, 234462-234463, 234465, 234468-234472, 234476, 234480-234482, 234484-234485, 234489-234492, 234494, 234496-234503, 234505-234508, 234510-234512, 234514, 234516-234518, 234521-234524, 234529, 234531-234532, 234534-234536, 234540, 234544-234545, 234550-234554, 234558-234559, 234561-234563, 234565-234567, 234569-234571, 234575-234588, 234590, 234592-234596, 234598, 234600-234602, 234604-234605, 234607-234609, 234611-234614, 234617-234619, 234621, 234623, 234625-234628, 234630-234632, 234635, 234637, 234640, 234642, 234644-234646, 234648-234653, 234655-234658, 234662-234666, 234669-234671, 234673-234674, 234676-234677, 234679, 234681, 234683-234685, 234688-234690, 234692-234693, 234695, 234698-234702, 234705-234708, 234710-234712, 234715-234717, 234721, 234723, 234725-234726, 234731-234738, 234741-234744, 234749-234751, 234757, 234760, 234762-234767, 234769, 234771, 234773-234775, 234777-234778, 234785, 234787, 234789-234792, 234795-234799, 234801-234807, 234809, 234813-234814, 234816, 234819, 234821, 234823-234825, 234827-234830, 234834-234844, 234846, 234848, 234850, 234852-234855, 234857, 234859-234861, 234863, 234866, 234868-234869, 234871-234872, 234874-234888, 234891-234893, 234895-234897, 234899, 234903-234909, 234911-234912, 234914-234916, 234919-234921, 234923-234926, 234928, 234930-234931, 234934, 234936, 234939-234941, 234945-234949, 234955-234957, 234961-234962, 234965-234968, 234970-234980, 234982-234993, 234995-234996, 234998-235000, 235003-235006, 235008-235010, 235012-235016, 235018, 235021, 235023, 235025-235028, 235033-235034, 235036-235046, 235048-235052, 235055-235058, 235060-235061, 235063-235066, 235069-235077, 235079, 235081, 235084-235085, 235087-235091, 235094-235095, 235099, 235105-235106, 235108-235113, 235115-235116, 235118-235123, 235125-235129, 235131-235132, 235134, 235137-235142, 235145-235146, 235148-235149, 235151-235153, 235155-235156, 235158-235159, 235161-235170, 235173-235177, 235179-235183, 235185-235187, 235189-235191, 235193-235195, 235197, 235199-235200, 235207-235209, 235211, 235214-235216, 235218, 235220, 235222, 235224, 235226, 235228, 235230-235231, 235234-235236, 235238-235240, 235242, 235244-235261, 235264, 235266, 235274, 235276-235287, 235289, 235291, 235295, 235297-235298, 235300, 235302, 235304-235307, 235309-235313, 235315, 235317, 235319-235321, 235323-235324, 235327, 235329-235330, 235332-235333, 235335-235336, 235338-235340, 235342-235345, 235347-235359, 235361-235362, 235364-235365, 235367, 235369-235380, 235382-235385, 235391-235393, 235397, 235399-235403, 235406-235410, 235413-235417, 235420, 235422-235424, 235426-235427, 235429, 235431, 235433-235434, 235437, 235440, 235443-235448, 235450-235451, 235453, 235456-235460, 235462, 235464, 235470, 235473, 235475, 235482, 235486-235487, 235490, 235492-235499, 235503-235504, 235508, 235512-235513, 235517-235519, 235522-235524, 235526-235532, 235534-235537, 235540-235545, 235547-235549, 235552-235556, 235560-235569, 235571, 235574, 235578, 235580-235583, 235586-235588, 235590-235592, 235594, 235596-235603, 235605-235607, 235609-235610, 235612-235615, 235617, 235620, 235623-235629, 235631, 235633, 235635, 235637-235647, 235649-235656, 235659-235661, 235663-235674, 235676-235677, 235679, 235681-235686, 235688-235691, 235693-235702, 235707, 235709-235715, 235717-235718, 235720, 235722-235724, 235727-235728, 235730-235731, 235735, 235737-235738, 235741-235745, 235747-235750, 235752-235755, 235758-235759, 235761-235764, 235766-235769, 235772-235774, 235776-235778, 235781-235782, 235784, 235786-235788, 235790-235795, 235797, 235800, 235802-235803, 235805, 235807-235813, 235815-235820, 235824-235835, 235837, 235839, 235849-235853, 235856-235862, 235865, 235868-235869, 235871-235876, 235879-235887, 235891-235894, 235897-235906, 235913-235914, 235916, 235920-235923, 235926-235927, 235929-235939, 235942-235943, 235945-235947, 235952, 235954, 235956-235957, 235959, 235963-235965, 235969, 235975, 235978-235986, 235988-235989, 235991, 235995, 235997-235998, 236000-236002, 236004-236005, 236010-236012, 236014, 236016, 236019-236025, 236027, 236029, 236032-236035, 236038-236041, 236043, 236045-236047, 236050, 236053-236054, 236057-236058, 236062-236066, 236069-236070, 236072-236082, 236085, 236087-236089, 236095-236102, 236104, 236106-236108, 236110-236114, 236117, 236119-236126, 236129-236130, 236132-236134, 236136-236139, 236141, 236144-236145, 236148, 236151-236159, 236161, 236165, 236167-236172, 236177, 236179-236186, 236188, 236190-236192, 236194-236196, 236198-236211, 236213-236221, 236223-236227, 236230, 236233-236238, 236240-236242, 236244-236245, 236248, 236250-236252, 236254, 236256-236270, 236272-236274, 236276-236279, 236283-236288, 236290-236293, 236296-236301, 236303, 236305-236310, 236312, 236314-236316, 236318-236321, 236323-236325, 236327, 236330-236331, 236334-236336, 236338, 236341-236342, 236345, 236347, 236349-236352, 236355, 236361, 236363-236366, 236368, 236370-236380, 236383-236385, 236387, 236389, 236392, 236395-236396, 236399-236403, 236406-236410, 236412-236413, 236415-236418, 236420-236423, 236425-236429, 236431-236434, 236438-236443, 236445-236448, 236450, 236453, 236455, 236460, 236462, 236465-236466, 236469-236470, 236472-236475, 236477, 236480, 236482-236486, 236488, 236490-236491, 236493-236494, 236498-236507, 236509-236529, 236531-236532, 236535-236539, 236541, 236543-236547, 236551-236553, 236555-236557, 236559-236560, 236565, 236570-236572, 236574-236575, 236578-236580, 236584-236585, 236587-236588, 236590, 236592-236595, 236598-236609, 236612-236624, 236626, 236632, 236641-236646, 236648, 236650-236652, 236656-236659, 236661-236662, 236664-236665, 236669-236671, 236673, 236675-236676, 236678, 236680, 236683-236691, 236694-236696, 236698-236699, 236702-236704, 236706-236707, 236709-236711, 236713-236714, 236718-236719, 236722-236723, 236725, 236729, 236731, 236742-236752, 236755-236757, 236759-236760, 236762-236763, 236768-236772, 236775-236779, 236781, 236783, 236785, 236788, 236790-236792, 236795, 236799-236801, 236805-236806, 236808, 236810-236811, 236813-236816, 236818-236819, 236821-236824, 236827, 236829-236830, 236832-236838, 236840-236844, 236846-236852, 236854, 236858-236865, 236868-236872, 236874, 236877-236880, 236882-236883, 236885-236901, 236903-236905, 236907, 236912, 236918-236920, 236923-236925, 236927-236928, 236931, 236933-236937, 236941-236942, 236945, 236949-236950, 236952, 236963-236966, 236970-236971, 236975-236976, 236978-236984, 236989-236990, 236993-236994, 236996-236999, 237002-237004, 237006, 237008-237010, 237012-237017, 237019-237021, 237024, 237026, 237028-237032, 237034, 237036-237038, 237041-237049, 237052, 237054-237056, 237058-237059, 237062-237063, 237065-237066, 237068-237070, 237072, 237074, 237078, 237080-237082, 237084, 237086, 237088, 237095-237099, 237101, 237103, 237105, 237107-237108, 237110, 237112-237119, 237121, 237123, 237125-237127, 237129-237130, 237132-237133, 237136-237140, 237142-237144, 237146-237147, 237149-237153, 237155-237156, 237158-237159, 237161-237166, 237170-237174, 237177-237179, 237181-237194, 237196-237201, 237203, 237206, 237208-237210, 237212-237219, 237222-237226, 237228, 237230-237231, 237233-237234, 237236-237239, 237244, 237247, 237249-237251, 237253-237257, 237260, 237262-237273, 237275, 237278, 237280, 237282-237288, 237290-237292, 237297, 237299-237301, 237306-237309, 237311-237314, 237316-237318, 237320-237327, 237330-237333, 237335-237340, 237342-237347, 237349-237352, 237355, 237357, 237359-237361, 237363-237365, 237367, 237369-237372, 237374, 237377, 237379-237380, 237383, 237387, 237389, 237392-237394, 237397-237399, 237401-237406, 237409-237410, 237412-237414, 237416, 237418-237420, 237422-237424, 237426-237427, 237429-237433, 237435-237437, 237439-237441, 237444-237449, 237451-237462, 237464, 237466-237467, 237470, 237472, 237477-237479, 237482-237483, 237485-237486, 237488, 237490, 237492-237494, 237496-237497, 237499-237503, 237505, 237508-237509, 237511-237514, 237517-237524, 237526, 237528, 237532, 237536-237537, 237544-237545, 237547-237548, 237554-237555, 237557-237560, 237563, 237568-237569, 237571-237573, 237577, 237581-237584, 237589-237594, 237596-237599, 237601-237602, 237604-237605, 237607-237608, 237610-237612, 237615-237618, 237621-237624, 237626-237636, 237638-237639, 237642, 237644-237645, 237647-237649, 237653-237654, 237658, 237660-237671, 237673-237674, 237676-237678, 237681-237683, 237685-237687, 237690-237701, 237703-237705, 237707, 237709-237711, 237713, 237716-237721, 237723-237726, 237728-237732, 237738-237743, 237746-237758, 237760-237763, 237765, 237767-237778, 237780-237784, 237788-237793, 237795-237804, 237807-237811, 237815, 237817, 237819, 237821-237823, 237825, 237832-237836, 237838-237843, 237845, 237847-237848, 237850-237851, 237853-237868, 237870-237875, 237878-237882, 237884-237886, 237891-237892, 237894-237895, 237897, 237900-237901, 237904-237905, 237907, 237909, 237911-237916, 237918-237919, 237923-237924, 237926, 237928, 237930-237931, 237933-237938, 237940, 237942, 237946, 237948-237952, 237956-237957, 237963-237965, 237969-237977, 237980-237985, 237987-237988, 237990-237991, 237994, 237997, 237999-238000, 238002-238004, 238006-238008, 238011, 238013-238016, 238018, 238024, 238027-238028, 238031, 238037, 238041-238043, 238045-238050, 238052-238056, 238058, 238063-238065, 238067, 238069-238072, 238074-238075, 238077-238079, 238081-238086, 238088, 238090-238091, 238093-238098, 238104-238106, 238112-238113, 238116-238119, 238122-238124, 238126-238127, 238130-238132, 238134-238135, 238137-238138, 238140-238141, 238145-238147, 238149, 238151, 238153-238155, 238158-238165, 238167, 238170, 238172-238175, 238178-238182, 238186-238188, 238191-238198, 238201-238206, 238209-238211, 238213, 238215-238216, 238218-238224, 238228-238237, 238239-238245, 238248-238253, 238255, 238257-238259, 238262-238264, 238266-238269, 238272-238273, 238275-238276, 238278, 238280-238283, 238285-238286, 238288-238289, 238291, 238293-238297, 238299-238300, 238302-238305, 238307-238309, 238311-238313, 238316-238321, 238324-238327, 238331, 238333, 238335, 238337, 238339, 238343-238346, 238349, 238351, 238353, 238356-238358, 238360, 238364, 238366-238370, 238373-238376, 238378-238381, 238384-238386, 238388-238402, 238405, 238407-238410, 238414, 238417-238418, 238420, 238426, 238428, 238431-238434, 238437-238439, 238441, 238443-238446, 238448-238453, 238455, 238457-238461, 238463-238468, 238470-238472, 238474, 238476, 238480-238484, 238486, 238488-238491, 238494-238496, 238499-238500, 238502-238506, 238508-238512, 238515, 238519-238522, 238524, 238527, 238530-238536, 238539-238545, 238549-238552, 238556-238558, 238561, 238565-238567, 238570-238572, 238577, 238579-238581, 238584, 238587, 238589-238591, 238593-238594, 238599-238600, 238602-238606, 238608-238609, 238611, 238613-238614, 238618-238620, 238623-238624, 238627-238632, 238634, 238636-238638, 238640-238645, 238648, 238652-238655, 238657-238658, 238660-238663, 238665-238669, 238672-238674, 238676-238678, 238680-238681, 238683-238685, 238688-238698, 238701, 238703-238705, 238707-238713, 238715-238718, 238721, 238723-238726, 238729-238733, 238735-238736, 238738, 238740-238756, 238760-238762, 238764-238765, 238767-238768, 238770, 238772-238773, 238775-238779, 238781-238782, 238784, 238786-238788, 238791, 238794-238796, 238799-238801, 238804-238805, 238807-238820, 238824-238826, 238828-238830, 238832, 238834-238835, 238837-238838, 238840-238843, 238845-238851, 238853, 238857-238860, 238862, 238865, 238867-238869, 238871-238872, 238874-238875, 238877-238879, 238881-238886, 238888-238893, 238895-238896, 238898-238903, 238905, 238910-238913, 238915, 238917-238918, 238924-238928, 238931-238934, 238936-238938, 238940-238941, 238944-238945, 238947-238948, 238950-238951, 238954, 238956, 238958-238959, 238962-238966, 238968-238976, 238980-238984, 238986-238990, 238992, 238995-

238996, 238998, 239000, 239002-239004, 239006-239011, 239013, 239015, 239018, 239021-239023, 239025-239026, 239029, 239032-239038, 239041, 239046-239047, 239049-239051, 239054-239056, 239058, 239060-239064, 239066-239070, 239072, 239076, 239079-239083, 239085-239089, 239091-239096, 239101, 239103-239104, 239106-239111, 239113-239117, 239120-239124, 239126-239129, 239131, 239134, 239136, 239138-239142, 239145-239146, 239148-239149, 239151-239152, 239154-239162, 239164-239170, 239173-239174, 239176, 239178-239179, 239181, 239183, 239185, 239187, 239189-239191, 239193-239195, 239197, 239199-239213, 239216-239217, 239219-239220, 239223-239227, 239229-239231, 239233-239235, 239238-239239, 239242-239244, 239246-239251, 239253-239260, 239262, 239266, 239268-239270, 239273-239279, 239281, 239286-239287, 239289, 239292, 239294, 239296-239300, 239305-239307, 239310-239312, 239314, 239316, 239319-239322, 239326, 239328, 239330-239333, 239335-239338, 239340, 239342-239343, 239346-239349, 239351, 239353-239358, 239361-239364, 239366, 239368-239372, 239374-239377, 239379-239380, 239382-239386, 239389, 239395-239399, 239404-239406, 239408, 239410-239412, 239414-239422, 239424, 239428-239430, 239432-239434, 239437-239438, 239440, 239443-239445, 239449, 239451, 239455, 239457-239458, 239461-239463, 239465, 239468, 239470, 239474-239483, 239488-239493, 239495-239498, 239503, 239505-239507, 239510, 239513, 239517, 239520-239521, 239524-239525, 239527-239530, 239533-239538, 239540-239555, 239557, 239559, 239567-239571, 239573-239574, 239577, 239579-239582, 239584, 239586-239590, 239593-239600, 239602, 239605-239610, 239612-239615, 239618, 239627-239629, 239631-239633, 239637, 239646, 239648-239649, 239652, 239656-239657, 239659, 239662-239664, 239666-239667, 239669-239671, 239673, 239675, 239679, 239681-239682, 239684-239685, 239688-239693, 239695, 239698, 239700-239701, 239704-239705, 239709-239714, 239717, 239719, 239722-239725, 239728, 239732-239747, 239749-239753, 239757-239759, 239761-239768, 239771-239781, 239784, 239787-239790, 239792, 239794, 239798-239799, 239801-239806, 239808, 239810-239814, 239816-239817, 239819-239824, 239826, 239829-239830, 239835-239843, 239845-239846, 239848, 239851-239854, 239856-239862, 239864-239866, 239868, 239870-239873, 239878-239879, 239883, 239887, 239889-239892, 239895, 239898, 239902-239905, 239907-239909, 239911, 239914, 239916-239917, 239919-239928, 239934-239937, 239942-239944, 239947-239948, 239950, 239952, 239955, 239958-239959, 239961, 239963-239969, 239971-239976, 239979, 239983-239984, 239986-239987, 239989-239990, 239992, 239994-239995, 239997-239998, 240000-240004, 240006-240008, 240011-240016, 240020, 240022-240023, 240025, 240027, 240029-240030, 240032-240037, 240039-240041, 240044, 240046, 240048-240051, 240057-240059, 240063-240065, 240067-240069, 240071-240072, 240074-240076, 240080, 240088-240100, 240102-240113, 240115-240127, 240130, 240132, 240135, 240137-240139, 240141-240142, 240144-240145, 240147-240151, 240154-240156, 240160-240161, 240163-240164, 240167-240169, 240171-240175, 240177, 240179-240180, 240182-240187, 240189, 240191, 240194, 240197-240205, 240211-240213, 240215-240219, 240223, 240225, 240227, 240229-240233, 240242-240249, 240251-240252, 240254-240256, 240258-240265, 240267, 240272-240273, 240275, 240278, 240285-240294, 240296-240298, 240309, 240311-240312, 240315, 240317-240318, 240323-240324, 240328, 240332-240337, 240339-240340, 240344, 240347-240348, 240350-240351, 240353, 240355, 240357-240361, 240363-240374, 240376-240379, 240387, 240389-240390, 240392-240394, 240398, 240400-240402, 240404-240409, 240414, 240418-240420, 240423-240425, 240427-240429, 240434-240437, 240439-240444, 240446, 240448-240453, 240455-240456, 240458, 240460-240463, 240465, 240469-240470, 240472-240491, 240493-240494, 240499-240501, 240503-240508, 240510-240513, 240517-240530, 240532, 240535-240537, 240539-240541, 240543-240544, 240546, 240548, 240550-240553, 240556, 240558-240559, 240561-240569, 240573-240574, 240576-240577, 240579, 240584-240586, 240589-240591, 240593-240605, 240608-240611, 240614, 240616-240621, 240623-240624, 240626-240631, 240633, 240635-240640, 240642-240646, 240651, 240653-240657, 240660-240666, 240671-240672, 240674-240675, 240678-240687, 240690-240692, 240695, 240697, 240700, 240702-240703, 240705, 240708-240711, 240715, 240717-240718, 240720, 240722-240731, 240733, 240739, 240741, 240744, 240746, 240748-240749, 240755-240758, 240760, 240765, 240767, 240769-240778, 240780-240787, 240789-240801, 240803-240806, 240811-240825, 240829-240833, 240835-240842, 240844, 240848-240854, 240856-240858, 240863-240868, 240870-240878, 240881-240882, 240887-240888, 240890-240897, 240899-240901, 240904-240916, 240919-240920, 240923-240927, 240929-240933, 240936, 240938-240946, 240948, 240950-240954, 240956-240959, 240966, 240968-240970, 240974, 240977, 240979, 240981, 240984-240989, 240991-241006, 241008, 241011-241012, 241015, 241019-241020, 241023-241026, 241029, 241031-241035, 241037-241039, 241042-241045, 241047-241049, 241051-241057, 241059, 241063-241064, 241067-241071, 241073, 241076-241077, 241080-241083, 241086, 241088-241089, 241093-241097, 241100, 241102-241107, 241109, 241111-241112, 241114-241116, 241118-241120, 241122, 241125-241126, 241128, 241130-241135, 241139-241141, 241143, 241149, 241151-241157, 241159-241161, 241163-241165, 241168, 241171, 241173, 241175, 241178, 241180-241181, 241183-241191, 241193-241194, 241196, 241198-241200, 241202-241210, 241212-241213, 241217-241229, 241231-241232, 241235-241245, 241247, 241254, 241258-241262, 241264-241268, 241270-241272, 241275-241276, 241281-241283, 241285-241287, 241291-241297, 241300-241302, 241306, 241308, 241310-241315, 241317, 241319-241321, 241323-241325, 241327, 241329-241335, 241337-241340, 241342-241348, 241350-241351, 241353, 241355-241356, 241358-241365, 241368-241369, 241371-241379, 241382-241383, 241385, 241387-241390, 241392, 241394-241398, 241400-241401, 241403, 241405-241406, 241408, 241411-241412, 241416, 241418, 241426, 241431-241433, 241435-241438, 241440-241442, 241444-241447, 241449-241450, 241453-241454, 241456-241458, 241464-241465, 241467, 241473, 241475-241481, 241485, 241488-241495, 241499-241503, 241507-241513, 241515-241517, 241520-241522, 241526, 241529-241532, 241535-241539, 241541-241542, 241544, 241546-241553, 241555-241559, 241561-241570, 241572, 241575-241583, 241589-241594, 241596, 241598, 241601-241606, 241608-241611, 241615-241616, 241618, 241620-241621, 241623, 241625, 241627, 241629-241630, 241632-241635, 241637-241639, 241642-241645, 241647, 241649, 241651, 241653, 241655-241660, 241662-241670, 241672, 241676-241678, 241680, 241684-241693, 241696-241700, 241704, 241707-241708, 241712, 241716, 241719, 241721, 241723-241726, 241728-241731, 241734, 241736-241741, 241743, 241746-241749, 241751, 241753-241755, 241759-241766, 241768, 241772-241773, 241776-241778, 241780-241781, 241783-241792, 241795, 241797-241802, 241804-241807, 241809-241817, 241819, 241822-241831, 241836-241838, 241840-241843, 241845, 241847-241848, 241852-241855, 241858-241860, 241863-241867, 241872-241877, 241879, 241881-241883, 241885, 241888-241891, 241893-241895, 241898-241902, 241906, 241908-241910, 241912-241915, 241917, 241919-241921, 241924-241927, 241929, 241937-241939, 241945-241954, 241956, 241959-241961, 241963-241965, 241967-241972, 241974, 241976-241978, 241984-241992, 241994-241995, 241997-241998, 242000, 242002, 242004-242005, 242008-242009, 242011-242018, 242020-242022, 242024, 242027-242029, 242031, 242036-242039, 242042-242044, 242046-242047, 242049-242059, 242062-242065, 242067, 242069, 242073, 242075, 242077, 242079, 242085, 242087, 242089-242092, 242097-242098, 242102-242105, 242107-242109, 242111-242112, 242114-242115, 242118, 242121, 242124, 242126-242127, 242130-242132, 242135, 242140-242142, 242144-242148, 242152-242153, 242156-242163, 242165-242166, 242169-242174, 242178, 242181-242188, 242190-242191, 242193-242196, 242198-242200, 242202, 242205-242206, 242208-242211, 242214-242217, 242219-242220, 242223, 242226-242228, 242230, 242238-242242, 242249, 242253, 242255-242257, 242260-242266, 242268, 242270, 242272, 242275-242277, 242279-242286, 242290, 242292, 242296-242301, 242303-242308, 242311-242317, 242319, 242321-242322, 242324-242325, 242327-242333, 242335-242346, 242348-242352, 242354, 242356-242361, 242364-242365, 242367, 242370, 242372, 242377-242378, 242380, 242383-242389, 242391-242392, 242394, 242402-242403, 242406, 242408, 242412-242417, 242419, 242422-242423, 242425-242426, 242428-242431, 242434, 242436-242446, 242452-242454, 242456-242462, 242464-242465, 242469-242470, 242472-242476, 242478-242482, 242484-242489, 242491-242498, 242501-242506, 242508, 242512, 242515-242519, 242521-242522, 242524-242525, 242529-242540, 242543-242544, 242546-242547, 242549-242550, 242552-242554, 242557, 242561-242563, 242566-242569, 242573-242576, 242584, 242586, 242588-242599, 242602, 242605-242606, 242608-242611, 242613-242615, 242617-242621, 242625-242629, 242632-242634, 242639, 242641-242647, 242649-242650, 242652-242658, 242660, 242662, 242664-242669, 242671-242677, 242679-242688, 242692, 242696-242698, 242706-242712, 242714, 242716-242718, 242720-242727, 242730-242733, 242735-242736, 242738-242740, 242742, 242745, 242747-242749, 242753-242763, 242766, 242768, 242770-242772, 242774-242775, 242777-242778, 242780-242781, 242783-242785, 242788-242790, 242793-242794, 242796-242799, 242802-242804, 242806-242809, 242812-242815, 242817-242822, 242824-242825, 242827, 242830-242834, 242837-242841, 242843, 242845-242846, 242848-242850, 242852-242855, 242857-242860, 242864, 242869-242870, 242873, 242875, 242878, 242882-242883, 242885-242889, 242893, 242895-242896, 242899, 242902, 242904-242905, 242907, 242909-242913, 242915, 242918-242922, 242925, 242929-242930, 242932-242938, 242943-242950, 242952-242953, 242955, 242957-242959, 242962-242963, 242965-242970, 242973, 242975-242977, 242982-242983, 242985-242986, 242989-242990, 242992, 242995, 242998, 243000-243002, 243004-243007, 243011-243015, 243017, 243020, 243022-243024, 243028-243045, 243047-243054, 243056-243060, 243063-243064, 243066-243067, 243069-243081, 243083-243084, 243086, 243088, 243090-243091, 243093-243095, 243098, 243101-243106, 243108-243109, 243111-243112, 243114-243120, 243122-243127, 243130-243137, 243139-243140, 243142, 243146-243147, 243150, 243152, 243155, 243161, 243163-243166, 243168-243171, 243173-243177, 243180-243186, 243190, 243192-243194, 243196-243199, 243201-243203, 243206-243207, 243209-243210, 243214-243218, 243220, 243222-243223, 243226-243231, 243233-243237, 243239, 243241-243245, 243248-243253, 243255-243257, 243260-243263, 243265, 243267-243269, 243271-243272, 243274-243275, 243278-243279, 243284-243289, 243291, 243294-243295, 243298-243303, 243306, 243308, 243310, 243312, 243314, 243317-243321, 243323, 243326, 243328-243330, 243333-243336, 243338-243341, 243343, 243346-243347, 243349-243351, 243355, 243358, 243360, 243362-243365, 243367, 243370-243371, 243375-243377, 243379-243385, 243387, 243389, 243391-243392, 243394, 243397, 243399, 243401, 243403-243408, 243410, 243412-243417, 243419-243427, 243429-243440, 243442-243447, 243450-243452, 243454, 243456, 243458-243463, 243465-243467, 243469-243470, 243473, 243475, 243477, 243483-243485, 243488-243489, 243492, 243495-243498, 243500, 243504-243505, 243509, 243511-243512, 243514-243517, 243519-243522, 243524-243529, 243531-243533, 243535-243536, 243538-243540, 243543-243544, 243546-243551, 243553, 243555, 243558-243559, 243563-243567, 243570-243578, 243580-243584, 243586-243588, 243590-243592, 243594-243596, 243598, 243600-243602, 243604, 243606-243608, 243610, 243612-243613, 243615-243616, 243619-243621, 243623-243629, 243631, 243633-243634, 243636, 243638-243639, 243642, 243644-243645, 243647-243648, 243652-243659, 243661, 243664, 243667-243671, 243673-243674, 243677-243679, 243686-243692, 243694-243701, 243703, 243705, 243707-243709, 243711, 243717-243729, 243731-243732, 243734-243737, 243739-243742, 243746, 243748-243751, 243754, 243756-243758, 243760, 243762-243766, 243769-243770, 243773, 243782, 243784-243785, 243787, 243789-243798, 243800-243801, 243803-243809, 243812, 243814-243817, 243819, 243821, 243824-243826, 243829-243842, 243849, 243851-243861, 243864-243865, 243867-243874, 243876-243878, 243880-243887, 243889-243890, 243893-243897, 243899-243901, 243904, 243906-243912, 243915-243926, 243928-243930, 243932-243933, 243935-243936, 243938-243940, 243947, 243951-243955, 243957-243958, 243962, 243964-243969, 243971, 243975, 243980-243983, 243985-243986, 243988-243992, 243994-244001, 244003, 244005-244011, 244014, 244019-244020, 244022-244023, 244026, 244028-244029, 244031, 244034, 244037-244038, 244041-244043, 244046-244048, 244052-244057, 244059-244068, 244070-244073, 244075-244080, 244082, 244084, 244088, 244095-244099, 244102-244103, 244109, 244111, 244116-244118, 244121, 244123-244125, 244133-244134, 244136-244137, 244141, 244143-244150, 244152-244153, 244155-244157, 244160-244163, 244166-244167, 244169-244184, 244188-244190, 244192-244196, 244198-244199, 244201-244203, 244205-244206, 244209, 244211-244224, 244227-244230, 244232-244235, 244238, 244241-244242, 244244, 244246, 244248, 244256-244264, 244266, 244268-244269, 244271, 244274-244277, 244280, 244284, 244286, 244288, 244290-244305, 244307-244311, 244313, 244315, 244318, 244322-244323, 244325-244327, 244330-244333, 244336-244339, 244341, 244343-244346, 244348, 244351, 244353, 244356, 244359-244361, 244363-244365, 244367, 244372, 244374-244376, 244378-244381, 244383-244384, 244386-244395, 244397, 244400, 244402-244406, 244409-244411, 244413-244420, 244423, 244425, 244427-244428, 244430, 244432-244434, 244436-244445, 244447, 244452, 244456, 244458-244460, 244462-244467, 244469-244471, 244473-244474, 244476, 244479-244482, 244484, 244486-244488, 244490-244493, 244495, 244497-244499, 244501-244503, 244505-244508, 244511-244512, 244514-244515, 244518, 244521, 244525, 244528-244532, 244534, 244538-244551, 244553-244555, 244558, 244560-244565, 244568, 244572-244573, 244575-244578, 244580-244581, 244585, 244588-244589, 244591-244593, 244596-244597, 244603-244606, 244608-244612, 244614, 244617, 244619, 244621, 244623-244625, 244631-244632, 244634-244640, 244643-244650, 244652-244654, 244656, 244662-244674, 244682-244685, 244687-244690, 244692-244698, 244700-244710, 244712, 244714-244716, 244718, 244720-244723, 244726, 244728-244729, 244731-244733, 244736-244738, 244740-244742, 244744, 244747-244748, 244750, 244754-244755, 244758-244762, 244764, 244766, 244768, 244771, 244775-244785, 244787-244788, 244792-244794, 244798, 244800-244810, 244812, 244814-244816, 244818-244819, 244821-244825, 244828, 244830-244834, 244836, 244838, 244840-244842, 244844, 244849-244850, 244852-244854, 244858-244859, 244861-244872, 244874, 244876, 244878-244880, 244884-244889, 244892, 244895-244896, 244898-244903, 244905, 244907, 244909, 244911, 244913-244921, 244923-244928, 244931-244936, 244938, 244940, 244942, 244944-244945, 244947-244950, 244952-244953, 244955-244960, 244964-244965, 244967-244968, 244970-244971, 244973, 244976-244979, 244982-244983, 244989, 244993-245000, 245002, 245005-245008, 245010, 245012-245015, 245017-245022, 245024-245034, 245040-245042, 245044, 245046-245048, 245050-245051, 245053, 245056-245060, 245063, 245068, 245070-245075, 245078, 245080-245081, 245083-245084, 245086-245090, 245092-245096, 245098-245101, 245105-245106, 245110-245120, 245122-245127, 245131-245134, 245136-245138, 245140-245147, 245149, 245151-245153, 245156-245157, 245160, 245162, 245164-245166, 245168-245169, 245172-245173, 245177-245185, 245187-245190, 245192-245193, 245196, 245199, 245201, 245204-245207, 245209-245210, 245212, 245214, 245216-245218, 245221-245228, 245230, 245233-245238, 245240-245243, 245245, 245250-245251, 245254-245260, 245264, 245266, 245269-245270, 245272-245273, 245275-245277, 245280-245300, 245303-245305, 245307, 245310-245312, 245314, 245318-245323, 245325, 245327, 245330-245334, 245336-245337, 245340-245343, 245346-245351, 245353-245359, 245361, 245363-245366, 245370, 245373-245374, 245376-245377, 245379, 245381, 245383-245387, 245389-245394, 245398, 245400, 245403, 245405-245406, 245410-245411, 245414, 245416, 245418-245428, 245430-245431, 245433-245437, 245439-245442, 245444-245445, 245447, 245450, 245452-245453, 245455, 245457, 245461, 245463, 245465-245471, 245473, 245475-245476, 245480-245483, 245485, 245487-245488, 245490, 245492-245493, 245496, 245499, 245501, 245507, 245511, 245513, 245515-245516, 245518-245519, 245526-245528, 245530-245531, 245533, 245536-245539, 245542-245543, 245545, 245549-245550, 245553-245555, 245557, 245559, 245561-245564, 245567-245572, 245575-245576, 245578, 245581-245586, 245588, 245590-245593, 245595-245596, 245603-245605, 245607-245608, 245611, 245613-245622, 245624, 245626-245627, 245629-245630, 245633-245641, 245643, 245645-245647, 245649-245653, 245655-245658, 245661, 245663, 245665-245667, 245669, 245677-245678, 245681, 245683, 245685-245691, 245693, 245698-245699, 245701, 245704-245713, 245715-245716, 245718-245719, 245721, 245723, 245725, 245729, 245733-245735, 245737-245740, 245742-245743, 245746, 245749, 245752, 245754, 245756-245760, 245762-245763, 245768, 245771, 245774-245778, 245782-245785, 245787-245790, 245793, 245795, 245797-245803, 245806, 245808-245810, 245813-245827, 245830-245836, 245838-245840, 245842, 245852, 245855, 245857-245859, 245862-245863, 245865-245867, 245869-245871, 245873-245877, 245880, 245882, 245884-245885, 245887-245891, 245893-245898, 245905-245916, 245921-245922, 245924-245932, 245934, 245942-245946, 245948-245952, 245955, 245963, 245967, 245969, 245971-245976, 245978, 245980-245981, 245983-245985, 245987, 245991, 245993, 245995-245996, 245998-246003, 246007-246009, 246012-246014, 246017-246020, 246022-246024, 246026-246027, 246029, 246032-246033, 246035, 246037, 246040-246043, 246045, 246050-246051, 246053-246054, 246056, 246059-246060, 246062-246065, 246068, 246071-246076, 246078, 246080, 246083, 246085, 246087-246089, 246091-246093, 246095, 246098-246100, 246102-246104, 246106-246107, 246109, 246112, 246114-246121, 246124-246126, 246129, 246132-246133, 246137, 246139-246140, 246143, 246145-246146, 246148-246150, 246152-246153, 246155, 246160, 246162, 246165-246166, 246169, 246171-246175, 246177-246178, 246180-246184, 246187, 246189-246191, 246193-246200, 246202-246203, 246205-246212, 246215-246216, 246218, 246220-246221, 246223-246226, 246228-246232, 246234-246236, 246238-246239, 246244-246255, 246259-246262, 246265-246267, 246269-246273, 246276-246278, 246281-246284, 246286-246292, 246294-246297, 246299-246305, 246308, 246310-246311, 246313-246316, 246320-246321, 246323-246327, 246331-246333, 246335, 246337, 246339-246340, 246342-246345, 246347, 246350-246354, 246358, 246363-246370, 246373, 246378-246380, 246382, 246384, 246386-246387, 246389-246390, 246393-246400, 246404-246405, 246407, 246412, 246414, 246417-246420, 246422-246423, 246425-246427, 246429-246430, 246434-246435, 246437-246444, 246447-246450, 246454-246456, 246459-246462, 246465, 246468, 246470, 246472, 246474-246476, 246478, 246481-246482, 246486-246488, 246490, 246492, 246494-246495, 246498-246504, 246506, 246508, 246511-246516, 246518-246519, 246521-246524, 246526, 246530, 246532-246533, 246535, 246537-246541, 246544-246545, 246547, 246549, 246551-246554, 246556, 246558-246564, 246566-246568, 246574-246579, 246582-246587, 246590-246591, 246595, 246597, 246599, 246605, 246608-246610, 246614-246618, 246620-246622, 246627-246628, 246631, 246633, 246640, 246643-246645, 246649-246655, 246659-246669, 246671-246673, 246676, 246680-246685, 246687-246690, 246693-246700, 246702-246706, 246709-246710, 246712, 246715, 246717, 246719, 246721-246727, 246729-246731, 246733-246734, 246736-246738, 246740, 246742-246752, 246756-246757, 246759-246760, 246764-246765, 246768, 246771, 246774-246778, 246780, 246784-246789, 246793, 246795, 246797, 246800-246802, 246804, 246806-246807, 246809, 246815-246819, 246823, 246825-246827, 246838-246839, 246841-246843, 246850, 246855, 246857, 246859, 246862-246863, 246865-246867, 246869-246872, 246874-246886, 246888-246900, 246902, 246904-246906, 246909-246917, 246921-246929, 246933-246935, 246938, 246940, 246942, 246944-246952, 246954-246959, 246961, 246964-246973, 246978-246983, 246985, 246987, 246990-246991, 246993, 246996, 246998, 247000-247003, 247005-247008, 247012, 247014-247015, 247017, 247022-247027, 247029-247033, 247035-247040, 247042, 247044-247047, 247049-247050, 247055-247056, 247058-247064, 247066-247068, 247071-247072, 247076-247077, 247079-247084, 247086-247089, 247091-247093, 247096-247099, 247101-247107, 247109, 247111-247112, 247114-247123, 247127, 247129-247139, 247141-247148, 247152-247157, 247159-247164, 247167-247172, 247174-247178, 247180, 247182-247185, 247187, 247189-247190, 247192-247194, 247196, 247199, 247202-247207, 247209-247217, 247219-247220, 247222, 247224, 247226, 247228, 247230-247231, 247234, 247238-247241, 247246-247247, 247249, 247251-247256, 247263, 247265, 247267, 247271, 247275-247276, 247278-247281, 247284-247285, 247287, 247291, 247305-247308, 247310, 247313-247319, 247322-247325, 247329, 247331-247332, 247334-247337, 247341-247342, 247346-247347, 247350-247351, 247354, 247358, 247361, 247365-247366, 247368, 247370-247372, 247374-247376, 247378, 247380-247384, 247386, 247388-247393, 247397-247398, 247400, 247403-247406, 247411, 247413, 247416-247422, 247424, 247426-247427, 247429-247436, 247439, 247441-247443, 247446, 247449, 247452-247453, 247456-247457, 247462-247463, 247465, 247470-247471, 247473-247475, 247477-247483, 247487-247488, 247491, 247493, 247495-247496, 247498-247507, 247510, 247514-247519, 247522-247523, 247526-247529, 247531, 247534, 247536, 247539-247544, 247546, 247549-247551, 247553-247554, 247558-247571, 247573-247574, 247578, 247580, 247582-247594, 247597-247603, 247606-247608, 247611-247613, 247615-247617, 247619-247626, 247628, 247633-247640, 247642-247644, 247646, 247649-247650, 247652-247655, 247659-247661, 247664-247665, 247667, 247669-247688, 247690, 247692, 247694-247699, 247701, 247704-247705, 247707, 247712-247715, 247718-247719, 247721-247727, 247731-247733, 247735-247736, 247738-247740, 247742, 247745, 247747-247749, 247751-247752, 247754-247761, 247763, 247765, 247767, 247769, 247773, 247779, 247782, 247784-247785, 247787, 247791, 247795, 247798, 247800-247801, 247803-247808, 247810-247812, 247820-247823, 247825-247826, 247830, 247833-247838, 247847, 247849-247855, 247859-247863, 247865-247869, 247872-247876, 247878, 247881-247883, 247886, 247890, 247892-247897, 247899-247900, 247909, 247912-247913, 247922, 247924-247925, 247929-247930, 247932-247933, 247935, 247937, 247939-247940, 247942, 247946, 247948, 247951, 247953-247958, 247961-247972, 247974-247978, 247980-247984, 247986, 247988, 247991, 247993, 248005, 248008, 248010-248014, 248016-248017, 248019-248020, 248022-248028, 248030, 248032, 248034, 248037-248039, 248041-248047, 248050, 248052-248055, 248058, 248063-248066, 248068-248069, 248072, 248074-248077, 248079, 248081-248082, 248084-248087, 248089-248090, 248092-248094, 248096, 248104-248109, 248116-248125, 248129-248137, 248140-248147, 248149-248151, 248154-248155, 248157-248164, 248168, 248170, 248172-248177, 248179-248184, 248186-248191, 248193, 248202-248206, 248208, 248210-248215, 248218-248219, 248221-248222, 248224, 248226, 248228, 248230-248238, 248241-248243, 248245, 248247-248252, 248254, 248256, 248258-248259, 248261-248262, 248264-248265, 248267-248268, 248270, 248272, 248274-248282, 248287, 248291-248292, 248295, 248297, 248299-248300, 248303, 248314, 248316, 248325-248328, 248335-248337, 248341-248342, 248346, 248352, 248359, 248361, 248363, 248367, 248370-248376, 248378-248379, 248382, 248385-248392, 248400-248403, 248406-248407, 248410, 248412, 248415-248417, 248422-248425, 248427-248429, 248432-248433, 248435-248441, 248443-248447, 248449-248450, 248452-248453, 248456-248461, 248463-248465, 248467-248468, 248470-248471, 248473-248475, 248477-248480, 248482-248484, 248486, 248488-248490, 248494-248495, 248497-248499, 248501-248502, 248505-248507, 248509, 248512-248520, 248522, 248524, 248527, 248529-248530, 248532-248534, 248536-248540, 248542-248543, 248546, 248548, 248550-248551, 248553-248555, 248558-248559, 248561-248565, 248567, 248570-248577, 248579-248580, 248582, 248584-248593, 248595-248598, 248600-248601, 248603-248612, 248614, 248617-248619, 248621, 248623, 248625-248629, 248631-248641, 248643, 248645-248651, 248654, 248658, 248660-248661, 248663, 248665-248666, 248669-248672, 248676, 248679-248680, 248682, 248684-248685, 248688, 248690-248696, 248700-248701, 248703-248708, 248712, 248716-248722, 248729, 248733-248738, 248742, 248744, 248746-248747, 248749-248756, 248760, 248762-248775, 248777, 248779, 248785, 248788-248789, 248791-248793, 248795-248797, 248805, 248807, 248813-248817, 248821, 248824-248827, 248831-248833, 248836-248837, 248839-248840, 248842-248844, 248846, 248849, 248853-248854, 248857-248858, 248862-248864, 248866-248871, 248873-248880, 248883-248885, 248889, 248894, 248896, 248898-248903, 248905, 248908-248911, 248913-248914, 248917-248927, 248930, 248933-248939, 248941-248942, 248949, 248952, 248954, 248957-248958, 248960-248961, 248963-248973, 248975, 248977-248979, 248981, 248984-248994, 248998-248999, 249001-249002, 249004, 249006-249007, 249010, 249012, 249014, 249016-249018, 249020-249021, 249024-249025, 249028-249038, 249041-249043, 249047-249051, 249053-249054, 249056, 249058-249062, 249064, 249066-249069, 249071-249073, 249075-249076, 249078-249080, 249082-249084, 249086, 249089-249091, 249095, 249097-249099, 249103-249104, 249106-249120, 249122, 249124-249126, 249131-249133, 249135-249138, 249141, 249143-249146, 249148-249151, 249156-249160, 249162-249163, 249165-249166, 249168-249170, 249173-249181, 249183-249184, 249187-249191, 249193, 249195, 249197-249200, 249205, 249208-249218, 249220-249222, 249224-249231, 249235-249239, 249241-249245, 249247-249249, 249251-249253, 249256-249268, 249271-249278, 249280-249281, 249284, 249286, 249288-249293, 249295, 249298-249303, 249307, 249310-249311, 249313, 249315, 249317-249320, 249322-249330, 249332-249334, 249337, 249339-249343, 249345-249346, 249349-249352, 249354-249355, 249359-249372, 249375, 249377-249378, 249380-249381, 249385-249386, 249389, 249394-249403, 249407-249408, 249410, 249416-249419, 249421-249422, 249424-249428, 249430-249432, 249435-249437, 249439-249440, 249442-249443, 249446-249447, 249450, 249452-249453, 249458-249459, 249463, 249466-249470, 249472, 249474-249475, 249479-249481, 249486-249487, 249489, 249497-249499, 249501, 249503-249508, 249510-249515, 249518-249519, 249523, 249528, 249530, 249533, 249535-249536, 249541-249542, 249545-249548, 249553-249554, 249560-249561, 249563, 249565, 249567-249569, 249571-249572, 249574, 249576-249577, 249579, 249581-249586, 249588-249590, 249593-249596, 249598-249600, 249602-249605, 249607-249622, 249625-249635, 249637-249638, 249640-249645, 249647, 249649-249655, 249657, 249660-249661, 249663-249665, 249667-249669, 249671-249676, 249678-249681, 249683-249686, 249688-249692, 249695-249701, 249703, 249705, 249708, 249710-249712, 249714-249723, 249725-249729, 249732, 249734, 249736, 249739-249742, 249744-249746, 249752, 249755, 249759-249760, 249762, 249765-249766, 249771, 249774-249775, 249777, 249779-249781, 249784-249787, 249789-249790, 249793-249794, 249796-249797, 249799, 249802-249807, 249809, 249811-249814, 249816-249818, 249820, 249822, 249824, 249826, 249829-249837, 249839-249842, 249844-249849, 249852-249853, 249855-249856, 249858-249860, 249862-249863, 249866-249879, 249883-249886, 249888-249889, 249891-249893, 249895-249899, 249904, 249906-249908, 249911-249912, 249914, 249918-249929, 249931-249936, 249939, 249942, 249944-249950, 249952, 249954-249960, 249962-249966, 249968-249971, 249973-249975, 249978-249979, 249981-249982, 249988-249989, 249991-249993, 249995, 249997-250001, 250003-250007, 250013-250014, 250016, 250019-250021, 250023-250029, 250032-250033, 250035, 250037, 250040, 250042, 250045-250049, 250051-250054, 250057, 250060-250061, 250063-250064, 250066-250067, 250070-250076, 250078-250079, 250082, 250084, 250086, 250088-250092, 250096, 250098, 250101-250103, 250105, 250109-250117, 250119-250121, 250123-250132, 250134-250148, 250150-250152, 250154, 250156-250160, 250162-250163, 250166, 250170-250171, 250175-250182, 250185, 250189-250190, 250193-250194, 250199-250201, 250203-250211, 250214-250219, 250222-250227, 250231, 250233-250236, 250238, 250242-250246, 250249-250251, 250253-250254, 250256, 250258-250260, 250267-250269, 250273, 250276-250277, 250280, 250282-250283, 250286-250292, 250294-250296, 250298-250301, 250306, 250308-250313, 250315-250316, 250319-250322, 250324-250327, 250331, 250333-250342, 250344-250345, 250347, 250349-250351, 250353-250360, 250362-250363, 250366-250368, 250370-250372, 250376-250378, 250380, 250382-250384, 250387-250388, 250391-250393, 250397-250398, 250401, 250405-250406, 250411, 250413-250414, 250417-250423, 250425-250431, 250433-250436, 250438-250441, 250443-250445, 250450-250455, 250457-250458, 250461, 250464-250468, 250470-250473, 250475, 250477, 250479-250485, 250489-250490, 250493-250494, 250496-250500, 250502-250505, 250507, 250510-250514, 250516, 250520-250521, 250523-250530, 250533-250534, 250538-250539, 250542, 250546-250549, 250553, 250556-250557, 250561-250563, 250565-250566, 250569-250570, 250572-250573, 250575, 250577-250578, 250583-250585, 250587, 250590-250591, 250593-250595, 250597, 250599, 250602, 250608, 250610-250611, 250613-250616, 250620, 250622, 250626, 250631-250639, 250641-250642, 250645-250646, 250648-250649, 250651, 250653-250655, 250659, 250661-250665, 250668-250673, 250675-250677, 250679-250680, 250682-250686, 250688-250689, 250691-250696, 250699-250703, 250705-250706, 250708-250709, 250711, 250713-250717, 250719-250721, 250723-250726, 250728-250734, 250736-250737, 250741, 250744-250746, 250748-250749, 250751-250757, 250759-250767, 250769, 250773-250774, 250776, 250778-250783, 250786, 250788-250789, 250791-250793, 250795, 250797-250798, 250803-250807, 250809, 250811-250812, 250814-250817, 250819, 250823-250826, 250828, 250830, 250833, 250835-250836, 250838-250848, 250850-250857, 250863, 250865-250866, 250869, 250871, 250873-250879, 250881, 250883, 250890-250893, 250895-250900, 250902, 250904-250906, 250909-250915, 250917-250922, 250925, 250927, 250930-250936, 250938-250940, 250942-250943, 250946, 250948, 250950-250951, 250954-250955, 250958-250964, 250966-250967, 250969-250970, 250975-250977, 250979-250981, 250988, 250991-250994, 250996, 250999-251000, 251003-251004, 251008, 251012-251013, 251016-251025, 251029, 251032-251034, 251037, 251045, 251051-251052, 251054, 251056, 251059-251062, 251064, 251066, 251072, 251074, 251076-251078, 251080-251082, 251085, 251088-251090, 251094, 251097-251099, 251101-251104, 251106-251107, 251109-251112, 251115, 251119, 251121-251127, 251129, 251131, 251133-251134, 251136, 251139-251140, 251144, 251146-251147, 251149, 251151-251152, 251154-251158, 251160-251162, 251164-251174, 251176-251181, 251183-251184, 251186, 251188, 251191-251194, 251196, 251199, 251201-251202, 251207-251212, 251214-251223, 251225, 251227, 251229-251231, 251233, 251235, 251237-251239, 251241-251243, 251245, 251249-251251, 251253, 251256-251258, 251260, 251264, 251267, 251270-251276, 251278-251279, 251285-251289, 251291, 251293, 251297, 251299, 251301-251303, 251306-251309, 251311, 251313, 251315, 251317, 251320-251323, 251325-251327, 251330, 251332-251339, 251341-251345, 251347, 251349-251352, 251354-251356, 251365, 251367, 251371, 251374-251375, 251378-251380, 251382-251383, 251385-251388, 251390-251396, 251399, 251402-251412, 251414-251415, 251418-251420, 251422-251423, 251425, 251427-251435, 251437, 251443, 251446-251449, 251451-251453, 251455, 251459-251476, 251478, 251481-251482, 251484-251487, 251489-251492, 251495-251497, 251499-251502, 251504, 251506, 251508-251510, 251513-251525, 251527-251534, 251537-251538, 251540-251541, 251543, 251545, 251547, 251549-251558, 251560-251570, 251573-251576, 251579, 251582-251586, 251588-251601, 251604, 251610, 251612, 251616-251619, 251621-251625, 251629, 251633, 251637, 251640-251643, 251645, 251647, 251649-251651, 251653, 251655, 251657-251666, 251668-251670, 251672-251675, 251677, 251679, 251681-251684, 251687-251691, 251693, 251695, 251698-251700, 251702-251705, 251707-251709, 251711-251715, 251722-251723, 251726-251728, 251733, 251736, 251738-251740, 251742, 251744-251748, 251750-251752, 251754-251759, 251764, 251766, 251769, 251772, 251774, 251776-251777, 251779, 251781-251783, 251786, 251789-251790, 251792-251793, 251795-251797, 251799-251800, 251804, 251808, 251810-251812, 251819-251820, 251822-251825, 251827-251829, 251833-251836, 251838-251850, 251852-251854, 251856, 251858-251862, 251864-251865, 251867-251870, 251873, 251875-251881, 251883-251886, 251888-251889, 251891-251893, 251896, 251898, 251900, 251903, 251905, 251908-251911, 251913-251914, 251916, 251918-251919, 251922, 251924, 251927-251929, 251931, 251933, 251939-251942, 251946-251950, 251953-251955, 251960, 251962-251963, 251968-251969, 251971, 251973-251974, 251978-251983, 251985, 251988-251997, 252000-252001, 252004-252005, 252007-252009, 252011-252012, 252015-252017, 252019, 252021-252022, 252024-252026, 252031-252034, 252036, 252039-252041, 252050-252053, 252061-252062, 252064-252066, 252069-252073, 252075-252076, 252078, 252080, 252083-252087, 252090-252091, 252093, 252096-252097, 252103, 252105-252106, 252108-252115, 252117, 252119, 252123-252128, 252130-252132, 252134, 252136-252138, 252140-252142, 252145-252146, 252148-252149, 252151-252157, 252161, 252163-252170, 252173, 252176-252177, 252182-252184, 252186, 252188-252189, 252191-252193, 252196-252200, 252205-252206, 252208-252212, 252214-252221, 252223-252224, 252226-252228, 252230, 252234, 252237-252240, 252242-252243, 252246-252248, 252250, 252252-252260, 252263-252266, 252268, 252270-252273, 252275, 252279, 252281-252283, 252286-252289, 252292-252294, 252297, 252300-252305, 252307, 252309, 252311-252315, 252318-252319, 252323, 252325-252326, 252328-252329, 252331, 252333, 252337-252340, 252344, 252347-252350, 252352, 252354-252356, 252358-252361, 252363, 252365, 252367-252368, 252374, 252376-252381, 252383, 252389-252390, 252392-252393, 252396, 252399-252403, 252407-252408, 252410-252412, 252414-252419, 252422-252426, 252428, 252431-252434, 252436-252439, 252441-252442, 252446-252454, 252456-252460, 252462, 252464-252469, 252471-252473, 252475-252476, 252478-252479, 252481-252484, 252488, 252490, 252492-252494, 252496-252497, 252499, 252501-252502, 252504, 252506-252508, 252513-252514, 252516, 252518-252519, 252522-252523, 252526, 252528-252529, 252532-252535, 252541, 252547-252549, 252551, 252555, 252559-252565, 252569-252572, 252575-252576, 252580, 252582, 252587, 252589-252590, 252593, 252595-252597, 252599, 252602, 252604-252605, 252610, 252616-252623, 252625-252629, 252633-252637, 252639-252641, 252643-252644, 252646-252651, 252653-252655, 252657, 252660-252663, 252666-252673, 252675, 252677-252678, 252680-252681, 252683, 252685, 252688-252690, 252692-252694, 252697-252698, 252700-252702, 252704, 252707-252710, 252712-252713, 252718-252719, 252721-252732, 252735, 252737-252742, 252744-252745, 252747-252752, 252754-252756, 252758-252761, 252767-252770, 252772-252774, 252776-252780, 252782, 252786, 252788-252789, 252791-252792, 252795-252805, 252807-252808, 252810, 252812-252814, 252818, 252820-252823, 252825-252830, 252833, 252836-252843, 252845, 252848-252849, 252851-252852, 252854, 252858-252859, 252861-252866, 252868, 252871, 252873, 252875, 252878, 252881-252883, 252887-252891, 252895-252907, 252909, 252911-252914, 252916-252919, 252921, 252925-252928, 252930, 252932-252942, 252944-252946, 252948-252951, 252953-252957, 252960, 252963-252964, 252967-252976, 252978, 252980, 252982-252987, 252989, 252992, 252995, 252997-253000, 253003, 253005-253006, 253008-253009, 253013-253015, 253018, 253020, 253023, 253025, 253027, 253029-253034, 253036, 253044, 253048-253050, 253052-253053, 253055-253058, 253063, 253065-253075, 253077, 253084-253085, 253087, 253089-253095, 253098-253100, 253103-253107, 253110-253111, 253114, 253116-253118, 253120, 253123, 253125-253132, 253135-253136, 253138, 253140, 253142-253144, 253147, 253152-253160, 253162-253163, 253166, 253168-253179, 253182-253188, 253192-253193, 253195-253201, 253203, 253205, 253208, 253212-253215, 253222-253223, 253225, 253228, 253230-253231, 253233, 253235, 253237-253242, 253244, 253247, 253250, 253252-253254, 253257, 253263-253267, 253269-253276, 253279-253286, 253289-253291, 253293, 253295, 253297-253300, 253302, 253304-253305, 253310-253316, 253320-253321, 253323-253328, 253330-253333, 253335-253339, 253342, 253344-253345, 253347, 253351-253358, 253360-253366, 253369, 253371, 253373, 253376-253378, 253380-253383, 253388, 253390-253392, 253394-253405, 253407-253408, 253411, 253414-253416, 253418-253422, 253424-253427, 253429, 253431-253437, 253439-253440, 253442, 253444-253447, 253449-253456, 253460, 253463-253470, 253473-253474, 253479-253480, 253483, 253485, 253487-253489, 253491-253495, 253499, 253501-253502, 253504, 253507, 253511-253513, 253520, 253522, 253525, 253532, 253534-253536, 253538-253539, 253541-253546, 253549-253551, 253553-253556, 253559, 253561, 253563-253566, 253569-253572, 253574-253577, 253580-253582, 253584-253585, 253587, 253589, 253591, 253593, 253596-253599, 253603, 253607, 253609, 253611-253621, 253627, 253629, 253631, 253633, 253635-253636, 253639-253640, 253643-253645, 253648-253654, 253656-253657, 253659-253660, 253663, 253665-253666, 253668-253672, 253674-253675, 253677, 253679, 253681-253683, 253685-253686, 253690, 253696-253700, 253703, 253705-253706, 253709-253710, 253712, 253714-253715, 253717, 253719-253720, 253728, 253731, 253733-253736, 253738, 253740-253745, 253749-253763, 253765-253768, 253770-253774, 253777-253778, 253780-253784, 253786, 253788-253789, 253791-253795, 253797, 253802-253804, 253806-253809, 253811-253816, 253819, 253823-253830, 253832, 253834-253835, 253840-253841, 253843-253850, 253854-253855, 253860-253862, 253864-253868, 253871, 253873-253875, 253879, 253881-253884, 253887-253890, 253894-253897, 253900-253905, 253913-253923, 253925-253926, 253928, 253931, 253933-253935, 253938-253940, 253943, 253945-253948, 253951-253959, 253961, 253963-253968, 253970-253978, 253980-253985, 253987-253991, 253993-253995, 253998, 254000, 254002, 254004-254011, 254013-254014, 254019-254020, 254024-254028, 254030-254034, 254036-254045, 254047, 254049-254050, 254054, 254056-254060, 254062, 254064-254065, 254068, 254070-254072, 254077, 254080-254083, 254085, 254089, 254093, 254097-254102, 254105-254109, 254111-254115, 254117-254119, 254122, 254128-254131, 254133-254134, 254136, 254139, 254141-254142, 254144, 254147, 254149, 254153, 254155-254158, 254160-254161, 254164, 254166, 254169-254170, 254174, 254176-254178, 254182-254183, 254185-254187, 254189, 254191, 254193-254201, 254206, 254209-254210, 254212-254213, 254215, 254217, 254219, 254221, 254224-254226, 254231-254242, 254245-254257, 254259, 254261, 254263-254266, 254269, 254271-254275, 254278-254279, 254281, 254285-254293, 254295-254299, 254303-254304, 254306-254309, 254312, 254314-254316, 254318-254319, 254321, 254328-254332, 254334, 254338-254340, 254342-254343, 254345, 254347-254350, 254352-254354, 254360, 254363-254364, 254366-254367, 254369, 254371-254372, 254374, 254376, 254379-254382, 254388-254391, 254393-254395, 254397-254401, 254403, 254405-254406, 254408, 254411-254413, 254417, 254421-254423, 254425, 254427-254431, 254434-254441, 254444-254447, 254449-254450, 254452-254459, 254463-254468, 254476, 254478-254479, 254482-254483, 254485, 254487-254494, 254496, 254499-254500, 254502, 254504-254512, 254514, 254516-254521, 254524-254525, 254527-254528, 254530-254533, 254535-254539, 254542-254549, 254551-254554, 254556-254558, 254560, 254562-254564, 254566, 254568-254569, 254573, 254577, 254579-254580, 254582-254584, 254586-254600, 254602-254603, 254605-254607, 254611, 254613-254620, 254622, 254625-254626, 254628, 254631-254634, 254636-254638, 254640-254642, 254644-254647, 254649-254654, 254656-254658, 254661, 254666-254672, 254677-254680, 254684-254687, 254689-254690, 254693, 254696, 254698-254699, 254701, 254703-254711, 254713-254716, 254721, 254723, 254726-254733, 254735-254742, 254748-254749, 254751, 254753, 254756, 254758-254767, 254771, 254777-254785, 254787-254788, 254790-254793, 254795, 254797-254802, 254804-254809, 254813-254814, 254816-254817, 254819-254824, 254826-254829, 254831-254834, 254837, 254840, 254843, 254845, 254847-254848, 254850-254855, 254857-254865, 254868-254870, 254872, 254875-254877, 254880, 254882-254885, 254887-254889, 254891-254892, 254894-254895, 254897, 254899-254901, 254903-254907, 254911-254914, 254916, 254919-254920, 254924-254925, 254928-254929, 254931-254935, 254937-254938, 254941-254945, 254947, 254949, 254952-254953, 254955, 254958, 254962, 254965-254969, 254971-254981, 254983, 254985-254986, 254988, 254990-254994, 254996-254997, 255001-255002, 255004, 255006, 255008-255010, 255012-255013, 255015, 255017-255021, 255023, 255025-255026, 255028-255029, 255034-255035, 255038, 255040-255043, 255045, 255047-255050, 255055, 255057-255060, 255063, 255065-255070, 255072, 255074, 255076-255078, 255080, 255082, 255084-255088, 255090-255095, 255097, 255099-255101, 255104, 255107-255108, 255110, 255112-255116, 255119, 255122-255124, 255126-255128, 255130-255136, 255138-255141, 255143-255147, 255149, 255151-255155, 255158-255159, 255161-255163, 255167, 255169, 255171, 255174-255178, 255181, 255183-255184, 255186-255187, 255189-255191, 255193-255201, 255203, 255209, 255212, 255215-255216, 255220-255221, 255224-255225, 255229-255232, 255234-255238, 255240, 255244-255246, 255248, 255250-255254, 255256-255257, 255260-255261, 255263-255268, 255275, 255277-255279, 255282-255287, 255290, 255295, 255297-255299, 255302-255308, 255311-255313, 255316, 255318, 255320-255322, 255324-255329, 255331-255336, 255338-255340, 255342-255343, 255346-255356, 255360, 255363-255364, 255366, 255368-255372, 255374, 255377, 255379, 255381-255383, 255385-255399, 255401-255414, 255417-255418, 255421-255422, 255425-255427, 255430-255440, 255445-255446, 255448-255449, 255451, 255453-255456, 255458-255461, 255464-255471, 255473-255474, 255476-255477, 255487, 255489-255491, 255493-255495, 255498-255500, 255502, 255505-255517, 255519-255520, 255522-255527, 255529, 255531, 255533-255534, 255536, 255538, 255540-255541, 255544, 255548-255550, 255554-255556, 255559, 255563-255568, 255571, 255573-255575, 255579-255581, 255583-255584, 255586, 255589, 255595-255596, 255598-255599, 255601-255605, 255607, 255612-255618, 255620-255622, 255624, 255626, 255628-255629, 255631, 255634, 255638-255641, 255644, 255649-255650, 255654, 255661-255667, 255670-255671, 255674-255675, 255678-255682, 255684, 255686-255692, 255694, 255697, 255699, 255702-255703, 255708-255711, 255716, 255719-255721, 255723-255727, 255729, 255732-255734, 255737, 255739, 255741, 255744-255750, 255752-255756, 255758-255760, 255764, 255767-255770, 255772-255773, 255776-255778, 255781-255782, 255784, 255786, 255790-255792, 255794-255795, 255798, 255800-255801, 255804-255806, 255812-255813, 255815-255816, 255818-255822, 255827-255828, 255837, 255841, 255845-255846, 255848, 255850-255855, 255858-255860, 255862, 255864, 255866-255868, 255870-255871, 255874, 255882-255883, 255885-255886, 255889, 255892, 255895-255899, 255901-255903, 255905-255906, 255908, 255912-255913, 255918, 255922, 255927, 255930, 255934-255943, 255946, 255948-255949, 255954-255956, 255958-255961, 255963-255967, 255970-255972, 255975-255987, 255991, 255993-255994, 255996, 256001-256003, 256007-256008, 256010, 256012, 256016, 256019-256021, 256023-256025, 256028-256030, 256032-256037, 256043, 256045-256048, 256050, 256052, 256054-256066, 256068-256074, 256076, 256079, 256081-256084, 256087-256092, 256094-256095, 256099-256106, 256108-256109, 256111-256117, 256119, 256122-256123, 256125-256131, 256133-256134, 256138-256143, 256146-256148, 256150, 256153-256160, 256162-256171, 256173-256179, 256181-256182, 256184-256185, 256187, 256189, 256193-256194, 256197, 256203, 256205-256210, 256212-256214, 256216-256226, 256229-256230, 256233, 256239-256242, 256244, 256247-256254, 256256-256257, 256259, 256261-256262, 256264-256267, 256270-256272, 256275-256276, 256278-256279, 256283, 256285-256287, 256289, 256291, 256293-256298, 256301-256302, 256305, 256307, 256309-256314, 256316, 256321-256323, 256325-256331, 256335, 256337, 256339-256345, 256347, 256349-256351, 256353-256357, 256359, 256361, 256365-256366, 256368-256373, 256376-256377, 256379, 256381-256383, 256385-256386, 256388, 256394, 256397-256399, 256402, 256409-256411, 256414, 256416-256417, 256419-256420, 256422-256425, 256427, 256429-256433, 256435-256437, 256439-256440, 256442, 256445-256451, 256453, 256455-256459, 256463, 256465, 256468-256478, 256481-256496, 256499-256506, 256509-256511, 256513-256516, 256519-256520, 256523-256525, 256529-256530, 256533, 256535-256539, 256543-256544, 256549-256552, 256555, 256557-256558, 256560, 256564-256567, 256569, 256571-256578, 256580, 256582-256590, 256592-256593, 256595, 256597-256598, 256601, 256603-256604, 256607, 256610, 256613-256614, 256617-256618, 256620, 256622, 256624-256626, 256628, 256632-256638, 256641-256642, 256644, 256646-256649, 256651-256658, 256660-256661, 256663-256665, 256667-256668, 256670-256676, 256680, 256682-256685, 256689, 256692, 256697-256701, 256703, 256705-256706, 256708-256710, 256712, 256716, 256719-256727, 256730, 256734-256735, 256738-256746, 256748-256752, 256758-256761, 256763-256768, 256770, 256772-256774, 256777-256780, 256782, 256784-256788, 256790-256792, 256794-256798, 256801-256818, 256822-256827, 256829-256830, 256832, 256834-256837, 256839, 256841-256842, 256844-256847, 256849, 256851-256852, 256854-256855, 256857, 256860-256863, 256865, 256870-256871, 256875-256882, 256884-256886, 256888, 256890-256892, 256894, 256896-256902, 256904-256905, 256909-256911, 256913, 256915-256916, 256919-256922, 256925-256927, 256930, 256932-256933, 256935-256936, 256938-256940, 256942-256943, 256947, 256949-256950, 256953-256954, 256958-256960, 256962, 256964-256965, 256967, 256969, 256971, 256974-256980, 256982, 256984-256988, 256992, 256995, 256997-256998, 257001, 257005, 257008-257012, 257015, 257019-257021, 257024, 257026, 257030-257033, 257035-257036, 257039-257042, 257044-257045, 257050, 257054-257062, 257064-257069, 257071-257072, 257074-257076, 257080-257081, 257085, 257090, 257095-257097, 257099, 257101-257105, 257107, 257109, 257112, 257114, 257118-257119, 257122, 257125-257128, 257130-257136, 257138-257141, 257143, 257145, 257147-257149, 257151-257152, 257156-257157, 257159, 257162-257164, 257166, 257168, 257170, 257174, 257177-257181, 257183-257184, 257189, 257191, 257193-257194, 257202, 257204-257206, 257209-257210, 257214, 257217, 257219, 257221-257222, 257224, 257226, 257228-257229, 257232-257234, 257236-257237, 257239-257240, 257242, 257244-257246, 257250-257251, 257255, 257258-257259, 257261-257264, 257267-257269, 257272, 257274, 257276-257282, 257284, 257286, 257288, 257290, 257292-257299, 257301, 257303, 257305-257309, 257311, 257313-257315, 257317, 257321-257323, 257325-257326, 257328-257329, 257331-257341, 257344-257353, 257355-257356, 257359-257360, 257365-257371, 257373, 257375-257383, 257387-257388, 257390, 257393-257394, 257396-257397, 257401-257406, 257408-257409, 257413-257416, 257419-257426, 257428, 257430-257431, 257435, 257437-257439, 257441, 257443-257445, 257447-257449, 257451, 257453-257454, 257458, 257461-257462, 257466, 257468-257469, 257471, 257476, 257478, 257484-257487, 257491-257496, 257498-257501, 257504-257508, 257516-257517, 257520-257534, 257536, 257538, 257540-257541, 257544, 257549, 257551, 257553, 257555-257556, 257559, 257563-257569, 257572-257574, 257576, 257578, 257580-257581, 257583-257591, 257593-257595, 257597, 257603, 257608-257615, 257618-257622, 257624-257626, 257628-257635, 257638, 257642-257645, 257647-257650, 257652-257653, 257655-257656, 257661, 257663-257667, 257670-257677, 257679-257682, 257684-257690, 257693, 257696, 257702, 257704-257706, 257710, 257714-257715, 257718-257719, 257721-257722, 257724, 257727, 257729, 257733, 257735-257741, 257745-257746, 257750-257764, 257766-257773, 257775-257790, 257794-257800, 257802-257806, 257809-257816, 257818-257819, 257821-257823, 257825, 257827, 257829-257834, 257836, 257838, 257840, 257842, 257844-257848, 257850, 257854-257856, 257858-257859, 257861-257862, 257866-257868, 257871, 257874-257875, 257881, 257886, 257889, 257896, 257900-257901, 257904, 257907, 257909-257911, 257918, 257921, 257923-257924, 257926, 257928-257929, 257931-257932, 257934-257937, 257939-257944, 257946-257951, 257957, 257959, 257965-257966, 257971, 257973, 257975-257976, 257978-257983, 257986-257987, 257989-257991, 257993-257994, 257996, 258006, 258008-258013, 258015, 258017-258022, 258030, 258032-258034, 258038, 258040, 258042-258049, 258051-258052, 258054-258061, 258064-258068, 258070, 258073-258076, 258078-258080, 258082-258084, 258086, 258089, 258092-258093, 258096-258097, 258100, 258102-258105, 258107-258111, 258113, 258115-258117, 258121, 258124-258127, 258129, 258131-258132, 258135-258137, 258139, 258141, 258143-258145, 258147-258148, 258150, 258152-258156, 258158, 258161-258162, 258165-258167, 258169-258174, 258179-258185, 258187-258191, 258195-258196, 258200, 258203, 258206-258207, 258209, 258214, 258217-258218, 258220-258224, 258226, 258230-258232, 258234-258239, 258241-258242, 258244-258246, 258250, 258254, 258256, 258258, 258260-258264, 258266-258268, 258272-258274, 258276, 258278-258289, 258292, 258295-258298, 258301-258302, 258304-258311, 258313-258314, 258317-258324, 258326-258332, 258336, 258338, 258340-258341, 258343-258344, 258346-258348, 258352-258353, 258355-258356, 258358-258363, 258365-258369, 258371, 258373-258376, 258378, 258380, 258385-258392, 258399-258412, 258427-258429, 258431-258433, 258439-258440, 258442, 258447-258449, 258451, 258453-258455, 258458-258459, 258463, 258473, 258476, 258479-258480, 258482-258483, 258486-258495, 258497, 258499-258501, 258508-258513, 258515-258517, 258519-258523, 258526-258530, 258533-258537, 258540, 258543, 258552-258556, 258558, 258563-258565, 258568-258570, 258572-258573, 258575-258576, 258581-258583, 258585-258587, 258589-258590, 258592, 258594-258596, 258600, 258604, 258611, 258614-258618, 258620-258621, 258623-258634, 258636-258642, 258644-258646, 258649-258650, 258652-258653, 258656, 258659-258663, 258666, 258668, 258671-258675, 258680-258683, 258691-258692, 258694, 258696-258698, 258700, 258702, 258705-258707, 258709, 258714-258717, 258720, 258722-258723, 258725, 258728-258730, 258732-258735, 258737-258740, 258742-258748, 258750, 258752, 258755-258762, 258767-258770, 258772, 258775, 258777, 258781-258782, 258785-258788, 258790-258793, 258795, 258798-258801, 258805-258809, 258811-258812, 258814-258815, 258820-258824, 258826, 258829, 258831, 258833-258835, 258837-258841, 258844-258846, 258849-258860, 258862-258865, 258867-258870, 258872-258874, 258880, 258882-258885, 258887-258896, 258898-258909, 258913-258924, 258927-258930, 258932-258934, 258939-258940, 258945, 258948-258957, 258961, 258967-258971, 258974, 258980-258982, 258987-258991, 258993-259000, 259003, 259005, 259007, 259009, 259011-259013, 259016, 259022, 259024, 259026-259028, 259030-259036, 259038, 259041-259049, 259051-259058, 259061, 259065-259066, 259068, 259070, 259072-259074, 259076-259081, 259083, 259085-259086, 259089-259091, 259093-259095, 259097-259108, 259110-259114, 259116, 259119-259122, 259125-259126, 259128, 259130-259138, 259140, 259142-259148, 259151-259153, 259156-259157, 259159-259161, 259164-259166, 259168-259169, 259174-259183, 259186-259187, 259195-259198, 259200, 259202-259203, 259206, 259208-259210, 259212, 259214-259216, 259220-259222, 259224, 259226, 259228-259233, 259235-259240, 259247-259253, 259255-259256, 259258-259262, 259265-259267, 259269-259270, 259272-259277, 259280-259283, 259285, 259289-259290, 259293-259295, 259297-259298, 259300-259301, 259303-259305, 259307-259308, 259310-259313, 259315-259316, 259318-259320, 259322, 259324, 259326, 259328, 259331, 259333-259339, 259341-259345, 259347-259353, 259355-259358, 259360-259361, 259363-259366, 259368-259373, 259375-259377, 259379, 259382-259386, 259388, 259391-259392, 259395, 259397-259400, 259402-259404, 259406, 259408-259410, 259413-259416, 259418-259429, 259433-259436, 259439, 259441-259442, 259444-259445, 259447-259448, 259453-259454, 259457, 259460-259461, 259463-259471, 259473, 259476, 259481, 259487-259488, 259491-259494, 259497-259498, 259500, 259502-259504, 259508, 259510-259511, 259514, 259517, 259519-259528, 259530-259531, 259536-259538, 259540-259544, 259546, 259548, 259551-259553, 259555, 259557-259559, 259563-259565, 259568, 259572-259573, 259575-259576, 259578-259579, 259583, 259585-259586, 259588-259589, 259594, 259596-259599, 259601-259602, 259604-259609, 259611-259612, 259614-259615, 259617-259622, 259625-259629, 259633-259639, 259643-259645, 259647, 259650-259651, 259653-259661, 259663-259666, 259670, 259673, 259675, 259677, 259680, 259682, 259684-259686, 259688, 259690-259692, 259694, 259699-259700, 259704, 259708, 259710-259713, 259715, 259717, 259719, 259721-259722, 259725-259726, 259728-259729, 259733, 259735-259736, 259739-259742, 259744-259745, 259747-259748, 259750, 259752, 259754, 259756-259757, 259761-259762, 259764-259766, 259768-259770, 259772, 259774-259778, 259780, 259782, 259784-259788, 259790, 259793, 259795-259797, 259801, 259805-259808, 259812-259814, 259819-259821, 259823, 259827, 259829, 259836-259837, 259839, 259842-259843, 259845-259846, 259848, 259850-259851, 259853-259855, 259857, 259860-259861, 259863-259864, 259869, 259872, 259875-259877, 259879, 259882, 259884-259885, 259887-259888, 259892, 259894-259896, 259898, 259900-259901, 259903, 259906-259908, 259910, 259913, 259917-259918, 259920-259921, 259923-259926, 259929-259930, 259935, 259937-259938, 259941-259942, 259945-259947, 259949, 259951-259953, 259956, 259959, 259961-259980, 259986-259987, 259989-259994, 259996-259997, 259999-260000, 260005-260007, 260009, 260011, 260014-260017, 260020, 260022-260029, 260031-260033, 260035, 260037, 260040, 260042-260050, 260053, 260055, 260058-260059, 260063-260064, 260067-260068, 260070, 260072, 260075-260076, 260078-260082, 260089-260094, 260099, 260101-260105, 260108-260111, 260113-260116, 260118-260119, 260123-260133, 260135-260138, 260141-260146, 260149-260152, 260154, 260156-260158, 260160-260163, 260165, 260168-260170, 260172, 260175-260177, 260179, 260181, 260184-260186, 260189, 260192-260194, 260198, 260200-260209, 260211-260217, 260219, 260221-260225, 260227, 260230-260232, 260234-260239, 260242-260244, 260247-260249, 260251-260252, 260254-260256, 260259-260260, 260262-260263, 260265-260266, 260269, 260274, 260278-260279, 260281-260292, 260294-260298, 260303-260304, 260307-260312, 260314, 260319-260321, 260323-260325, 260329-260332, 260334-260336, 260338-260339, 260342-260343, 260345-260349, 260351-260354, 260357-260361, 260364-260366, 260369-260370, 260373, 260375, 260377-260381, 260384, 260387-260389, 260391-260394, 260396, 260401-260402, 260404, 260406-260407, 260409-260416, 260418-260419, 260422, 260424, 260429-260431, 260433, 260435-260436, 260438-260442, 260444-260448, 260450-260454, 260456-260459, 260461-260463, 260467, 260469-260470, 260472-260474, 260476, 260479, 260482-260483, 260486-260489, 260491-260500, 260503-260506, 260511, 260513, 260516, 260518-260521, 260524-260530, 260533, 260535-260542, 260547, 260549-260552, 260555-260557, 260559-260560, 260564, 260569-260570, 260572-260579, 260581-260584, 260587-260592, 260594, 260596-260597, 260601-260606, 260608, 260612-260614, 260616-260622, 260626-260627, 260629-260634, 260636-260637, 260644, 260646-260649, 260651, 260655, 260657, 260660-260661, 260663-260664, 260666-260672, 260675-260676, 260678, 260680, 260682, 260684, 260686-260688, 260690-260691, 260693-260694, 260696-260697, 260699, 260702-260704, 260706-260710, 260712-260715, 260718, 260720, 260722, 260724-260728, 260732-260735, 260737-260738, 260740-260741, 260743-260747, 260750-260751, 260755, 260757-260759, 260761-260770, 260773-260779, 260781, 260784-260785, 260789-260796, 260800-260801, 260803-260805, 260807-260810, 260812-260814, 260816-260822, 260825-260828, 260831-260832, 260835, 260838-260839, 260841-260847, 260849-260851, 260853, 260855-260861, 260863, 260865, 260867-260868, 260872, 260874, 260878, 260880, 260882-260886, 260888-260894, 260898-260904, 260907-260908, 260911, 260914-260915, 260917, 260919-260925, 260927-260929, 260941-260948, 260950-260951, 260954-260965, 260968-260971, 260974, 260977-260978, 260983-260986, 260990-260994, 260996-260998, 261000-261003, 261005-261006, 261009-261013, 261016-261030, 261032, 261035, 261038-261039, 261041-261044, 261046-261056, 261058-261067, 261069, 261071, 261076-261083, 261085, 261087, 261089-261093, 261095-261096, 261100, 261103, 261105-261106, 261111-261112, 261114-261116, 261119-261120, 261122, 261125-261132, 261134-261135, 261141, 261143-261144, 261146-261150, 261152-261155, 261157-261159, 261161, 261163-261164, 261166-261168, 261170, 261173, 261175-261182, 261184-261188, 261190-261195, 261197-261202, 261204-261205, 261207-261209, 261213, 261215-261235, 261239-261240, 261242-261244, 261246-261247, 261249-261251, 261253-261254, 261256-261259, 261261-261263, 261265-261274, 261276-261277, 261279, 261284-261285, 261288, 261290-261295, 261298, 261302-261304, 261307-261311, 261314-261318, 261321-261324, 261326-261332, 261335-261342, 261345-261349, 261351-261363, 261366-261373, 261376-261377, 261380, 261384-261386, 261390-261391, 261393-261394, 261397-261400, 261402-261404, 261406-261410, 261413-261418, 261420, 261422-261425, 261428-261432, 261434-261437, 261441, 261444-261461, 261463-261464, 261466-261468, 261470, 261472-261473, 261475-261476, 261478-261481, 261484-261486, 261488-261491, 261493, 261495, 261497-261501, 261504, 261507-261508, 261510-261511, 261513, 261515, 261518-261519, 261525, 261532-261534, 261536-261537, 261539-261542, 261546-261549, 261551-261556, 261559, 261563, 261565-261566, 261568-261569, 261571-261572, 261574-261577, 261579, 261581-261583, 261586, 261588-261589, 261591, 261593-261597, 261599, 261601-261604, 261606-261607, 261609-261611, 261613-261620, 261622, 261624-261629, 261631, 261634, 261636-261637, 261639, 261641-261643, 261645, 261647-261649, 261651-261653, 261656, 261658-261659, 261662-261668, 261672, 261674, 261676-261695, 261697-261701, 261705, 261709, 261712-261713, 261715-261718, 261721-261723, 261725-261728, 261730-261742, 261745, 261748, 261750-261751, 261754-261758, 261762, 261764-261769, 261771, 261773, 261776-261779, 261781-261782, 261788, 261790, 261792-261793, 261796-261798, 261800-261805, 261807, 261809-261811, 261813, 261816-261821, 261825-261830, 261832-261836, 261839-261840, 261842, 261844-261847, 261851, 261857, 261859-261862, 261864-261866, 261869-261879, 261881-261884, 261886-261887, 261889-261890, 261892-261894, 261896-261898, 261901-261903, 261905-261906, 261908-261910, 261912, 261915-261917, 261919-261923, 261925-261930, 261932-261936, 261938-261945, 261948-261956, 261959-261964, 261967-261971, 261973-261976, 261978, 261984, 261986-261987, 261992-261996, 262004, 262006-262010, 262012-262015, 262017-262019, 262023, 262025-262029, 262033-262034, 262038, 262041, 262044-262046, 262048-262050, 262054-262062, 262064-262065, 262068-262072, 262075, 262077-262079, 262081-262089, 262091, 262097, 262105-262107, 262110-262112, 262114-262115, 262118, 262120, 262122-262129, 262131-262134, 262136-262137, 262139, 262142, 262145-262147, 262150-262154, 262156, 262158, 262161, 262163-262164, 262167-262169, 262171-262174, 262177-262178, 262184, 262187-262189, 262191-262192, 262194-262198, 262200-262201, 262203-262206, 262208-262209, 262212, 262216-262221, 262225, 262228, 262230-262237, 262239, 262241-262242, 262245, 262250-262253, 262255-262256, 262262-262263, 262265, 262268-262269, 262273, 262275, 262277-262281, 262284-262288, 262290-262293, 262295, 262298-262300, 262302-262307, 262309-262311, 262314-262315, 262317-262319, 262323-262328, 262330-262333, 262338-262347, 262349, 262351-262352, 262354-262360, 262363-262364, 262367-262368, 262372, 262377, 262380, 262385-262387, 262393-262398, 262401-262403, 262409-262413, 262423-262424, 262426, 262428-262430, 262433-262439, 262441-262442, 262445-262446, 262448-262451, 262453-262455, 262457-262458, 262461-262464, 262466, 262468-262470, 262472-262473, 262476, 262478-262481, 262483-262492, 262498, 262501, 262504-262505, 262507, 262509-262510, 262513, 262515-262520, 262523, 262526-

262528, 262530, 262533-262534, 262536-262537, 262542-262543, 262545, 262548, 262550, 262554-262555, 262557-262558, 262560, 262562-262563, 262565, 262571-262573, 262576-262581, 262583-262585, 262589, 262592-262595, 262603-262604, 262607-262610, 262612-262624, 262626-262630, 262632, 262634, 262640-262642, 262645, 262647-262655, 262657, 262659-262668, 262670, 262672-262674, 262676-262679, 262683-262684, 262686-262690, 262694, 262696-262698, 262704, 262707-262710, 262712-262713, 262715, 262717-262718, 262720-262722, 262724, 262726-262731, 262733, 262735-262737, 262739-262740, 262744-262746, 262748, 262750-262754, 262756-262757, 262759-262762, 262764-262769, 262771-262773, 262776-262777, 262780-262782, 262784-262785, 262790-262791, 262793-262796, 262798-262799, 262801-262802, 262804-262806, 262808, 262810, 262812-262813, 262815-262816, 262819-262823, 262827-262829, 262834-262840, 262842, 262847-262848, 262851-262858, 262860-262861, 262864-262870, 262876-262877, 262879-262885, 262887-262890, 262892-262893, 262895, 262897, 262903-262904, 262906, 262913, 262915-262926, 262928, 262931-262933, 262936-262938, 262941-262943, 262945-262946, 262948, 262950, 262952-262954, 262956-262958, 262960-262961, 262963-262966, 262968-262974, 262977-262978, 262981-262982, 262988, 262990-262996, 262998-263000, 263002-263009, 263011-263013, 263015-263019, 263021-263024, 263026, 263028-263032, 263034-263037, 263039, 263041-263042, 263044-263048, 263050-263053, 263056, 263058-263069, 263071-263077, 263081-263082, 263084-263086, 263088, 263090-263095, 263098-263104, 263107, 263109-263110, 263113-263118, 263120, 263123-263124, 263130-263131, 263133-263134, 263136-263142, 263144, 263146-263147, 263149, 263151-263152, 263154-263156, 263158, 263160, 263162-263165, 263168, 263170-263171, 263174, 263179, 263181, 263185-263187, 263189-263190, 263193-263201, 263204-263206, 263208-263211, 263213-263217, 263219-263220, 263222, 263225-263234, 263236, 263238-263244, 263247-263250, 263253, 263257, 263264-263266, 263268-263270, 263274-263275, 263279-263285, 263289-263297, 263299-263302, 263304-263310, 263312-263313, 263315-263319, 263322, 263324-263331, 263333-263342, 263349-263352, 263354-263355, 263357, 263359, 263362, 263365, 263367-263377, 263379-263385, 263387-263388, 263391-263399, 263403-263404, 263406-263408, 263412-263421, 263423-263425, 263429, 263431, 263433-263434, 263436-263437, 263443, 263445-263446, 263448-263454, 263456, 263462-263463, 263465-263469, 263474-263477, 263479-263485, 263487, 263489-263492, 263494-263496, 263498-263499, 263501, 263503-263504, 263508-263517, 263519-263521, 263525, 263528, 263530-263531, 263533-263534, 263536, 263539, 263542-263556, 263558-263560, 263563, 263565-263570, 263572-263573, 263575, 263578, 263580-263586, 263588-263589, 263591, 263595-263596, 263598-263599, 263602-263608, 263610-263614, 263616-263628, 263630, 263632, 263634-263636, 263638-263639, 263641, 263643-263644, 263646-263647, 263650-263651, 263653, 263655-263659, 263661-263666, 263669-263672, 263674-263681, 263683-263684, 263687-263688, 263691-263693, 263696-263700, 263702-263706, 263709-263710, 263713-263714, 263718, 263720-263721, 263723, 263725-263743, 263746-263753, 263755-263760, 263763-263764, 263769-263779, 263781, 263783-263785, 263787, 263790-263795, 263797-263799, 263802-263805, 263807, 263809-263810, 263814-263823, 263826-263830, 263833-263834, 263836-263837, 263839-263846, 263849-263853, 263855, 263857, 263861-263862, 263864-263865, 263868, 263871-263873, 263875-263880, 263882-263887, 263889-263890, 263893-263895, 263897-263900, 263902-263905, 263907-263908, 263910-263911, 263914-263917, 263919, 263921, 263923, 263926-263927, 263929-263932, 263934-263938, 263940-263945, 263947-263950, 263952-263955, 263958-263971, 263974-263978, 263980-263983, 263985-263988, 263992-263997, 263999-264000, 264002-264004, 264006-264022, 264025-264027, 264029-264032, 264035, 264037, 264039-264042, 264045, 264047-264054, 264056, 264060, 264063-264064, 264066-264067, 264070, 264072, 264075-264081, 264085-264088, 264090-264092, 264094-264097, 264100-264103, 264105, 264108-264117, 264120, 264125, 264127-264129, 264132-264133, 264138-264139, 264142, 264144, 264146-264154, 264157, 264159-264161, 264163-264166, 264169, 264172-264173, 264175-264178, 264180-264181, 264184, 264186-264190, 264192, 264198-264199, 264201-264203, 264205-264207, 264211-264212, 264214-264216, 264218-264229, 264231, 264234-264235, 264238-264239, 264243-264245, 264247-264249, 264251-264256, 264258-264262, 264264-264272, 264276-264278, 264283-264286, 264288-264289, 264292, 264294-264297, 264299-264304, 264306, 264308, 264310-264312, 264314-264316, 264318-264319, 264321-264322, 264324-264325, 264327, 264329, 264333, 264337, 264339, 264341, 264343-264345, 264349-264355, 264358-264360, 264362-264363, 264365-264366, 264370-264371, 264373, 264375, 264378-264383, 264386-264388, 264391-264403, 264405, 264408-264409, 264411-264415, 264418, 264420-264421, 264423, 264426, 264428-264430, 264432, 264434-264435, 264438-264440, 264443, 264445, 264447-264450, 264457-264460, 264462-264465, 264467, 264469, 264477-264480, 264482, 264484-264486, 264489-264490, 264496, 264498, 264500-264501, 264503, 264509-264512, 264514-264516, 264519-264521, 264523-264531, 264533, 264537, 264539, 264541-264542, 264545, 264547, 264549-264553, 264556, 264559, 264561, 264564-264567, 264569-264570, 264573-264577, 264584, 264587-264590, 264592, 264594-264600, 264602, 264604, 264607-264608, 264614-264619, 264623-264624, 264626, 264630-264632, 264635, 264641-264646, 264648, 264650, 264652, 264656, 264658, 264660-264661, 264663, 264666, 264668, 264670, 264672, 264674-264677, 264679-264680, 264684-264687, 264691-264692, 264697-264700, 264703, 264707, 264711-264714, 264716-264717, 264719-264720, 264723, 264725, 264728-264731, 264734, 264736-264737, 264740-264741, 264744-264747, 264750, 264752, 264754, 264756-264759, 264761-264766, 264768-264770, 264772-264774, 264777-264781, 264783-264786, 264788, 264791-264792, 264794, 264797, 264799-264804, 264807-264809, 264811-264819, 264821-264823, 264825-264827, 264830-264834, 264836, 264841-264843, 264845-264851, 264856-264860, 264862-264865, 264868, 264871, 264873-264874, 264877, 264880, 264883-264884, 264887, 264891-264892, 264895-264901, 264905, 264908, 264910-264912, 264914-264917, 264919-264920, 264922, 264924-264926, 264929, 264932, 264934-264936, 264939-264943, 264945-264952, 264954, 264956-264957, 264959-264960, 264964, 264966-264967, 264970-264975, 264978-264979, 264981, 264983, 264986-264988, 264990-264995, 264998-265002, 265005, 265007-265015, 265017-265027, 265033-265036, 265039, 265042-265043, 265046-265047, 265051-265052, 265054-265055, 265057, 265059, 265063-265065, 265067, 265069, 265071-265072, 265074-265084, 265086-265097, 265099-265102, 265106-265107, 265109-265112, 265116-265117, 265119-265124, 265126, 265128-265134, 265136-265138, 265140-265142, 265144-265145, 265148-265151, 265153-265154, 265158, 265160-265161, 265163-265164, 265166-265176, 265178-265180, 265182-265185, 265187-265189, 265191, 265194-265196, 265198-265201, 265206-265209, 265211-265213, 265215, 265217-265220, 265224-265231, 265233-265234, 265238, 265240-265244, 265247-265248, 265250-265254, 265257-265262, 265264-265267, 265269, 265271-265274, 265276, 265278-265282, 265284-265285, 265287, 265289-265290, 265293-265298, 265300-265313, 265316-265319, 265321, 265324, 265326-265331, 265333-265335, 265338-265340, 265350-265352, 265354-265355, 265358, 265360-265362, 265364-265365, 265369-265375, 265377-265380, 265383-265389, 265391-265393, 265395, 265397-265399, 265401-265404, 265406-265408, 265410, 265412, 265414, 265417, 265419-265423, 265425-265434, 265436, 265438-265439, 265441, 265443-265447, 265453-265454, 265456, 265458-265464, 265468-265472, 265474-265477, 265481, 265484-265485, 265489-265490, 265492, 265499, 265501, 265503, 265505-265510, 265512-265515, 265517, 265520-265523, 265525-265528, 265533, 265535, 265537-265539, 265542-265543, 265545-265546, 265548-265550, 265553-265560, 265563, 265565, 265567, 265569-265574, 265576, 265578, 265583, 265585, 265587-265593, 265596, 265598, 265601-265603, 265605, 265607-265613, 265616-265617, 265619-265621, 265623-265627, 265629, 265631-265634, 265636-265650, 265653-265659, 265661-265664, 265668, 265670, 265674, 265677, 265679-265680, 265682-265687, 265689-265693, 265695-265703, 265705, 265708-265711, 265713-265720, 265723-265727, 265729-265732, 265734-265738, 265742-265743, 265745-265750, 265753-265756, 265758, 265761-265762, 265764-265769, 265771-265772, 265774-265783, 265785-265793, 265795-265797, 265799, 265802, 265804-265808, 265810-265818, 265820, 265822-265824, 265827-265831, 265833, 265835-265841, 265844-265845, 265847-265852, 265854, 265856, 265859-265860, 265864-265865, 265867-265870, 265872-265879, 265884-265891, 265895-265896, 265899, 265902-265903, 265905, 265909-265910, 265914-265916, 265918, 265920, 265925-265930, 265933-265945, 265951-265952, 265954-265958, 265960, 265963-265964, 265973-265974, 265976, 265978-265983, 265985-265988, 265991-265992, 265994-265995, 265998-265999, 266001-266005, 266008-266010, 266012, 266014, 266016, 266019-266021, 266023-266030, 266033, 266035-266038, 266040-266041, 266043, 266045, 266047-266050, 266052-266053, 266055, 266058, 266060-266064, 266067, 266070-266075, 266078, 266081, 266083, 266087, 266090-266095, 266097-266098, 266102-266104, 266114-266116, 266118-266120, 266123, 266125-266126, 266128-266132, 266134, 266137, 266139, 266141, 266144-266146, 266148-266149, 266152, 266155-266157, 266159-266167, 266169, 266172-266174, 266176-266178, 266180, 266183-266185, 266187-266189, 266192, 266194, 266197-266199, 266201-266202, 266206, 266210, 266212, 266214-266215, 266217-266220, 266222-266230, 266232, 266234-266236, 266239-266241, 266243-266258, 266260-266262, 266264-266267, 266269-266273, 266275-266276, 266278, 266281, 266283, 266288, 266291-266292, 266295-266296, 266298, 266303, 266305-266307, 266309-266310, 266313-266314, 266317, 266319-266320, 266322, 266325, 266327-266334, 266337-266340, 266344, 266346, 266348, 266350-266359, 266361, 266364-266366, 266369-266371, 266373-266374, 266376, 266378, 266380, 266383-266385, 266387-266389, 266391-266393, 266395, 266398-266407, 266412, 266414-266422, 266426-266427, 266430, 266432-266446, 266449, 266452, 266454, 266456-266459, 266461, 266464-266468, 266470-266471, 266473-266474, 266477-266478, 266480-266487, 266492, 266494, 266496-266501, 266503, 266508, 266510-266511, 266513, 266515-266516, 266518-266521, 266523-266525, 266527, 266532-266533, 266535-266541, 266545-266546, 266548-266551, 266553, 266555, 266557, 266562-266563, 266565-266569, 266572, 266575-266580, 266582-266586, 266588, 266590-266593, 266595-266596, 266598, 266601-266602, 266604-266606, 266610, 266612, 266614-266616, 266618-266619, 266621-266622, 266624-266634, 266636-266640, 266643, 266645-266647, 266651, 266654, 266657, 266659-266662, 266664, 266666-266667, 266669-266672, 266675-266677, 266680, 266683-266685, 266688-266690, 266692-266695, 266697-266702, 266704, 266707, 266709-266711, 266714-266716, 266718-266724, 266728, 266730-266733, 266735-266744, 266746, 266748-266756, 266759-266760, 266764-266766, 266768-266769, 266771-266773, 266775-266776, 266778-266780, 266782-266784, 266787-266788, 266790-266791, 266793, 266795, 266797, 266800-266805, 266807-266808, 266811-266812, 266814-266819, 266821-266823, 266825-266826, 266828, 266830, 266832-266834, 266836, 266838-266840, 266843, 266845, 266847-266848, 266850-266851, 266853-266854, 266857-266858, 266860, 266863-266864, 266866-266871, 266874, 266882, 266884, 266886, 266890-266892, 266895-266897, 266900, 266904, 266906-266908, 266911-266912, 266914, 266921-266935, 266937, 266939, 266941-266942, 266944, 266946-266950, 266952-266954, 266956-266957, 266960, 266962-266970, 266972, 266974-266978, 266980-266983, 266988, 266991, 266994, 266997, 266999-267002, 267005-267008, 267011, 267013-267019, 267021, 267024-267025, 267027-267028, 267030-267035, 267041-267043, 267045-267046, 267049, 267051, 267053, 267057, 267063-267064, 267067, 267069-267073, 267075-267078, 267081, 267084-267085, 267088, 267091, 267093, 267095, 267098-267099, 267101-267102, 267104, 267108, 267115, 267120-267122, 267124-267125, 267127-267134, 267138-267140, 267142, 267149, 267152, 267155-267156, 267158-267163, 267165, 267171-267178, 267180-267182, 267187-267188, 267190-267193, 267196-267197, 267201, 267203, 267205-267208, 267211-267216, 267218, 267220, 267222-267223, 267225-267226, 267229-267231, 267233, 267237, 267239-267242, 267245-267251, 267256, 267258-267260, 267262, 267264-267266, 267268-267271, 267275, 267278-267280, 267283-267284, 267287, 267290-267295, 267298-267301, 267304-267305, 267307, 267309-267314, 267317, 267319, 267321, 267323-267325, 267327-267333, 267335-267336, 267339, 267342-267348, 267352-267356, 267358-267359, 267361, 267363-267364, 267366-267368, 267372-267376, 267378-267379, 267381-267382, 267384-267386, 267390-267391, 267393-267394, 267396-267401, 267404-267405, 267407, 267409, 267411, 267414, 267416-267424, 267426-267427, 267430-267432, 267437, 267439-267443, 267448, 267450-267452, 267454-267460, 267463-267469, 267471-267475, 267477, 267479-267482, 267487-267492, 267495-267498, 267500-267501, 267503, 267505, 267507, 267509-267513, 267515, 267518-267526, 267528, 267530, 267532-267533, 267535, 267539, 267541-267542, 267544, 267546, 267553-267554, 267556, 267559-267560, 267562-267564, 267568, 267570, 267574-267580, 267584-267585, 267587, 267592, 267598-267599, 267601-267610, 267612-267613, 267615-267616, 267618-267620, 267623, 267625-267626, 267628-267629, 267631-267632, 267635-267641, 267645, 267648, 267650-267653, 267656-267659, 267661-267662, 267664-267666, 267668, 267670, 267672, 267676-267678, 267680-267681, 267684-267685, 267688-267691, 267695-267699, 267701-267704, 267706, 267708-267718, 267721-267724, 267726-267727, 267730-267731, 267735, 267740-267742, 267745, 267747-267748, 267752, 267759-267762, 267764-267765, 267769-267776, 267778-267782, 267784-267785, 267787-267789, 267793-267794, 267796-267802, 267804, 267806-267811, 267814, 267816, 267818-267820, 267822, 267824-267827, 267829-267830, 267832, 267834-267839, 267841-267847, 267850, 267853-267854, 267856-267861, 267865-267866, 267870, 267872-267879, 267881, 267883-267885, 267889-267890, 267892-267895, 267897, 267899-267901, 267904-267908, 267910-267912, 267915, 267917-267919, 267922, 267924-267929, 267932, 267934-267938, 267941-267944, 267946-267954, 267956, 267958-267959, 267961, 267965, 267967-267968, 267970, 267972-267973, 267975-267976, 267979-267981, 267983-267984, 267986-267989, 267991-267994, 267997, 267999, 268001, 268003-268006, 268009, 268011, 268013, 268016-268018, 268020, 268022, 268024-268027, 268029-268036, 268040, 268042, 268046-268049, 268051-268053, 268055-268057, 268059, 268062-268063, 268065-268070, 268072-268073, 268075-268081, 268084-268085, 268088-268090, 268094, 268096-268097, 268103, 268107, 268116, 268119-268123, 268125-268126, 268128, 268130-268132, 268134-268135, 268138-268140, 268142-268146, 268148-268150, 268152-268155, 268159-268165, 268167-268169, 268176-268178, 268180-268183, 268188-268190, 268195-268196, 268198-268202, 268205-268213, 268215, 268218-268220, 268222, 268224-268234, 268237-268238, 268243, 268248, 268250-268252, 268254, 268256-268261, 268263, 268265-268266, 268269-268270, 268273-268274, 268280, 268282-268286, 268288-268291, 268293, 268296-268298, 268301-268302, 268304-268305, 268307, 268309-268312, 268314-268315, 268317, 268319-268320, 268324-268328, 268331, 268333, 268335-268336, 268338-268342, 268344-268345, 268347-268348, 268350, 268353-268354, 268356, 268358-268359, 268361, 268364-268365, 268367-268369, 268373, 268375-268376, 268378-268380, 268382-268391, 268396-268399, 268402-268405, 268407, 268409, 268412, 268414, 268416-268419, 268421-268427, 268429-268432, 268434, 268436, 268438-268440, 268444-268447, 268452-268453, 268455, 268457, 268460-268465, 268467-268468, 268470, 268472-268476, 268478-268480, 268482-268483, 268486-268487, 268489, 268492-268498, 268500-268505, 268507, 268509, 268511-268514, 268517, 268519-268526, 268529-268530, 268532-268536, 268539-268540, 268543, 268547, 268549-268552, 268555, 268557, 268561, 268563, 268565-268566, 268568-268571, 268573-268574, 268576-268578, 268581-268584, 268588-268591, 268596-268599, 268602-268604, 268607-268608, 268611, 268613-268624, 268626-268628, 268631, 268633-268637, 268639-268641, 268644-268645, 268647-268652, 268654-268656, 268658-268666, 268668-268669, 268671-268672, 268674-268676, 268679, 268681-268687, 268689, 268693, 268696-268697, 268703, 268708, 268712, 268715, 268718-268721, 268723-268726, 268728-268731, 268733, 268739, 268742, 268744-268746, 268749-268750, 268756, 268758-268760, 268762-268764, 268768, 268773-268785, 268787-268788, 268790, 268792-268795, 268797-268798, 268804-268807, 268812, 268814-268815, 268817, 268819-268820, 268822, 268826-268827, 268829, 268831-268833, 268835-268837, 268841, 268843-268847, 268852-268853, 268856-268858, 268861-268862, 268864, 268867-268869, 268871-268873, 268875, 268881-268882, 268886-268891, 268894-268903, 268905-268906, 268909-268912, 268917-268918, 268920, 268923, 268925-268928, 268930-268931, 268933-268934, 268937, 268939-268941, 268943-268945, 268948, 268950, 268953, 268955, 268957, 268962, 268964-268966, 268970, 268974, 268976, 268978-268982, 268985-268988, 268990-268995, 268999, 269002-269005, 269007-269010, 269012-269013, 269015, 269018-269019, 269021-269026, 269028-269030, 269032, 269038-269044, 269047-269050, 269052, 269055-269058, 269060, 269062-269063, 269065-269070, 269074-269078, 269080, 269082-269085, 269089-269092, 269094-269095, 269097-269105, 269108, 269110-269111, 269113-269116, 269120-269121, 269123-269124, 269126, 269129-269134, 269136-269138, 269140-269144, 269147-269150, 269154-269155, 269158-269160, 269163-269164, 269166-269168, 269170-269174, 269176-269177, 269179, 269181-269183, 269185, 269187, 269190, 269193-269199, 269202-269207, 269209-269212, 269214-269217, 269219, 269222-269226, 269228, 269232-269233, 269235, 269237, 269239, 269241-269248, 269250, 269254, 269258-269261, 269263-269265, 269267, 269269-269280, 269287-269295, 269298-269302, 269305-269308, 269311-269313, 269315-269327, 269329-269331, 269334, 269339-269341, 269343-269345, 269348-269350, 269352, 269354-269356, 269359-269361, 269363, 269366-269367, 269372-269374, 269376-269378, 269380-269385, 269387-269388, 269390-269391, 269394-269395, 269397-269400, 269402, 269404-269413, 269416-269421, 269423, 269425, 269427-269432, 269434-269441, 269443-269444, 269447, 269449-269450, 269452-269456, 269458, 269460-269461, 269463-269465, 269467, 269469-269471, 269473, 269475-269478, 269481-269483, 269485-269489, 269491-269493, 269495-269496, 269499, 269503-269506, 269508-269509, 269511, 269513-269515, 269517-269523, 269525, 269527, 269530-269534, 269536, 269539, 269542, 269544-269546, 269549-269551, 269553-269554, 269560, 269562, 269566-269572, 269577-269579, 269581-269592, 269594, 269597-269602, 269604-269606, 269609-269610, 269612-269613, 269617, 269620-269622, 269628-269629, 269635-269636, 269639, 269641, 269645-269646, 269648-269650, 269652, 269655-269657, 269659, 269662-269666, 269668, 269670-269673, 269675-269676, 269678-269679, 269681-269684, 269686-269687, 269689-269690, 269693, 269696, 269699-269702, 269705-269706, 269709, 269711, 269714-269719, 269721, 269725-269728, 269731, 269733-269744, 269746-269748, 269753-269754, 269756, 269762, 269764, 269766-269767, 269769-269770, 269772-269778, 269780-269783, 269786-269790, 269792, 269795-269796, 269798-269802, 269804-269805, 269807-269808, 269810-269817, 269819-269820, 269822, 269824, 269826-269828, 269830-269831, 269833-269834, 269837-269848, 269850, 269852-269858, 269860-269861, 269863-269865, 269867, 269870-269871, 269873-269875, 269879-269881, 269884, 269886, 269890, 269892, 269894, 269896, 269900-269907, 269909-269917, 269919-269925, 269929-269932, 269934-269935, 269937-269938, 269940-269942, 269945-269946, 269948, 269952, 269957, 269961-269962, 269964-269969, 269971, 269974, 269976-269977, 269980-269981, 269985-269987, 269989, 269991, 269994-269996, 269998-270001, 270003-270007, 270009-270010, 270013-270014, 270018-270026, 270029-270030, 270032-270039, 270043-270046, 270048-270051, 270053-270054, 270056-270057, 270061-270062, 270064, 270066-270068, 270070-270072, 270074-270078, 270083, 270087, 270090-270097, 270099, 270101-270102, 270107, 270111-270114, 270117-270120, 270122-270123, 270126-270127, 270129-270130, 270132-270136, 270139, 270143, 270145-270147, 270149-270153, 270155-270156, 270159-270172, 270174-270177, 270180-270187, 270189, 270191, 270194, 270196, 270200-270201, 270204-270205, 270207-270208, 270213-270215, 270217-270219, 270221-270226, 270229-270241, 270244, 270246, 270250, 270254-270256, 270258-270259, 270261-270268, 270272, 270275-270284, 270286-270292, 270295-270296, 270298, 270300, 270305-270307, 270309-270316, 270321, 270324-270325, 270327, 270329-270330, 270333-270339, 270342-270352, 270354-270358, 270360, 270362-270368, 270370-270373, 270375-270377, 270380-270381, 270383, 270385-270390, 270395-270397, 270399, 270402-270406, 270410-270411, 270413, 270416-270420, 270426-270429, 270431, 270433-270438, 270440-270443, 270446, 270450, 270452, 270454, 270456-270457, 270459-270462, 270464-270466, 270469-270471, 270473-270477, 270479-270483, 270485, 270487-270501, 270503-270507, 270511-270516, 270518-270520, 270523-270529, 270533-270535, 270538-270539, 270541-270550, 270552, 270554, 270556, 270558-270559, 270562-270569, 270573-270583, 270585, 270587-270588, 270591-270598, 270600-270607, 270610, 270612, 270618-270619, 270622, 270625, 270627-270636, 270638-270643, 270645, 270647-270670, 270677-270681, 270684-270688, 270691, 270693-270694, 270701, 270703, 270705-270711, 270713-270715, 270717-270718, 270720, 270722-270723, 270726, 270730-270733, 270735-270737, 270739-270740, 270742-270744, 270746-270747, 270749-270751, 270753-270755, 270757-270759, 270761, 270763-270768, 270771, 270774-270777, 270779-270780, 270782-270790, 270792, 270796-270801, 270806-270807, 270809-270815, 270817-270818, 270820, 270822, 270824-270825, 270834, 270836, 270838-270840, 270843-270846, 270848-270851, 270853-270858, 270863-270864, 270868-270870, 270872-270874, 270876-270878, 270880-270885, 270887-270889, 270891-270894, 270896-270897, 270899, 270901, 270903-270909, 270911, 270913, 270916, 270918, 270920, 270922-270928, 270930-270932, 270934, 270940, 270946, 270948-270951, 270954, 270956-270965, 270967, 270970-270972, 270974, 270976-270978, 270981-270988, 270990-270993, 270996-271005, 271008-271010, 271013-271016, 271018, 271020, 271023, 271026-271029, 271031-271032, 271038, 271040-271042, 271044-271046, 271051-271052, 271054, 271056-271063, 271066, 271068, 271072, 271074-271076, 271078-271080, 271083, 271086-271092, 271094-271107, 271109, 271111-271112, 271114, 271117-271121, 271124, 271126-271137, 271139, 271141-271142, 271144-271148, 271151, 271153-271163, 271165-271166, 271169-271170, 271172, 271174-271176, 271178-271189, 271191-271195, 271199-271200, 271202-271203, 271206, 271208-271211, 271215, 271219-271220, 271222-271227, 271229-271231, 271233-271234, 271236, 271238-271240, 271242-271243, 271249-271252, 271254-271255, 271257, 271261-271265, 271267-271268, 271270, 271272, 271275-271277, 271279, 271283, 271285-271286, 271288-271289, 271291-271293, 271295, 271297, 271300, 271302, 271306-271325, 271327, 271329, 271332, 271334, 271338-271341, 271345, 271347-271348, 271350, 271353-271354, 271357, 271359, 271361-271362, 271364-271365, 271367, 271369-271372, 271374-271375, 271377-271378, 271386-271398, 271400-271402, 271404-271406, 271408, 271410-271412, 271415-271423, 271425, 271429, 271431-271434, 271436-271439, 271441-271448, 271450, 271452-271454, 271456-271457, 271464-271475, 271477-271479, 271481, 271484, 271488-271489, 271491-271494, 271496-271498, 271500-271501, 271504, 271507, 271509-271529, 271531, 271533-271534, 271536-271537, 271539-271540, 271542, 271544, 271546-271547, 271549, 271551-271553, 271556, 271558, 271561-271565, 271567, 271569-271573, 271575-271586, 271588, 271590-271595, 271597-271604, 271606-271607, 271609-271613, 271615-271620, 271623-271628, 271630, 271632-271635, 271638-271639, 271642-271644, 271647-271651, 271654, 271656-271660, 271663-271664, 271666, 271668-271671, 271673, 271676-271680, 271682, 271684-271687, 271689-271703, 271705-271706, 271709-271712, 271714, 271716, 271719, 271721, 271723, 271726-271732, 271734, 271736, 271739-271740, 271742, 271744, 271746, 271748, 271750-271755, 271757-271762, 271764-271767, 271770-271773, 271777-271781, 271784-271788, 271790, 271796-271801, 271804-271808, 271810, 271813-271817, 271820-271822, 271826, 271829, 271832-271833, 271836, 271839-271840, 271842-271845, 271847, 271849-271851, 271854-271856, 271860-271862, 271864, 271867-271873, 271876, 271879, 271881-271885, 271887, 271889-271891, 271893, 271897, 271899-271900, 271902, 271905, 271908, 271910, 271912, 271915-271922, 271924, 271926, 271928, 271930, 271932-271933, 271935, 271939-271947, 271950-271953, 271956-271963, 271965-271974, 271976-271979, 271981-271982, 271984-271985, 271988-271990, 271992-271994, 272000-272001, 272003-272010, 272012-272014, 272016, 272022-272023, 272025-272026, 272029-272036, 272038-272039, 272041-272043, 272045-272047, 272050, 272053, 272056, 272059, 272061, 272063-272066, 272068-272076, 272078-272081, 272083, 272085, 272087-272091, 272093-272095, 272097-272099, 272102-272103, 272105, 272107-272108, 272110-272114, 272116, 272118-272120, 272122-272123, 272129, 272131-272133, 272135-272136, 272138, 272141-272143, 272145, 272148-272149, 272151, 272157-272158, 272161-272171, 272173, 272178-272183, 272185, 272188-272189, 272191, 272195, 272198-272201, 272203-272204, 272207-272208, 272210-272212, 272215-272218, 272220, 272225-272226, 272228-272232, 272238, 272240-272244, 272246-272248, 272250-272259, 272262-272264, 272267, 272271-272277, 272280-272296, 272298-272300, 272302-272310, 272315, 272317-272322, 272326-272327, 272329-272330, 272332, 272336, 272342, 272345, 272347-272351, 272353, 272355-272356, 272358-272363, 272366-272368, 272370-272375, 272377-272378, 272380-272382, 272390-272391, 272393, 272395, 272397, 272399-272404, 272406-272407, 272409-272411, 272413-272414, 272417-272422, 272424, 272426, 272428, 272430, 272437-272441, 272443, 272445-272447, 272450-272451, 272456, 272458-272460, 272462-272466, 272469, 272472-272474, 272476, 272483, 272485, 272487-272488, 272491-272492, 272495-272496, 272498-272499, 272501-272506, 272509-272511, 272513-272515, 272517, 272521, 272524-272525, 272527, 272531-272533, 272535, 272537, 272539-272541, 272544, 272548, 272550-272555, 272557-272558, 272562, 272566, 272568, 272572, 272575-272576, 272578-272588, 272593-272595, 272598-272599, 272602-272603, 272607, 272609, 272611-272616, 272620, 272622, 272624, 272626-272629, 272631, 272636, 272638-272641, 272644-272645, 272650-272653, 272656, 272658, 272666, 272669, 272675-272676, 272679-272680, 272683, 272686-272687, 272689, 272694, 272697, 272702-272716, 272718-272721, 272723-272726, 272730, 272732-272733, 272735, 272737-272740, 272744-272747, 272749-272753, 272756-272759, 272761-272773, 272775, 272777-272779, 272781, 272783-272784, 272786-272793, 272795-272797, 272799-272800, 272802-272803, 272806-272807, 272809-272816, 272818, 272823-272837, 272839, 272844, 272846, 272848, 272850-272855, 272857, 272862-272863, 272872-272873, 272875-272877, 272879, 272881, 272883-272884, 272886, 272888, 272890-272894, 272896-272898, 272900, 272904-272907, 272912, 272914-272917, 272923-272926, 272928-272930, 272935-272944, 272946, 272948, 272951-272952, 272956-272959, 272961-272962, 272966, 272968-272972, 272975-272977, 272979, 272981-272982, 272984, 272989, 272991-272994, 272997-272999, 273001-273009, 273011-273017, 273020-273025, 273027, 273030-273033, 273035, 273037, 273041, 273043, 273047, 273050-273051, 273053-273055, 273058-273059, 273061, 273064-273069, 273071, 273075, 273079, 273082, 273085-273089, 273092-273094, 273098, 273100, 273103, 273106-273108, 273110-273111, 273113-273118, 273120, 273122, 273124-273130, 273132-273133, 273135-273139, 273141-273144, 273146, 273151, 273153-273155, 273157-273162, 273168, 273172-273173, 273177-273179, 273181, 273183-273184, 273186-273188, 273190-273192, 273196-273208, 273210, 273213, 273215-273219, 273221, 273224-273225, 273227, 273230-273240, 273242-273243, 273246, 273249, 273251-273253, 273255-273256, 273259-273266, 273271-273272, 273274, 273276, 273278-273281, 273284-273286, 273289-273290, 273293-273297, 273299-273301, 273303, 273305-273309, 273312-273316, 273318-273322, 273324, 273328-273334, 273337-273341, 273343-273344, 273346-273347, 273349-273350, 273352-273355, 273357, 273359-273362, 273365-273366, 273368, 273371-273384, 273386-273387, 273389-273390, 273397-273399, 273401-273407, 273417-273422, 273424, 273427-273429, 273431-273432, 273436, 273438-273440, 273442-273447, 273449-273450, 273452-273456, 273460, 273463, 273466, 273469, 273475-273484, 273487-273489, 273491, 273494-273498, 273501-273508, 273510, 273513, 273518, 273520-273521, 273524, 273529-273530, 273532-273537, 273539, 273542, 273545-273548, 273550, 273552-273553, 273556-273558, 273563, 273567-273569, 273571-273572, 273574-273585, 273588, 273590-273591, 273593, 273595-273600, 273602-273603, 273606, 273608-273609, 273612-273613, 273615, 273617-273620, 273622-273623, 273625, 273627, 273632-273633, 273635-273641, 273643, 273646, 273648, 273650, 273652, 273655, 273657, 273659-273663, 273665-273667, 273669, 273671-273672, 273674, 273678, 273680, 273682-273684, 273688, 273690-273696, 273698-273701, 273703, 273705-273707, 273710-273714, 273716, 273721, 273723-273724, 273726-273729, 273731-273732, 273734-273735, 273737-273740, 273742-273747, 273750-273751, 273753, 273755-273756, 273758, 273760-273762, 273764-273770, 273773-273774, 273776-273782, 273786-273791, 273793, 273795-273797, 273800, 273803-273804, 273809, 273811-273821, 273826-273832, 273837, 273839-273841, 273843-273846, 273848, 273851-273856, 273858-273860, 273862-273864, 273866-273867, 273869-273871, 273873-273878, 273881-273882, 273884-273886, 273889-273894, 273896-273906, 273908, 273910-273913, 273915-273917, 273920, 273923-273925, 273927, 273929-273931, 273933, 273936-273941, 273947, 273949-273952, 273954-273958, 273960, 273962-273963, 273966-273971, 273973-273978, 273980-273983, 273985-273988, 273990, 273992-273993, 273995, 273999, 274001-274002, 274004, 274006, 274011, 274013-274014, 274018-274020, 274024, 274028-274033, 274035-274041, 274043-274046, 274048-274049, 274051-274069, 274071, 274073-274075, 274077, 274082-274086, 274088-274089, 274091-274100, 274103, 274106, 274109-274111, 274114-274117, 274121-274125, 274128-274129, 274131-274132, 274135, 274138, 274140, 274143-274146, 274148-274154, 274157, 274160-274161, 274163, 274169, 274172-274175, 274178-274185, 274187-274197, 274200-274203, 274206-274221, 274223-274226, 274229, 274231-274233, 274235, 274237-274240, 274243, 274245, 274247-274252, 274254-274255, 274258, 274260, 274262-274265, 274268, 274270-274272, 274276-274279, 274282-274286, 274288-274289, 274291, 274294-274300, 274302-274303, 274306-274323, 274325, 274327, 274330, 274332-274339, 274341, 274343, 274345-274347, 274349-274357, 274359, 274361-274370, 274373-274374, 274377-274379, 274382, 274384, 274386-274387, 274390-274392, 274395, 274398, 274402-274406, 274408-274410, 274413-274414, 274416-274428, 274432-274437, 274440, 274444, 274446-274447, 274450-274453, 274455-274458, 274461-274462, 274464, 274467-274470, 274472, 274474-274475, 274477-274478, 274480-274481, 274483-274484, 274486, 274489-274492, 274494-274500, 274502-274506, 274508, 274512, 274515, 274519-274521, 274523, 274527, 274529-274534, 274536-274544, 274546-274547, 274549, 274551, 274553-274556, 274558-274572, 274574-274577, 274580-274581, 274584, 274586-274589, 274592, 274594-274596, 274598, 274600, 274605, 274608-274609, 274611-274613, 274619-274620, 274623-274627, 274629, 274631-274632, 274635-274636, 274638-274639, 274644, 274648-274651, 274653-274655, 274659, 274661-274663, 274665, 274667-274668, 274673-274679, 274681, 274683, 274686, 274689, 274694-274699, 274701-274703, 274705, 274708, 274710-274712, 274717, 274722-274723, 274730-274731, 274734-274737, 274739, 274743-274745, 274747-274750, 274752, 274757, 274761-274766, 274768-274772, 274778, 274780, 274782, 274784, 274789-274791, 274793-274801, 274803-274804, 274807-274808, 274810-274811, 274813-274815, 274821-274825, 274828, 274831-274832, 274837-274843, 274849, 274851, 274854, 274856, 274860, 274862, 274864-274866, 274869, 274872-274873, 274875, 274878-274883, 274885, 274888-274889, 274891, 274896-274901, 274903-274906, 274908, 274910-274911, 274914-274915, 274919-274921, 274923, 274925-274928, 274930, 274932, 274937-274946, 274948, 274950, 274952, 274954-274957, 274959-274963, 274966-274967, 274969-274976, 274978, 274980-274986, 274990, 274992, 274997-274998, 275001-275002, 275007-275008, 275011-275015, 275017-275021, 275023, 275025, 275031-275034, 275037, 275045, 275048, 275051, 275053, 275055, 275057, 275059-275061, 275063, 275068-275070, 275074-275076, 275078, 275081-275082, 275084, 275086-275096, 275098-275100, 275103-275104, 275108-275112, 275118-275125, 275127-275133, 275135-275138, 275142-275144, 275147-275149, 275151, 275157-275161, 275163-275166, 275170, 275174-275175, 275179, 275181-275182, 275184-275185, 275188-275192, 275194-275195, 275197-275199, 275202-275206, 275208-275210, 275212, 275214-275216, 275221-275224, 275228, 275230-275232, 275234-275235, 275238-275243, 275245-275252, 275256-275257, 275259, 275262-275263, 275266, 275268-275269, 275271-275276, 275279-275285, 275287-275289, 275293, 275295-275304, 275306-275308, 275311, 275316-275320, 275322-275326, 275328, 275330, 275332, 275335-275341, 275343-275347, 275351-275352, 275354-275359, 275361-275364, 275366-275369, 275371, 275375, 275378-275380, 275382-275386, 275388-275391, 275393-275394, 275396-275402, 275407, 275411-275418, 275422-275430, 275434, 275437-275439, 275442, 275446-275449, 275451, 275453-275456, 275458, 275461-275464, 275466-275467, 275469-275475, 275477-275478, 275480-275486, 275488-275489, 275492, 275494-275495, 275497-275500, 275502-275503, 275505-275507, 275512, 275514-275520, 275522-275531, 275533-275534, 275536-275539, 275544, 275546, 275548-275553, 275555-275558, 275562-275563, 275568-275572, 275575-275578, 275582, 275585-275589, 275591-275595, 275597, 275602, 275604-275606, 275611-275612, 275617-275619, 275622-275639, 275641-275644, 275647-275648, 275650, 275652-275653, 275655, 275657-275658, 275660, 275662, 275664-275668, 275670, 275673-275675, 275677, 275683, 275685, 275691, 275697, 275700, 275703, 275715-275723, 275726-275727, 275729-275731, 275733-275734, 275737, 275739, 275741, 275743-275744, 275748-275749, 275751-275755, 275757-275761, 275763-275765, 275768, 275771-275772, 275774-275777, 275779-275781, 275783, 275785-275788, 275790-275793, 275795-275796, 275799-275807, 275809-275812, 275814-275819, 275821-275823, 275825-275833, 275835, 275838-275839, 275842, 275844-275846, 275848, 275850, 275852-275853, 275856-275860, 275863-275864, 275866-275869, 275871-275873, 275875, 275877, 275879-275886, 275888-275890, 275892-275893, 275895-275896, 275901-275907, 275909-275911, 275914-275917, 275924, 275926-275929, 275931-275935, 275937-275938, 275941, 275943, 275945-275951, 275953-275955, 275958-275963, 275965-275968, 275971-275972, 275974, 275977-275979, 275981, 275983-275986, 275988-275989, 275993-275996, 275998-276008, 276010-276011, 276014-276017, 276022-276024, 276028, 276034-276037, 276039, 276042-276044, 276048-276049, 276051-276060, 276062, 276066-276069, 276071-276073, 276078, 276080-276081, 276085-276094, 276097-276099, 276102-276114, 276116, 276118-276121, 276125, 276127-276132, 276135, 276137-276145, 276153, 276155-276156, 276159-276164, 276166-276169, 276171-276172, 276175-276177, 276180-276182, 276188, 276191-276194, 276196, 276198-276200, 276205-276207, 276210, 276213, 276215-276216, 276219, 276221-276225, 276227-276228, 276230, 276232-276239, 276243-276245, 276249-276252, 276254-276263, 276266-276270, 276272-276278, 276280-276282, 276284-276285, 276287, 276290-276291, 276293-276295, 276298-276300, 276303-276304, 276306-276315, 276318, 276323-276329, 276331, 276333-276335, 276343-276357, 276361, 276363-276370, 276373, 276375-276377, 276379-276382, 276384-276386, 276389, 276391-276392, 276396, 276399-276400, 276402-276409, 276412-276413, 276417-276418, 276420, 276423-276427, 276429-276432, 276434-276436, 276438-276442, 276445-

276446, 276449-276450, 276452-276453, 276455-276456, 276458-276464, 276466-276467, 276469, 276476-276478, 276481-276486, 276488-276492, 276494, 276497-276502, 276504, 276507, 276509-276510, 276512-276514, 276516-276519, 276521, 276523, 276527, 276529, 276531-276533, 276535-276537, 276540, 276542-276546, 276548-276552, 276554, 276556, 276561-276568, 276570, 276572-276581, 276584-276587, 276589, 276591, 276597, 276599-276614, 276620, 276623-276625, 276629-276631, 276634-276638, 276640, 276642-276645, 276647-276656, 276658-276661, 276663, 276667-276668, 276671-276682, 276684, 276686, 276690, 276692, 276694, 276696-276701, 276705-276708, 276712, 276714-276718, 276721, 276723, 276725, 276728, 276730, 276732-276735, 276738-276745, 276747-276753, 276759-276760, 276764, 276767-276770, 276772-276773, 276777-276784, 276786-276789, 276792-276800, 276802-276803, 276806-276808, 276811, 276813-276817, 276819, 276821, 276823, 276825-276828, 276830-276832, 276835-276837, 276840, 276842-276843, 276846, 276849-276852, 276854-276855, 276858, 276860-276863, 276865, 276868-276869, 276872-276881, 276883, 276885-276887, 276889-276892, 276894, 276896-276897, 276899-276900, 276902, 276904-276905, 276909-276914, 276916-276918, 276920, 276922, 276926, 276928, 276931-276932, 276934-276936, 276942-276947, 276951-276952, 276955-276960, 276962-276963, 276966, 276968, 276971-276974, 276977, 276979-276982, 276984-276987, 276989, 276992, 276994, 276997-276999, 277001-277002, 277004-277005, 277009-277015, 277018-277020, 277022-277023, 277028, 277031, 277033-277035, 277037, 277039-277040, 277042-277043, 277047-277052, 277054-277055, 277057-277059, 277062-277068, 277070-277071, 277073-277076, 277078-277084, 277087-277089, 277091-277096, 277098, 277101, 277104-277105, 277107-277108, 277111, 277113-277117, 277119-277121, 277123-277124, 277127-277133, 277137, 277139-277144, 277146, 277148-277149, 277151-277158, 277160, 277168-277171, 277173-277175, 277178-277179, 277181-277182, 277184-277185, 277189-277191, 277193-277194, 277196-277198, 277201, 277203-277204, 277207-277212, 277214, 277217-277224, 277227, 277230-277231, 277233, 277235, 277237-277246, 277248-277250, 277252-277262, 277264, 277266-277270, 277272, 277274-277279, 277281-277282, 277284, 277286-277287, 277289-277292, 277295-277296, 277298-277301, 277305-277309, 277311, 277313, 277315-277319, 277325, 277329, 277333-277337, 277339, 277341-277345, 277348-277351, 277353-277360, 277362-277363, 277365-277366, 277370-277377, 277380-277381, 277383-277391, 277393-277394, 277397-277399, 277401, 277403, 277406, 277408-277410, 277412, 277416, 277418-277419, 277421-277428, 277430, 277434-277439, 277442-277446, 277450-277456, 277459-277470, 277472-277473, 277475-277480, 277482-277485, 277487-277494, 277496, 277498-277500, 277502, 277504-277507, 277509-277510, 277512, 277514-277529, 277531-277532, 277534-277535, 277537-277539, 277541, 277543, 277545-277552, 277554-277563, 277567-277568, 277570, 277572-277579, 277581, 277584, 277586-277596, 277602-277607, 277611-277615, 277617, 277619-277622, 277624-277630, 277634-277636, 277638, 277644, 277646-277655, 277657-277659, 277662-277663, 277666-277669, 277671, 277673-277675, 277679-277680, 277682, 277684, 277686-277692, 277696-277697, 277703-277706, 277709-277712, 277714, 277719, 277721-277723, 277725, 277730, 277734-277742, 277744-277746, 277748, 277750-277752, 277755-277757, 277761, 277764-277770, 277772-277773, 277776-277778, 277780-277782, 277784-277786, 277788-277789, 277791, 277793-277803, 277806-277807, 277809, 277811, 277814, 277818, 277821, 277824, 277826-277830, 277832, 277834-277837, 277840-277841, 277843-277851, 277853-277854, 277857, 277859, 277861, 277863, 277865, 277867-277869, 277871-277873, 277875-277879, 277881, 277884-277885, 277888-277891, 277894-277903, 277906, 277909-277920, 277923-277926, 277928-277930, 277933-277936, 277938, 277940-277941, 277943-277944, 277946, 277950, 277952-277956, 277958, 277962-277966, 277968-277971, 277974-277980, 277982-277983, 277985, 277988, 277991-277993, 277995-277998, 278001, 278005-278006, 278009-278015, 278018, 278021-278023, 278025-278027, 278029-278030, 278032, 278034-278035, 278037-278038, 278040-278044, 278046-278052, 278054, 278056-278057, 278059-278062, 278066-278068, 278071-278072, 278074-278079, 278081, 278083-278086, 278090-278092, 278097, 278100-278107, 278109-278114, 278116, 278118, 278121-278126, 278128-278136, 278138, 278140, 278142, 278144-278146, 278149-278150, 278152-278154, 278156-278158, 278160-278161, 278164, 278168, 278170-278172, 278174-278176, 278180-278182, 278186-278190, 278192-278200, 278203, 278205-278209, 278211-278212, 278214, 278216-278218, 278222-278228, 278231-278235, 278237, 278239, 278241, 278246-278249, 278251-278253, 278256-278257, 278260-278261, 278265, 278268-278269, 278272-278275, 278277-278283, 278285-278287, 278289-278290, 278292, 278295-278301, 278304-278305, 278308-278309, 278312-278324, 278327-278330, 278332-278333, 278335-278337, 278339-278345, 278347-278348, 278350-278355, 278357-278358, 278361-278372, 278374-278378, 278384, 278388-278389, 278391, 278395-278398, 278400, 278403, 278405-278406, 278408-278410, 278413, 278415-278417, 278419-278420, 278422-278423, 278425-278429, 278431-278432, 278434, 278436, 278439-278445, 278447, 278450, 278452-278453, 278455, 278457-278462, 278465-278466, 278468-278471, 278474-278480, 278482-278483, 278485, 278487, 278490-278494, 278496, 278498-278499, 278503, 278505-278506, 278508, 278510-278518, 278520-278523, 278525-278530, 278533-278535, 278537, 278540-278542, 278544-278545, 278551-278554, 278556, 278558-278569, 278571-278574, 278576-278578, 278582, 278586-278592, 278595-278596, 278599, 278602-278615, 278617-278618, 278620-278622, 278624-278626, 278630, 278632-278636, 278638-278641, 278643, 278647-278656, 278661-278662, 278666-278669, 278671, 278673, 278678-278682, 278685-278687, 278689-278690, 278692-278697, 278700-278701, 278704, 278706, 278708-278710, 278714, 278716-278722, 278724-278725, 278727-278729, 278732-278733, 278735-278736, 278738-278744, 278747, 278750-278756, 278758, 278763-278767, 278770-278774, 278776-

278786, 278791-278792, 278795-278801, 278804-278805, 278807, 278810, 278812, 278814-278819, 278821-278822, 278825, 278828-278829, 278831-278832, 278834-278837, 278841, 278843-278844, 278847, 278850, 278852-278853, 278856, 278858, 278863, 278865-278870, 278872-278876, 278880-278882, 278884, 278886, 278888-278889, 278891, 278894, 278897-278906, 278909-278910, 278912, 278916-278921, 278923-278925, 278928, 278930, 278935, 278937, 278939-278946, 278949-278959, 278962-278966, 278968, 278971-278976, 278978, 278980-278991, 278994-278996, 278998-279011, 279014, 279017, 279019-279024, 279026-279027, 279029-279030, 279033, 279035, 279038-279039, 279041-279049, 279051-279054, 279056, 279058-279059, 279062-279065, 279067-279069, 279073-279074, 279076-279077, 279079-279080, 279082-279084, 279087-279092, 279094, 279099-279100, 279102-279103, 279106-279109, 279115-279118, 279120-279123, 279126-279128, 279130-279143, 279147-279148, 279150, 279152-279153, 279155-279160, 279162-279164, 279166-279167, 279171, 279173-279179, 279181, 279183-279184, 279186-279187, 279189-279190, 279193, 279195, 279200, 279202-279204, 279208-279212, 279216, 279218-279222, 279226-279230, 279232-279233, 279235, 279237-279241, 279243-279250, 279252-279255, 279257, 279259, 279263-279265, 279267-279268, 279271-279274, 279276-279278, 279280-279285, 279289, 279291-279292, 279294-279299, 279303, 279306-279307, 279312-279313, 279315-279317, 279319-279320, 279322-279323, 279325-279329, 279331, 279334-279335, 279337, 279342, 279344-279350, 279353-279355, 279357-279363, 279365-279366, 279371-279373, 279376-279378, 279380, 279384-279391, 279393, 279395-279396, 279399-279400, 279405-279407, 279418-279424, 279426-279427, 279429-279431, 279433, 279435-279439, 279443-279444, 279446-279447, 279450-279460, 279462-279463, 279465-279469, 279471-279472, 279474-279482, 279484-279486, 279488, 279495-279502, 279511, 279513-279515, 279517-279519, 279521-279523, 279525-279537, 279540, 279542-279545, 279547-279548, 279550-279554, 279556, 279558-279562, 279564-279573, 279575-279577, 279581-279586, 279588, 279592-279594, 279596-279597, 279599-279613, 279615, 279618, 279621-279624, 279626, 279628, 279632-279634, 279640, 279644, 279648-279649, 279653, 279655, 279657, 279659, 279662-279668, 279670, 279672-279678, 279680, 279685-279686, 279688-279690, 279694-279697, 279699-279701, 279703, 279705-279706, 279708-279711, 279713, 279715-279719, 279721, 279723-279724, 279728-279732, 279734-279736, 279738, 279740-279741, 279744-279745, 279747-279750, 279752, 279754, 279760-279765, 279768-279771, 279774-279790, 279792, 279794, 279799, 279803-279804, 279806-279810, 279813-279814, 279816, 279818, 279821-279822, 279824, 279827-279830, 279835-279839, 279841-279843, 279847-279852, 279854-279855, 279858-279859, 279863-279865, 279867, 279871-279874, 279876-279877, 279885-279886, 279888-279891, 279893, 279895-279896, 279898-279900, 279904-279906, 279908, 279910, 279912, 279916, 279918-279923, 279926-279927, 279930-279932, 279934-279940, 279942, 279944-279946, 279948-279951, 279953-279954, 279956-279957, 279959-279961, 279963, 279965, 279968-279973, 279975-279978, 279981-279986, 279989, 279992, 279994, 279996-280001, 280004, 280006-280010, 280012-280013, 280017, 280019, 280023, 280025, 280027-280035, 280037-280043, 280045-280047, 280049-280050, 280052-280054, 280057-280058, 280061, 280063, 280066-280067, 280069-280073, 280075-280079, 280082, 280093-280094, 280096, 280098, 280100-280103, 280105-280115, 280117-280122, 280124-280127, 280129-280140, 280142-280143, 280145-280146, 280148-280150, 280154-280155, 280157, 280159-280161, 280163-280165, 280170-280172, 280174-280181, 280183-280185, 280193, 280195, 280197-280201, 280203, 280205, 280207, 280210, 280212, 280215, 280217, 280224-280225, 280229, 280233-280237, 280239, 280243-280244, 280248-280267, 280269-280278, 280280-280281, 280283, 280286, 280288-280298, 280301, 280303-280304, 280309-280312, 280315, 280319, 280321-280322, 280324-280326, 280328-280331, 280333, 280335, 280337-280341, 280345-280348, 280352-280358, 280360-280371, 280373-280381, 280383-280389, 280391, 280393, 280395, 280398-280399, 280402-280405, 280408-280410, 280412, 280414, 280416-280418, 280423, 280426, 280428-280435, 280437, 280439-280445, 280448, 280451-280455, 280460, 280462-280464, 280466-280467, 280469-280472, 280474, 280476-280478, 280481-280482, 280484, 280487-280488, 280490-280493, 280496-280498, 280500, 280503-280505, 280509, 280511-280513, 280517-280521, 280524-280526, 280528-280535, 280537, 280539-280540, 280542-280543, 280548-280549, 280551-280558, 280560-280562, 280566, 280568, 280570-280572, 280578-280582, 280584, 280589-280590, 280592-280594, 280596-280599, 280601-280604, 280606-280616, 280618, 280621, 280624, 280626-280627, 280629, 280632, 280634, 280636-280643, 280647-280648, 280654-280657, 280659-280660, 280662, 280664-280667, 280669-280673, 280675-280678, 280681-280682, 280684, 280686, 280689-280690, 280692-280695, 280698-280699, 280702, 280707-280708, 280710, 280712, 280715-280718, 280720, 280722, 280726, 280728, 280731, 280733, 280736, 280738, 280740-280749, 280752-280753, 280755-280757, 280759, 280763, 280766-280767, 280769-280774, 280777, 280780-280783, 280785, 280791-280796, 280798-280801, 280807, 280809-280810, 280812, 280814-280816, 280818, 280820-280823, 280826-280827, 280829-280831, 280834-280835, 280837-280840, 280843, 280852, 280857, 280859-280863, 280867-280868, 280870-280871, 280873, 280875, 280877-280881, 280883-280885, 280887, 280890-280891, 280893-280894, 280898-280901, 280904, 280907-280908, 280910, 280912, 280915-280916, 280924-280926, 280928-280929, 280933-280935, 280937-280945, 280948, 280952, 280955-280956, 280958-280961, 280964-280965, 280967, 280969-280971, 280973, 280977-280981, 280983-280984, 280987, 280989, 280991, 280993, 280996, 280999-281002, 281005-281006, 281008, 281010, 281013-281016, 281019-281020, 281023-281032, 281034-281036, 281039-281044, 281047-281048, 281050-281060, 281062-281067, 281069, 281071-281075, 281077, 281079-281084, 281086-281089, 281094-281109, 281112, 281115-281116, 281118-281119, 281121-281130, 281133-281145, 281147-281149, 281152-281154, 281157-281160, 281162, 281165, 281167-281168, 281170-281171, 281173-281175, 281177, 281185, 281187, 281189, 281192, 281196-281199, 281201, 281203-281205, 281208-281211, 281213, 281216, 281219-281220, 281224-281225, 281227, 281229, 281232, 281234, 281236-281237, 281242-281253, 281256-281261, 281268, 281270, 281274, 281280, 281282, 281285, 281287, 281289, 281291-281297, 281299-281309, 281312-281313, 281316-281321, 281324-281326, 281331-281332, 281334-281335, 281337-281342, 281346, 281353-281354, 281356-281357, 281359-281361, 281363, 281365, 281368-281369, 281373-281379, 281381-281382, 281384-281385, 281387-281389, 281391-281392, 281394-281399, 281401-281402, 281405, 281407, 281409-281410, 281416-281424, 281426, 281431-281434, 281437-281441, 281443-281444, 281446-281449, 281452, 281455-281456, 281458, 281460, 281462-281463, 281465, 281468-281469, 281472, 281474-281484, 281486, 281488-281491, 281494, 281496, 281498, 281500, 281502, 281504-281505, 281508-281509, 281511-281513, 281515-281519, 281521, 281523, 281525-281526, 281528, 281531-281533, 281537-281542, 281546-281548, 281551-281553, 281555-281558, 281565-281567, 281569, 281572-281573, 281576, 281579-281580, 281582-281583, 281585-281586, 281588, 281591-281592, 281594-281598, 281601-281606, 281608-281610, 281612, 281617-281620, 281623, 281625-281629, 281631-281633, 281635, 281638, 281640-281641, 281643-281646, 281650, 281652-281658, 281660, 281663-281667, 281669-281670, 281672-281675, 281677-281679, 281682, 281685, 281687-281689, 281691-281692, 281694-281695, 281697-281701, 281703-281708, 281710-281711, 281713, 281716-281717, 281720-281721, 281723-281724, 281726-281728, 281731, 281733, 281736-281747, 281749, 281751, 281753-281755, 281757-281764, 281766-281769, 281771, 281775, 281778-281779, 281781-281782, 281785, 281787-281790, 281792-281796, 281799, 281801, 281803-281806, 281810-281812, 281814-281818, 281820-281822, 281824, 281826-281828, 281832-281834, 281836-281840, 281842-281850, 281852-281854, 281857-281858, 281861-281865, 281868, 281870-281871, 281873, 281876-281877, 281880-281881, 281883-281887, 281889-281890, 281894, 281898-281900, 281902-281904, 281906-281914, 281917-281918, 281922-281923, 281926-281936, 281940, 281942-281944, 281946-281948, 281951, 281955, 281959-281961, 281963, 281965-281969, 281971-281975, 281977-281978, 281980, 281982-281984, 281987, 281990-281991, 281993-281996, 282000-282001, 282003, 282007, 282009-282015, 282017, 282020-282023, 282025, 282028, 282030, 282032-282033, 282035-282036, 282040-282042, 282044, 282047-282050, 282052, 282054-282063, 282066, 282068, 282070-282072, 282074-282076, 282078-282084, 282088-282089, 282091-282098, 282100-282101, 282103-282104, 282106-282107, 282109, 282111-282112, 282114-282119, 282123-282128, 282130-282131, 282134-282137, 282139, 282141, 282143-282144, 282146-282149, 282151-282157, 282160, 282169-282176, 282179, 282181-282184, 282186-282189, 282191-282193, 282195-282197, 282200-282208, 282210-282212, 282214, 282216-282218, 282221-282231, 282233, 282235, 282237-282241, 282243-282248, 282251-282252, 282254-282256, 282265-282278, 282281-282286, 282289-282295, 282298-282303, 282305-282306, 282308-282309, 282312-282317, 282320-282321, 282323-282324, 282327-282331, 282337-282339, 282341, 282343, 282345, 282347, 282352, 282354, 282356-282358, 282364-282366, 282368, 282370-282373, 282375-282377, 282379, 282381-282382, 282385-282387, 282390, 282395-282399, 282403-282404, 282406-282409, 282411, 282413-282417, 282420, 282422-282425, 282427-282430, 282432-282433, 282435, 282438-282441, 282449-282451, 282455-282456, 282459-282460, 282462-282464, 282466, 282469-282472, 282474, 282476, 282480-282484, 282486-282487, 282490-282491, 282495, 282497-282499, 282501-282502, 282504, 282507-282514, 282518, 282520-282524, 282527-282536, 282538-282544, 282548, 282550-282552, 282554-282559, 282561, 282563-282566, 282568, 282570-282572, 282576-282577, 282579-282591, 282593-282594, 282598-282601, 282603-282606, 282608, 282610, 282612-282614, 282616-282625, 282627-282635, 282637-282638, 282640-282642, 282644-282645, 282647-282649, 282651-282653, 282655, 282658, 282660-282665, 282667, 282669-282675, 282677, 282679-282680, 282682-282690, 282692-282694, 282696-282697, 282700, 282702-282704, 282708, 282711-282713, 282716, 282719-282720, 282722, 282724-282733, 282735-282737, 282739, 282741-282745, 282747-282750, 282753, 282757, 282759-282760, 282762-282763, 282765-282768, 282770, 282773, 282778, 282780-282782, 282790-282796, 282798, 282801-282802, 282806-282808, 282812-282814, 282816, 282818-282821, 282823, 282825, 282827, 282829-282834, 282838-282839, 282841-282849, 282851-282853, 282855-282856, 282858-282859, 282861-282862, 282865-282869, 282872-282873, 282875, 282877, 282879-282880, 282883, 282888-282889, 282891-282897, 282899, 282901-282904, 282906-282916, 282919, 282921-282927, 282930, 282934-282935, 282937-282948, 282953-282961, 282963, 282966-282968, 282970, 282972-282976, 282978, 282980-282983, 282985, 282987-282988, 282992, 282999-283000, 283002, 283005, 283007, 283009-283010, 283014, 283017-283020, 283022-283023, 283025-283026, 283029-283030, 283036-283044, 283046, 283054-283058, 283061, 283063-283065, 283067, 283069, 283072-283073, 283075-283080, 283083-283088, 283092-283093, 283095-283097, 283100-283103, 283105, 283107-283109, 283113, 283115-283117, 283122-283123, 283126-283130, 283132-283134, 283136-283137, 283142-283149, 283151-283155, 283159, 283161-283162, 283165-283169, 283171-283181, 283183-283184, 283186-283187, 283189-283190, 283192, 283195-283200, 283203-283207, 283210, 283213-283218, 283220, 283222, 283224, 283226-283228, 283230-283232, 283234, 283236-283238, 283240-283245, 283247-283252, 283254-283255, 283257-283259, 283262-283275, 283278-283279, 283281-283282, 283284-283299, 283301-283304, 283306-283314, 283316-283317, 283319-283322, 283324, 283326-283327, 283330-283331, 283333-283349, 283351, 283353-283356, 283358-283372, 283374-283377, 283379-283380, 283384, 283386, 283389-283395, 283397-283400, 283402, 283404-283411, 283413-283415, 283417, 283419, 283421-283423, 283426-283429, 283431-283433, 283435-283441, 283445-283447, 283449, 283451-283455, 283457-283463, 283465-283469, 283471-283475, 283477, 283479-283483, 283485, 283487, 283489, 283491-283508, 283510-283513, 283517-283519, 283521, 283523-283526, 283528-283532, 283534-283536, 283539, 283541, 283543-283544, 283547-283548, 283550-283552, 283554-283558, 283560, 283562-283569, 283571-283572, 283575-283580, 283582, 283584-283589, 283591-283594, 283596, 283602-283603, 283606, 283608-283609, 283611, 283613, 283615-283618, 283620, 283622-283626, 283628-283642, 283645, 283648, 283650, 283653-283662, 283664-283665, 283667-283673, 283675-283676, 283678-283680, 283682, 283688-283689, 283691-283693, 283695-283696, 283699-283703, 283705-283708, 283710-283715, 283717-283723, 283727, 283729-283730, 283732, 283734-283737, 283739, 283742-283752, 283754-283756, 283758, 283760-283764, 283766, 283769, 283771, 283773, 283775, 283777-283784, 283787, 283789, 283792-283803, 283805-283806, 283811, 283813-283815, 283818, 283820, 283825-283830, 283832-283834, 283837-283839, 283843, 283845-283847, 283850, 283852, 283856, 283858, 283860-283864, 283866-283867, 283869-283870, 283874-283875, 283877-283878, 283881-283891, 283894, 283896-283898, 283901-283903, 283905, 283908, 283910, 283913-283915, 283917, 283922-283930, 283934-283938, 283942-283944, 283946, 283948-283949, 283951-283952, 283956, 283958-283962, 283964, 283966, 283968-283971, 283973-283978, 283981-283982, 283984-283993, 283996-283998, 284001-284002, 284004-284006, 284008-284010, 284014-284028, 284032-284043, 284045-284047, 284049-284055, 284057-284059, 284061-284069, 284072-284073, 284075-284077, 284079, 284082-284085, 284088-284089, 284091, 284093-284094, 284097-284098, 284101-284106, 284109-284113, 284115-284118, 284120-284123, 284126-284134, 284136, 284140, 284143, 284145-284146, 284148, 284150, 284153-284154, 284159, 284161-284163, 284169, 284171, 284173, 284177, 284180-284181, 284184, 284188, 284190-284192, 284195-284197, 284199-284205, 284207-284210, 284214-284215, 284218-284219, 284221-284223, 284225-284226, 284228-284230, 284232-284233, 284235, 284239, 284241-284242, 284244, 284246, 284248-284250, 284254-284260, 284262, 284264-284265, 284267-284278, 284281-284282, 284284, 284286-284293, 284295, 284297-284300, 284303, 284305, 284307-284309, 284311-284312, 284315-284318, 284321, 284323-284328, 284330-284332, 284336, 284338, 284340-284351, 284353, 284355, 284357-284358, 284360-284361, 284364-284369, 284371-284372, 284375-284376, 284378-284379, 284381-284386, 284388-284393, 284396-284398, 284400-284402, 284405, 284407, 284409-284411, 284415-284417, 284420, 284422, 284424, 284426-284428, 284430, 284434, 284439-284442, 284445-284447, 284449-284453, 284455, 284457-284458, 284460-284468, 284472-284474, 284476-284477, 284479-284481, 284486, 284488-284493, 284495-284496, 284499-284502, 284505, 284507-284508, 284514-284515, 284517-284518, 284520-284522, 284525-284531, 284534-284537, 284539-284542, 284545-284546, 284548-284550, 284552-284556, 284558-284560, 284563-284567, 284569-284576, 284578, 284580-284582, 284592-284593, 284595-284616, 284618-284624, 284626-284627, 284631-284633, 284635-284636, 284638, 284642-284644, 284646-284649, 284652, 284655, 284657, 284659, 284661-284667, 284670, 284673-284675, 284678, 284683, 284685-284688, 284690, 284695, 284698, 284700-284704, 284707-284712, 284714, 284716, 284718, 284720-284724, 284728-284731, 284737-284741, 284743, 284745, 284748, 284750, 284753, 284755, 284757, 284760-284771, 284778, 284780-284781, 284783-284784, 284787-284792, 284794, 284796-284801, 284805-284807, 284810, 284813-284817, 284819-284821, 284827, 284830, 284833-284843, 284846, 284848-284849, 284851-284852, 284854, 284856, 284860, 284868-284869, 284871-284876, 284878-284879, 284881-284882, 284884-284887, 284889-284892, 284898-284900, 284903-284904, 284907, 284909-284911, 284917-284925, 284927, 284931-284932, 284934, 284936, 284938-284940, 284943-284944, 284946-284951, 284953-284954, 284956-284957, 284960-284963, 284966, 284968-284970, 284973-284981, 284983-284984, 284987, 284989-284990, 284992, 284994, 284997-284999, 285001, 285003-285004, 285006-285007, 285010-285012, 285014-285019, 285022-285023, 285025-285026, 285029-285035, 285037-285038, 285040-285045, 285051-285059, 285063-285070, 285073, 285075-285078, 285080, 285082-285083, 285085-285089, 285091, 285093-285096, 285098-285121, 285125, 285128, 285130-285147, 285149, 285152-285156, 285158-285161, 285164, 285166, 285168-285170, 285174-285179, 285181-285184, 285187-285188, 285191-285192, 285196, 285200, 285202, 285204-285207, 285210-285212, 285214-285215, 285217-285220, 285222-285223, 285225-285227, 285232, 285234, 285239-285241, 285244, 285246-285250, 285253, 285256-285257, 285259-285265, 285268-285272, 285275-285278, 285280-285285, 285287, 285294, 285296-285298, 285300-285301, 285303-285304, 285307-285315, 285317, 285322, 285324-285334, 285336-285340, 285342-285343, 285345, 285347, 285349, 285351, 285353-285356, 285362-285363, 285367, 285369-285370, 285372, 285374-285376, 285381-285382, 285384-285388, 285391, 285393, 285396, 285398, 285401, 285403-285421, 285423, 285425, 285427, 285429-285434, 285436-285441, 285445, 285447-285450, 285452-285453, 285455-285459, 285461, 285463, 285465-285468, 285471, 285475-285476, 285478-285480, 285482-285483, 285489, 285491-285498, 285501, 285503, 285505-285506, 285508, 285510-285514, 285517-285518, 285520-285523, 285525, 285527, 285529-285530, 285532-285535, 285537, 285540-285545, 285547-285548, 285552-285553, 285557-285558, 285560-285562, 285564, 285566-285568, 285571-285575, 285578, 285580, 285583-285585, 285588, 285590, 285595, 285600, 285602-285606, 285608-285611, 285614, 285616, 285620, 285622-285623, 285625-285629, 285631-285636, 285638-285641, 285644, 285647, 285649-285653, 285655-285660, 285663-285667, 285669, 285671-285674, 285676, 285678, 285680-285682, 285684-285687, 285689-285690, 285694-285701, 285703-285704, 285706-285711, 285714-285719, 285721-285727, 285729, 285731, 285736, 285738-285739, 285743-285745, 285747, 285749-285750, 285752-285754, 285756-285757, 285760, 285762, 285765-285768, 285771-285774, 285776, 285778-285781, 285783-285785, 285787-285788, 285790-285792, 285796, 285798-285799, 285803, 285805-285807, 285809-285810, 285812-285813, 285815-285816, 285818, 285821, 285824, 285827-285828, 285830, 285834, 285836-285837, 285839, 285841-285843, 285849-285852, 285855-285856, 285858-285866, 285868, 285871, 285873-285877, 285881-285883, 285885, 285887, 285889-285890, 285892-285893, 285895, 285899, 285901-285902, 285904-285909, 285911-285915, 285917, 285928-285934, 285936-285939, 285941-285944, 285946, 285949-285955, 285957-285961, 285965-285970, 285973-285975, 285978-285980, 285982, 285984, 285986-285989, 285991-286000, 286008-286009, 286011-286023, 286025, 286028-286031, 286034-286037, 286039-286040, 286043, 286045-286046, 286048, 286053-286062, 286065-286066, 286068-286069, 286072-286073, 286075, 286079, 286081-286084, 286087, 286089, 286092, 286094-286095, 286098, 286101, 286105-286107, 286109-286111, 286114-286115, 286118-286120, 286122, 286126-286129, 286131-286135, 286138-286141, 286143-286144, 286146-286156, 286161, 286163-286169, 286171, 286174-286175, 286177-286179, 286181, 286183-286184, 286187-286189, 286193-286194, 286197-286198, 286200-286206, 286208-286210, 286214, 286216-286219, 286223-286224, 286226-286227, 286230-286231, 286233-286235, 286237-286239, 286242-286245, 286247-286248, 286251-286252, 286254-286258, 286260, 286262-286265, 286267, 286269-286270, 286272-286273, 286276-286282, 286284-286285, 286287-286292, 286294, 286296-286300, 286303, 286305, 286307-286309, 286311, 286313-286315, 286319-286321, 286323, 286326, 286330, 286335, 286337-286339, 286341, 286343-286344, 286348-286349, 286352-286355, 286357-286358, 286360-286361, 286364-286370, 286373, 286376-286380, 286384, 286389-286391, 286397-286402, 286405-286408, 286410-286413, 286415, 286419-286423, 286425-286428, 286430-286433, 286435-286444, 286446, 286448-286449, 286451-286458, 286460-286461, 286463, 286466, 286468, 286470, 286472-286478, 286481, 286483, 286485, 286488-286491, 286493-286495, 286500, 286502, 286504-286506, 286508, 286514, 286517-286520, 286522, 286525-286526, 286528-286530, 286533-286535, 286537, 286539-286546, 286549-286553, 286555-286561, 286564, 286566, 286570, 286579, 286582-286584, 286591-286605, 286607-286614, 286616, 286619-286623, 286625, 286627, 286629, 286631-286635, 286638-286648, 286651, 286654-286656, 286658-286661, 286663, 286666, 286668, 286670-286672, 286675, 286677-286679, 286684, 286686-286694, 286696, 286698-286700, 286704-286706, 286708, 286710, 286712-286714, 286716, 286718-286720, 286725-286727, 286729-286731, 286734-286738, 286740, 286742, 286745-286753, 286756, 286759-286760, 286762, 286770, 286772-286773, 286775-286776, 286778, 286780, 286782, 286784-286788, 286790-286792, 286794-286797, 286799, 286801, 286804, 286806, 286808, 286811, 286814, 286818, 286821, 286823-286824, 286826-286831, 286833, 286837-286838, 286840-286846, 286849-286850, 286852-286856, 286858-286869, 286872-286873, 286875-286877, 286880, 286884-286885, 286887-286892, 286894, 286900-286903, 286905, 286907-286908, 286912-286918, 286921-286926, 286928-286934, 286937-286939, 286941-286942, 286945-286947, 286950-286951, 286955-286957, 286961-286963, 286965-286966, 286971, 286973-286977, 286979-286984, 286986, 286989-286990, 286992-286998, 287000, 287004-287005, 287009, 287011-287012, 287015-287016, 287018, 287024, 287029-287036, 287040, 287042, 287044-287046, 287049, 287051-287052, 287055, 287058, 287060, 287063, 287065-287072, 287078-287081, 287083, 287085, 287087-287088, 287090-287095, 287098-287099, 287102, 287104-287105, 287107-287110, 287112, 287116, 287118-287122, 287124-287135, 287137-287138, 287140, 287142-287144, 287147, 287150-287153, 287155, 287157-287159, 287161, 287163, 287165-287171, 287174-287176, 287179-287182, 287185-287186, 287188, 287190-287191, 287193, 287198, 287201, 287204-287207, 287209-287210, 287212-287218, 287220, 287222-287224, 287226-287227, 287229, 287231-287233, 287235, 287238-287245, 287247, 287249, 287251-287255, 287262-287263, 287269, 287272, 287277-287280, 287282, 287284-287285, 287287, 287289-287291, 287293, 287297-287302, 287305-287308, 287312, 287317, 287319-287320, 287322-287330, 287332, 287334, 287336-287339, 287341-287342, 287344, 287347-287352, 287354, 287357, 287359-287360, 287363, 287365, 287368-287369, 287371, 287374, 287381, 287383-287384, 287389-287392, 287394, 287396-287398, 287400, 287403-287404, 287406, 287409-287412, 287415-287418, 287421, 287423-287425, 287427-287428, 287431, 287433, 287435-287436, 287438-287441, 287443, 287449, 287451, 287454-287455, 287457, 287459-287461, 287463-287464, 287466-287468, 287479, 287484, 287486-287491, 287494-287496, 287498, 287500-287501, 287503-287505, 287507-287510, 287514-287515, 287518-287519, 287521-287526, 287528-287532, 287534-287535, 287542-287545, 287548, 287550-287552, 287554, 287556-287561, 287563-287565, 287568, 287570, 287572-287578, 287580, 287582, 287584-287586, 287588-287590, 287592, 287596-287597, 287599, 287601-287607, 287609-287620, 287623-287624, 287626, 287629-287631, 287634-287635, 287637-287640, 287643, 287645-287647, 287649-287661, 287663-287664, 287666-287677, 287679-287681, 287683, 287689, 287694, 287699, 287702, 287705-287707, 287709-287712, 287714-287716, 287718, 287720-287721, 287723, 287725, 287727, 287729-287735, 287739, 287743, 287746, 287748-287750, 287752-287753, 287755-287761, 287763-287765, 287767, 287771-287773, 287775-287776, 287778-287787, 287790, 287792-287795, 287797, 287800-287802, 287805-287808, 287810-287811, 287815, 287818-287819, 287821-287824, 287826, 287828-287830, 287832, 287837-287838, 287840-287844, 287846-287850, 287852-287853, 287856-287859, 287862-287867, 287869, 287874-287878, 287882-287883, 287886-287887, 287889, 287891-287894, 287897, 287899-287902, 287904, 287911, 287913-287917, 287919, 287921, 287924-287928, 287930-287931, 287933-287936, 287940, 287944-287949, 287951-287954, 287958, 287960-287961, 287964, 287966-287974, 287983-287984, 287986, 287988, 287991-287992, 287994-287996, 287999, 288001, 288003, 288006-288007, 288010-288014, 288017, 288019, 288023-288025, 288028, 288034-288036, 288040, 288044-288049, 288052, 288055, 288057, 288059-288060, 288062-288064, 288067-288073, 288075, 288082-288092, 288094, 288096, 288098-288099, 288101-288102, 288105-288106, 288108, 288112-288113, 288115-288116, 288118-288121, 288130-288131, 288133, 288137, 288140-288145, 288148-288149, 288152, 288154-288158, 288160, 288162, 288177, 288179-288180, 288183-288186, 288188, 288190-288196, 288202-288209, 288211-288216, 288219, 288221-288225, 288227-288228, 288230-288237, 288239, 288241-288242, 288244-288245, 288248-288249, 288251-288253, 288255, 288263, 288265-288266, 288269-288272, 288278, 288280-288288, 288291, 288293-288296, 288298-288300, 288302-288306, 288312-288318, 288320-288321, 288324, 288326-288328, 288330, 288332-288341, 288343, 288345-288347, 288350, 288352-288356, 288358-288361, 288363-288366, 288369, 288371-288377, 288379-288383, 288387, 288389-288393, 288395-288397, 288399-288405, 288409-288411, 288413-288417, 288419-288420, 288422, 288424-288428, 288431, 288434, 288437-288439, 288443, 288445-288451, 288454-288457, 288459-288468, 288478, 288482, 288487-288489, 288491-288494, 288496, 288498-288503, 288506-288509, 288512-288513, 288516, 288518-288521, 288523, 288525, 288527-288531, 288534-288536, 288541-288543, 288547, 288549-288554, 288556-288558, 288560-288561, 288563, 288565-288566, 288569, 288571-288573, 288575-288579, 288581-288582, 288584, 288586-288589, 288591-288592, 288594-288596, 288598-288599, 288602, 288604-288607, 288609-288619, 288622-288627, 288630-288631, 288633-288635, 288638, 288641-288642, 288644-288648, 288651-288662, 288664-288670, 288672, 288674, 288676-288691, 288694, 288697, 288699, 288701, 288705, 288708, 288710, 288714-288716, 288720-288724, 288727-288735, 288737-288738, 288740, 288743-288744, 288746-288747, 288751-288754, 288756-288758, 288762-288767, 288771-288774, 288776-288777, 288780-288785, 288787, 288791-288793, 288795-288798, 288800, 288803, 288805-288806, 288808-288811, 288813, 288816, 288818-288819, 288821, 288823-288824, 288827-288828, 288832-288833, 288835-288844, 288846-288849, 288851-288859, 288861-288864, 288870-288871, 288873-288874, 288877-288878, 288880, 288883, 288886-288888, 288890, 288899-288901, 288905, 288907-288910, 288912, 288917-288918, 288922-288924, 288928, 288930-288936, 288939-288941, 288943-288945, 288949-288950, 288952, 288957, 288959-288960, 288962-288963, 288966-288971, 288981, 288984-288985, 288987-288988, 288990-288991, 288993, 288995, 288997-289000, 289002, 289004-289005, 289009, 289011-289013, 289015-289018, 289021-289022, 289024-289025, 289027-289033, 289039-289041, 289044, 289046, 289048, 289050-289051, 289053-289058, 289062-289067, 289069, 289073-289076, 289078-289089, 289094-289095, 289100, 289102-289104, 289106-289109, 289111-289114, 289117-289121, 289123, 289125-289126, 289128, 289133-289134, 289137, 289139, 289143-289145, 289147-289148, 289155, 289157-289158, 289161-289162, 289164-289168, 289170, 289173-289176, 289178, 289180-289181, 289183-289184, 289187-289192, 289198, 289202, 289204-289206, 289208-289211, 289215-289220, 289222, 289225-289226, 289231-289232, 289234-289236, 289238-289239, 289241-289242, 289244, 289249, 289255-289260, 289263, 289266, 289270, 289272-289273, 289275-289277, 289280, 289282, 289286, 289288-289289, 289291, 289295, 289303-289308, 289310, 289312-289316, 289320, 289322-289324, 289326-289336, 289338, 289340-289341, 289344, 289347-289348, 289351, 289355-289356, 289358-289359, 289361-289362, 289364, 289366, 289369-289372, 289374-289376, 289378, 289380, 289386, 289388, 289391-289392, 289395, 289397-289398, 289400-289401, 289403, 289405, 289408-289417, 289419, 289422-289424, 289428-289429, 289431, 289433, 289436, 289438-289439, 289441-289445, 289447, 289449-289451, 289453, 289455-289458, 289462-289467, 289469, 289472, 289476-289477, 289479-289480, 289482-289483, 289485-289488, 289491, 289495, 289497-289499, 289501, 289504-289507, 289510-289518, 289521, 289524-289526, 289528, 289530, 289532-289538, 289541-289542, 289545-289546, 289548-289553, 289555, 289557, 289559-289575, 289577, 289580, 289583-289584, 289586-289592, 289594-289595, 289597-289600, 289603, 289606, 289608-289610, 289612-289614, 289616-289617, 289620, 289623-289625, 289627-289630, 289633-289634, 289636, 289639-289644, 289646, 289654-289655, 289657, 289659-289664, 289666, 289668-289669, 289674-289678, 289681-289683, 289685, 289689-289699, 289701-289703, 289705-289706, 289708, 289710, 289713-289719, 289725-289727, 289729-289730, 289732, 289737, 289739-289742, 289744, 289746, 289748-289755, 289758-289763, 289765, 289768, 289770, 289772-289773, 289775-289776, 289779-289780, 289782-289785, 289787, 289789-289795, 289801-289802, 289807, 289810-289811, 289813, 289815-289816, 289819-289823, 289825, 289833-289834, 289837-289840, 289842, 289844, 289848-289851, 289853, 289856-289863, 289865, 289874-289878, 289881-289882, 289894, 289897-289898, 289901-289902, 289911-289913, 289915, 289919, 289922-289923, 289925, 289929, 289931, 289935, 289937, 289939-289943, 289945, 289947-289949, 289952-289953, 289955-289956, 289958-289962, 289965-289967, 289969-289970, 289972-289975, 289977-289979, 289981, 289984-289989, 289991-289992, 289994, 289996-290001, 290003-290005, 290010-290014, 290018, 290022, 290024-290027, 290029-290032, 290034-290035, 290038, 290040-290044, 290046-290047, 290049-290050, 290052, 290055, 290057-290058, 290061, 290063, 290065-290067, 290069-290070, 290072-290075, 290077-290079, 290081, 290083, 290086, 290088, 290090, 290092, 290095, 290097-290098, 290102-290103, 290105-290109, 290112-290115, 290117-290122, 290124-290125, 290130, 290132-290133, 290136, 290138, 290140-290141, 290143-290146, 290149-290151, 290154-290156, 290158-290162, 290164, 290166-290171, 290174-290178, 290181-290186, 290188-290195, 290198-290200, 290206, 290210-290212, 290214, 290216-290218, 290222-290223, 290227, 290229, 290231-290238, 290240-290248, 290250-290251, 290254-290259, 290261, 290263-290264, 290266-290269, 290271-290281, 290284-290288, 290291, 290293, 290296, 290299, 290306-290309, 290311-290314, 290316-290319, 290321-290323, 290325-290331, 290336-

290339, 290342-290343, 290345, 290347-290354, 290356-290361, 290363-290367, 290369, 290371, 290373, 290375-290378, 290381-290382, 290384-290387, 290391-290392, 290394, 290396-290400, 290403-290405, 290407, 290409, 290412, 290415-290417, 290420-290423, 290428, 290430-290434, 290436-290441, 290443-290444, 290449, 290451-290452, 290461, 290465, 290467-290468, 290472, 290475-290479, 290481-290483, 290485-290487, 290490-290492, 290497-290498, 290500, 290502-290511, 290513-290516, 290518-290523, 290526-290533, 290535, 290537-290541, 290543, 290545-290546, 290549, 290552, 290556-290559, 290562, 290564, 290568-290569, 290573-290575, 290577-290581, 290585-290592, 290595, 290598-290599, 290601, 290606-290609, 290615, 290617, 290619-290620, 290622-290628, 290632-290634, 290636-290645, 290647, 290649-290652, 290654, 290656, 290658-290659, 290663-290666, 290668, 290671, 290674, 290676, 290679-290693, 290698-290703, 290705-290708, 290710-290711, 290713, 290715-290716, 290718, 290720, 290723, 290730, 290733, 290735, 290737-290738, 290741-290742, 290744-290745, 290748-290749, 290752-290753, 290756, 290758, 290761-290762, 290764-290766, 290768-290771, 290774, 290779-290780, 290787, 290789-290794, 290800-290804, 290806, 290809, 290811-290812, 290814-290815, 290818-290820, 290822-290824, 290827-290828, 290831-290833, 290836-290837, 290839-290840, 290842-290844, 290847-290850, 290853-290855, 290857, 290860-290862, 290865-290872, 290877-290878, 290880, 290882-290883, 290885, 290887, 290889-290890, 290892-290893, 290895-290896, 290901, 290905, 290907-290910, 290913, 290915-290921, 290924-290929, 290931, 290934, 290936-290937, 290940-290941, 290944, 290947, 290949, 290954-290955, 290957-290962, 290965-290966, 290969-290972, 290974, 290979-290982, 290986-290987, 290989-290990, 290992-290993, 290995, 291000-291010, 291012-291013, 291015-291016, 291019, 291021-291023, 291025-291026, 291029, 291031, 291033, 291035, 291037, 291039, 291042-291045, 291047, 291049-291052, 291054-291056, 291058-291059, 291063-291064, 291066, 291068, 291072-291075, 291077-291078, 291080-291081, 291083, 291085, 291092-291093, 291096, 291098, 291100-291101, 291103-291105, 291107-291109, 291111, 291113, 291115, 291120-291121, 291123-291125, 291127-291139, 291141, 291145-291149, 291152, 291159-291162, 291164-291166, 291170-291178, 291180-291182, 291184-291186, 291188, 291192, 291195-291197, 291199, 291201-291204, 291206, 291208-291211, 291213, 291215-291220, 291223-291224, 291227, 291229, 291231-291234, 291237-291238, 291242-291243, 291246-291255, 291260, 291263, 291266-291270, 291273-291279, 291281-291282, 291285-291289, 291292-291293, 291295-291297, 291299, 291303-291305, 291309-291310, 291312-291313, 291315, 291320-291321, 291323, 291325-291326, 291329-291333, 291336-291337, 291340, 291343-291344, 291346-291347, 291349-291350, 291352-291356, 291359-291360, 291364-291368, 291370-291371, 291373, 291376, 291378, 291380-291382, 291384-291388, 291391-291397, 291399-291402, 291405-291406, 291412-291414, 291416-291421, 291423-291426, 291428, 291430, 291432, 291434, 291436-291437, 291439, 291441-291444, 291446, 291448-291452, 291454, 291456, 291459, 291461, 291464-291465, 291467-291472, 291474-291489, 291492, 291498, 291500-291504, 291507, 291514, 291516-291520, 291522, 291524-291525, 291531-291538, 291540-291541, 291544, 291549, 291551-291556, 291558-291559, 291561-291563, 291565, 291567, 291569-291571, 291573, 291576-291583, 291589, 291591-291595, 291597-291602, 291607, 291609, 291611-291612, 291614-291615, 291617, 291619-291623, 291625-291628, 291630-291640, 291642-291643, 291645, 291647-291649, 291651-291652, 291654-291659, 291662-291666, 291668-291670, 291672, 291674-291676, 291678-291679, 291681-291687, 291689-291694, 291696, 291699, 291701, 291703-291704, 291706, 291709, 291712-291718, 291720-291729, 291731, 291733-291738, 291740, 291742-291746, 291748-291759, 291762, 291764, 291766, 291772-291774, 291777-291785, 291789-291796, 291798-291799, 291801, 291803-291804, 291807-291811, 291813-291819, 291822-291823, 291826-291827, 291829, 291831-291832, 291834-291839, 291841-291843, 291847-291853, 291855, 291857-291863, 291865-291866, 291868, 291870-291871, 291873-291876, 291879-291882, 291884, 291887-291888, 291891-291893, 291895-291901, 291905-291906, 291909, 291911, 291915, 291918, 291920-291923, 291925-291928, 291930-291934, 291937-291938, 291941-291944, 291946-291948, 291956-291967, 291971-291972, 291974, 291976-291979, 291982, 291984-291987, 291989-291990, 291993, 291999, 292002, 292005-292006, 292008-292012, 292014-292021, 292026, 292029, 292032, 292034-292035, 292037, 292039-292040, 292042, 292048-292050, 292055, 292057, 292059-292065, 292067-292076, 292081-292084, 292086-292088, 292090-292092, 292095-292096, 292099-292101, 292103-292107, 292113, 292117-292125, 292128-292130, 292134-292135, 292137-292138, 292140-292141, 292144-292148, 292152, 292154-292162, 292165-292170, 292172-292182, 292185, 292188-292192, 292194, 292196-292204, 292206, 292208-292211, 292213-292218, 292220-292227, 292229-292230, 292232, 292234-292235, 292237-292238, 292241-292244, 292246-292247, 292250-292251, 292253, 292255-292257, 292259, 292262, 292265-292267, 292271, 292273, 292275-292278, 292282-292284, 292287, 292289, 292295-292298, 292300, 292302, 292310-292313, 292315-292316, 292318, 292320-292321, 292323-292332, 292334-292337, 292339, 292344, 292347, 292349-292353, 292355-292361, 292364, 292366-292373, 292377-292379, 292382-292383, 292386, 292388-292389, 292391-292406, 292408-292409, 292411, 292414-292418, 292420-292423, 292425, 292429, 292433, 292435, 292440-292441, 292444-292446, 292449, 292451, 292454, 292456-292457, 292459-292462, 292468-292469, 292471-292472, 292478, 292480, 292482-292489, 292491-292492, 292494, 292501-292503, 292505-292506, 292508, 292511, 292518-292521, 292530-292544, 292548-292551, 292554, 292556, 292558, 292562, 292564-292567, 292570, 292572, 292575, 292577, 292579-292580, 292582-292586, 292591-292592, 292594, 292596-292598, 292606, 292609, 292611-292612, 292615-292616, 292619, 292621-292623, 292626, 292628, 292631-292633, 292635-292637, 292640-292641, 292647-

292648, 292650-292656, 292658, 292660-292662, 292664-292666, 292670, 292676, 292678-292679, 292681-292682, 292684-292685, 292687-292688, 292690, 292692, 292695, 292697, 292700-292705, 292710-292712, 292714-292717, 292719, 292721-292722, 292724, 292726, 292728, 292730-292731, 292733-292734, 292736, 292738-292741, 292743, 292745-292749, 292752, 292754-292762, 292765-292768, 292770-292771, 292776-292780, 292783, 292785-292787, 292790, 292792-292797, 292800-292803, 292805-292815, 292817-292818, 292821, 292829, 292832-292834, 292838-292839, 292841-292842, 292844-292846, 292848-292850, 292852-292854, 292857-292858, 292860-292861, 292863-292868, 292870, 292873, 292877-292884, 292889-292893, 292896-292897, 292899-292903, 292907, 292909-292913, 292917-292918, 292920, 292925-292926, 292928-292931, 292935, 292937, 292939-292945, 292948-292956, 292958-292963, 292965, 292968-292969, 292971-292972, 292974-292980, 292982-292985, 292988-292989, 292992-292994, 292996-293000, 293002-293004, 293009-293014, 293016-293020, 293022, 293025, 293028-293030, 293032-293034, 293036, 293038, 293040-293047, 293051-293053, 293055, 293060-293061, 293063-293070, 293072, 293074-293076, 293078, 293080-293081, 293083-293084, 293086, 293090, 293092-293095, 293098, 293100-293103, 293106-293117, 293119, 293121-293123, 293125-293127, 293129-293132, 293135, 293137-293139, 293141-293147, 293150-293153, 293155-293157, 293160-293163, 293167-293168, 293170-293175, 293180-293182, 293184, 293186, 293188, 293190-293194, 293196-293201, 293205-293206, 293208, 293210-293221, 293223-293224, 293226-293233, 293236-293242, 293244-293245, 293249, 293251, 293254, 293258, 293261-293262, 293264-293265, 293267-293268, 293270-293271, 293273, 293275-293276, 293278-293281, 293283, 293285-293286, 293288-293293, 293297, 293302-293303, 293306-293309, 293311, 293313-293317, 293319-293323, 293325, 293330-293333, 293335-293337, 293340, 293343, 293345-293351, 293353-293354, 293358-293362, 293364-293365, 293367-293370, 293372-293375, 293377-293378, 293380-293386, 293391-293394, 293396-293408, 293410-293411, 293413-293425, 293428-293433, 293436, 293438-293441, 293443, 293445-293450, 293452-293455, 293458-293461, 293464-293465, 293467-293468, 293472-293477, 293479, 293482, 293485-293487, 293489-293493, 293495, 293499-293501, 293503-293510, 293515-293516, 293518-293530, 293532, 293535, 293539-293541, 293543, 293545, 293547-293548, 293550-293551, 293553, 293555, 293557, 293559-293560, 293562, 293565, 293567, 293569-293571, 293574-293579, 293584-293591, 293595, 293598-293599, 293602-293604, 293606-293608, 293610, 293613-293615, 293617-293620, 293622-293623, 293631-293632, 293634-293635, 293637-293638, 293645-293646, 293650, 293653-293655, 293657-293659, 293662-293668, 293671-293681, 293683-293688, 293690, 293692-293700, 293702, 293704, 293709-293715, 293719-293721, 293723-293725, 293727-293729, 293731-293732, 293734, 293736, 293738, 293740, 293742-293743, 293746, 293749-293751, 293753-293756, 293758-293761, 293763, 293766-293769, 293771-293779, 293782-293786, 293788-293791, 293793-293794, 293796-293798, 293800-293803, 293806-293807, 293809-293810, 293817-293818, 293822-293823, 293825, 293827, 293829-293833, 293836, 293840-293844, 293846-293852, 293856, 293859, 293863, 293867-293868, 293872, 293874, 293876, 293878-293879, 293884, 293886, 293888-293893, 293895, 293897, 293899-293901, 293907, 293909, 293913, 293915-293917, 293920-293923, 293926-293928, 293930, 293933-293939, 293941-293943, 293945-293947, 293950-293951, 293955-293957, 293961-293968, 293973, 293975, 293981, 293983-293985, 293987-293989, 293991-293998, 294001-294003, 294005-294010, 294016-294021, 294023, 294029, 294031, 294034, 294036-294039, 294042-294049, 294051, 294053-294056, 294060, 294064-294065, 294067-294068, 294070-294076, 294078-294079, 294081-294086, 294088-294096, 294098-294099, 294101, 294103, 294106, 294108, 294113-294119, 294121-294123, 294126-294127, 294130, 294132-294138, 294140-294143, 294145-294147, 294149-294171, 294173-294176, 294178-294188, 294191-294192, 294194, 294197, 294199-294200, 294205, 294208-294213, 294215-294217, 294219-294223, 294225-294228, 294230-294233, 294235-294237, 294239-294249, 294252-294256, 294258-294260, 294263-294264, 294266-294267, 294269, 294271-294273, 294275-294278, 294281-294290, 294294-294303, 294305, 294307-294309, 294312-294314, 294316, 294318-294322, 294324, 294326-294327, 294330, 294334, 294338-294340, 294344-294349, 294351, 294353-294354, 294357-294361, 294364, 294367-294368, 294371, 294373-294374, 294376-294378, 294382-294385, 294387-294390, 294393-294395, 294398-294401, 294406-294410, 294413-294414, 294416-294418, 294422, 294424-294425, 294428, 294430-294433, 294436-294441, 294443, 294445, 294447-294448, 294450, 294455-294458, 294460-294462, 294464-294465, 294467, 294470, 294472-294474, 294476-294478, 294482-294483, 294486-294492, 294494-294501, 294504-294520, 294522-294527, 294529-294540, 294542, 294544, 294546, 294548-294550, 294556, 294560-294561, 294563, 294565, 294567-294570, 294572, 294574-294583, 294585, 294587-294590, 294594, 294598-294599, 294601, 294604, 294606, 294608, 294611-294612, 294614-294620, 294622-294623, 294627-294628, 294631, 294635, 294637-294638, 294640-294642, 294644, 294646-294647, 294649, 294651, 294656, 294658-294659, 294663-294664, 294667, 294670-294672, 294675, 294677, 294679-294682, 294684-294685, 294687-294691, 294695-294698, 294700, 294702, 294704-294705, 294707, 294709, 294713, 294715, 294717-294718, 294720, 294726-294731, 294733, 294735, 294737-294738, 294740, 294742-294743, 294745-294747, 294750, 294753-294757, 294759, 294761-294762, 294764, 294767-294769, 294771-294772, 294775-294782, 294784-294788, 294790-294791, 294795-294802, 294804-294812, 294814-294815, 294822-294823, 294826-294829, 294831-294832, 294834, 294836-294837, 294839-294840, 294842, 294844-294845, 294848-294853, 294855-294859, 294861, 294866-294870, 294872, 294879, 294883, 294886-294894, 294896, 294898-294900, 294902-294909, 294911-294912, 294914-294918, 294920-294923, 294925-294927, 294929-294930, 294932-294934, 294936-294937, 294940, 294942, 294944, 294946-

294950, 294954, 294962-294968, 294970-294971, 294975-294980, 294982, 294984-294985, 294987-294988, 294990-294991, 294994-294996, 294999-295000, 295002-295004, 295006-295007, 295010-295012, 295015-295016, 295018, 295020, 295024-295034, 295036, 295038, 295040-295051, 295053, 295057-295059, 295061-295067, 295069, 295075, 295077-295079, 295081-295084, 295087-295089, 295092, 295094, 295096-295097, 295099-295101, 295104-295108, 295110-295111, 295113-295114, 295118, 295121-295123, 295125-295130, 295132, 295134, 295137-295141, 295144-295147, 295149-295151, 295155-295156, 295158-295163, 295165-295166, 295169, 295171-295178, 295180-295183, 295185-295187, 295191-295193, 295195, 295197-295198, 295200-295202, 295204-295210, 295212, 295214-295216, 295220, 295223, 295225, 295230, 295232, 295234-295235, 295238-295244, 295246, 295248-295249, 295251-295254, 295256, 295260, 295262, 295264, 295267-295274, 295276-295283, 295286-295287, 295289-295292, 295299-295304, 295306, 295308, 295310-295311, 295314-295315, 295321, 295323-295325, 295327-295328, 295330-295331, 295334-295335, 295337, 295340-295341, 295344, 295346-295350, 295352-295355, 295357-295359, 295363, 295369, 295371-295376, 295380, 295382-295384, 295389, 295391-295393, 295395-295396, 295400-295401, 295404-295405, 295409-295410, 295412-295414, 295416-295428, 295430-295434, 295436, 295439, 295443-295446, 295450-295452, 295459, 295464-295467, 295470, 295473, 295475-295479, 295481-295494, 295497, 295499-295508, 295510-295512, 295515-295516, 295518, 295520-295521, 295524-295525, 295529-295530, 295535-295536, 295538-295541, 295543, 295545-295548, 295550-295552, 295558-295561, 295563, 295568, 295571-295572, 295576-295577, 295579, 295581, 295583-295587, 295589-295590, 295593-295595, 295599, 295602-295603, 295605, 295609, 295614, 295617-295619, 295622, 295625-295629, 295632-295636, 295638, 295640-295642, 295645-295652, 295655, 295658-295661, 295663-295668, 295670, 295672, 295675, 295677, 295683, 295690, 295692-295695, 295699, 295701, 295703, 295705, 295710, 295717-295718, 295720-295721, 295723, 295726-295728, 295730, 295732-295740, 295743-295744, 295748-295750, 295754-295755, 295762-295769, 295773-295776, 295778-295780, 295783-295787, 295790, 295792-295794, 295796-295798, 295800-295801, 295803-295805, 295809-295813, 295818-295819, 295823, 295830-295832, 295834, 295837-295838, 295841-295851, 295853-295862, 295864-295866, 295868-295869, 295871-295874, 295876-295882, 295884, 295886-295892, 295894-295896, 295898, 295903, 295905-295912, 295915, 295917-295923, 295925-295928, 295930-295931, 295933-295935, 295937, 295939-295942, 295944-295948, 295952-295953, 295955-295956, 295958, 295962-295967, 295969-295971, 295974-295975, 295979, 295981-295982, 295985-295989, 295991, 295993-295995, 295997-295998, 296001, 296004, 296010, 296012-296013, 296016-296020, 296023, 296025-296026, 296029, 296031-296035, 296037-296039, 296044, 296046, 296052-296053, 296055-296060, 296063, 296066-296070, 296073-296086, 296088-296091, 296095, 296098-296099, 296102, 296109-296110, 296112-296115, 296117-296118, 296120-296122, 296124-296128, 296130-296132, 296134-296137, 296139-296140, 296143-296151, 296153-296157, 296159, 296161, 296163-296167, 296170-296172, 296175-296176, 296178-296180, 296182-296183, 296186-296189, 296191-296194, 296197-296198, 296200, 296205-296206, 296208-296217, 296220, 296224-296228, 296231, 296234, 296236, 296238-296241, 296244, 296246, 296250-296256, 296258-296261, 296263-296265, 296267-296270, 296272, 296276-296287, 296289-296294, 296296-296297, 296300, 296303, 296305, 296307, 296309-296310, 296312-296317, 296319, 296322, 296325-296327, 296331, 296334-296336, 296338, 296340-296354, 296357-296361, 296365-296367, 296371-296376, 296378-296380, 296382, 296384-296385, 296390-296391, 296393-296403, 296408-296415, 296417-296421, 296424-296425, 296427, 296429-296430, 296433, 296435-296436, 296439-296442, 296447-296450, 296453-296460, 296464-296468, 296471-296473, 296475-296476, 296478-296484, 296488, 296491-296493, 296496, 296499, 296501, 296503, 296507, 296514, 296516, 296520-296535, 296537-296540, 296543-296546, 296548-296553, 296556, 296558-296559, 296561-296562, 296564, 296566-296567, 296569-296572, 296575, 296577-296580, 296582-296589, 296593-296597, 296599, 296601, 296603-296613, 296615-296616, 296618, 296620-296623, 296628, 296632, 296634, 296636, 296638-296642, 296644, 296648-296650, 296655, 296658, 296660-296663, 296665, 296667-296668, 296670-296672, 296674-296675, 296678, 296683-296687, 296692-296695, 296697-296699, 296702-296708, 296711-296712, 296714-296717, 296719, 296721, 296723-296724, 296727-296729, 296734, 296740, 296745-296747, 296750, 296753-296755, 296757, 296764, 296767-296769, 296771-296776, 296778-296779, 296782-296787, 296789-296794, 296796, 296798-296801, 296804-296806, 296808-296820, 296822-296823, 296825, 296827, 296831, 296833-296834, 296837-296843, 296845, 296847, 296849, 296851, 296854-296856, 296858-296860, 296865-296867, 296869-296871, 296873-296874, 296878-296888, 296890, 296893-296900, 296902-296903, 296905-296907, 296910, 296913-296915, 296917-296921, 296923-296927, 296937-296938, 296941, 296943-296944, 296946-296949, 296951, 296953, 296955-296958, 296961-296962, 296964, 296967-296972, 296974, 296980, 296982-296983, 296985-296990, 296992, 296995-296998, 297001, 297004-297010, 297012, 297015-297017, 297019, 297021-297028, 297030-297031, 297034-297036, 297038, 297041-297042, 297045-297046, 297049, 297053, 297058, 297061-297074, 297077, 297080, 297082, 297086, 297088-297089, 297092, 297095-297098, 297102, 297104, 297106-297108, 297110-297111, 297113, 297115, 297117-297118, 297120-297123, 297125-297128, 297130-297137, 297139-297140, 297142, 297145-297146, 297148, 297151-297164, 297166-297170, 297172, 297174-297176, 297178, 297180-297182, 297185, 297187-297188, 297190-297192, 297195-297197, 297199, 297202, 297204-297209, 297215-297216, 297218, 297221, 297224, 297227-297237, 297239, 297241-297242, 297245-297247, 297250-297263, 297265, 297268, 297271, 297273-297275, 297277, 297280-297283, 297285-297286, 297288-297292, 297294, 297296, 297298-297303, 297310, 297312-297314, 297317, 297320, 297322-297331, 297334-297337, 297339-297342, 297344, 297346-297348, 297350-297351, 297353-297354, 297356-297361, 297363-297364, 297367, 297371, 297376, 297378-297379, 297381-297382, 297384, 297388, 297390-297391, 297395-297396, 297400, 297402, 297404-297412, 297415, 297417-297420, 297423-297425, 297427-297428, 297431, 297433, 297437, 297439-297444, 297447-297448, 297450-297451, 297453, 297460-297461, 297463, 297465-297468, 297473, 297475-297477, 297481, 297484, 297486-297487, 297489, 297492, 297495, 297502-297504, 297506, 297514-297515, 297517-297519, 297521, 297523-297525, 297527, 297530-297531, 297533-297540, 297542-297544, 297546-297550, 297552-297553, 297557, 297559, 297561, 297563-297564, 297567-297568, 297573-297578, 297580, 297582, 297585-297587, 297590-297591, 297593-297601, 297603, 297606, 297608-297609, 297618, 297620-297623, 297625, 297627-297632, 297635-297639, 297641, 297644-297648, 297651-297660, 297662-297663, 297666-297669, 297671, 297673-297674, 297678, 297682-297684, 297687-297688, 297693, 297697-297698, 297700-297701, 297703-297704, 297707, 297711-297712, 297714-297720, 297722-297723, 297725, 297727-297731, 297733, 297735, 297737, 297740-297741, 297744-297745, 297747-297762, 297764-297768, 297770, 297772-297774, 297777, 297779, 297781-297785, 297788-297789, 297791-297797, 297799, 297803, 297805-297809, 297811, 297814, 297816-297818, 297822-297823, 297831, 297834-297835, 297838, 297840-297842, 297848, 297850, 297854, 297857-297858, 297861, 297865-297867, 297869-297874, 297877-297878, 297882-297883, 297885-297886, 297888-297889, 297891-297896, 297898, 297905-297908, 297911, 297917-297919, 297921-297925, 297934, 297938, 297940-297941, 297943, 297945, 297947-297951, 297953, 297955, 297958-297959, 297962-297964, 297967, 297969-297971, 297973-297978, 297982, 297984, 297987, 297990, 297992-297996, 298002, 298004-298006, 298009, 298013-298018, 298020-298021, 298023-298025, 298027-298031, 298035-298036, 298039, 298042-298044, 298046-298048, 298052, 298054-298056, 298058-298059, 298062-298063, 298066, 298068-298072, 298074, 298077-298079, 298081-298082, 298085, 298088, 298092-298094, 298096, 298098-298099, 298101-298103, 298105-298108, 298110-298113, 298115, 298119-298120, 298122-298124, 298127, 298131-298136, 298138-298142, 298146-298147, 298149-298151, 298153-298163, 298165, 298168-298174, 298180-298184, 298186, 298188-298189, 298191-298192, 298194-298195, 298200-298211, 298213-298214, 298216-298222, 298224, 298227-298229, 298231-298232, 298235-298236, 298239, 298241-298243, 298245-298253, 298255, 298258-298261, 298263-298264, 298266, 298268-298271, 298274, 298276-298279, 298281-298282, 298285-298290, 298292, 298294-298296, 298298, 298300, 298302-298304, 298306-298311, 298314-298328, 298330, 298332, 298335-298340, 298344, 298346, 298348-298350, 298352-298353, 298355, 298357, 298360, 298362-298366, 298368-298369, 298371, 298374, 298378-298379, 298382, 298384-298390, 298393-298395, 298397-298410, 298412, 298422, 298428-298431, 298434-298435, 298437-298439, 298442-298446, 298449, 298452-298454, 298459, 298461-298467, 298470, 298472-298475, 298482-298483, 298485-298498, 298501-298509, 298511, 298514, 298517-298520, 298522-298526, 298528, 298530, 298533, 298535-298538, 298544-298546, 298548, 298550, 298554, 298556-298558, 298560, 298566-298569, 298571-298580, 298582-298584, 298586, 298588, 298592-298594, 298596-298598, 298601-298603, 298606-298607, 298610-298615, 298618-298623, 298625, 298627-298629, 298631-298635, 298637, 298639-298640, 298643-298648, 298650, 298653-298654, 298656-298662, 298665-298666, 298668, 298670-298671, 298678-298690, 298693-298700, 298704-298705, 298707, 298709, 298711, 298713, 298715-298720, 298722-298731, 298733, 298735-298739, 298742-298747, 298749-298751, 298755, 298758, 298761, 298764-298765, 298767, 298770-298776, 298778-298781, 298784-298794, 298803-298805, 298809, 298812-298813, 298816, 298819-298831, 298834-298839, 298841-298850, 298854-298855, 298857, 298859-298863, 298865-298868, 298871, 298873-298874, 298876-298877, 298880, 298882, 298884, 298887, 298889-298892, 298897, 298899, 298901, 298903-298904, 298906-298909, 298912-298913, 298915-298918, 298921, 298923-298929, 298933, 298937-298938, 298941-298943, 298945, 298947-298948, 298950, 298952-298953, 298955, 298957, 298960-298962, 298965, 298967-298968, 298970-298972, 298978, 298980-298981, 298984, 298987, 298990, 298992-298999, 299001, 299007, 299009, 299013-299014, 299016-299020, 299024, 299027, 299029-299035, 299039, 299041-299043, 299046-299056, 299058-299059, 299061-299063, 299065, 299067, 299071, 299073, 299075-299078, 299080-299084, 299087, 299089-299090, 299093, 299096-299101, 299106-299107, 299110-299115, 299117-299120, 299123-299124, 299132, 299136, 299138, 299140-299141, 299143, 299145-299146, 299148-299150, 299153, 299162-299165, 299170-299178, 299180-299183, 299185-299187, 299192-299196, 299198, 299202-299203, 299206-299207, 299209-299210, 299212-299214, 299216-299218, 299221-299225, 299227-299236, 299238, 299240, 299242, 299244, 299246-299247, 299249, 299251-299253, 299255, 299257-299258, 299263, 299265-299266, 299268-299270, 299274-299276, 299278-299280, 299282-299283, 299286-299287, 299292-299295, 299297-299299, 299301-299304, 299306-299307, 299311-299315, 299317, 299319, 299321-299322, 299324, 299328, 299331, 299333-299334, 299338-299341, 299343, 299345-299346, 299349-299353, 299356, 299361-299362, 299364, 299367-299371, 299374, 299376-299379, 299381-299382, 299384-299385, 299387, 299390, 299393, 299395-299396, 299400, 299402, 299406-299407, 299409-299411, 299413-299414, 299417, 299419, 299421-299422, 299425-299430, 299432, 299436, 299438-299439, 299442, 299444-299445, 299447-299448, 299450-299452, 299454, 299459-299460, 299466, 299468, 299470-299472, 299474, 299476-299477, 299479, 299483-299487, 299489-299498, 299500, 299503-299506, 299508-299510, 299512-299513, 299516-299517, 299520, 299523, 299525-299527, 299530-299532, 299534, 299537-299539, 299541, 299544-299548, 299550-299551, 299553, 299555-299563, 299565, 299567, 299569-299574, 299576, 299578, 299581, 299583-299588, 299590-299591, 299593, 299595, 299598-299607, 299609, 299613, 299615, 299619-299621, 299623-299628, 299632-299635, 299637-299640, 299642-299646, 299648-299652, 299655, 299657, 299659, 299661, 299663, 299666, 299668, 299670-299671, 299674-299676, 299678-299679, 299681, 299683, 299685-299687, 299692-299694, 299696-299700, 299702-299703, 299705, 299707, 299710, 299712, 299714-299715, 299717, 299719-299730, 299734-299735, 299737, 299739-299740, 299742, 299747-299749, 299755-299756, 299758-299759, 299761-299762, 299765-299766, 299768-299779, 299781, 299783-299784, 299786-299789, 299791, 299796-299797, 299799, 299803-299805, 299807-299810, 299812, 299814-299815, 299818-299819, 299823-299824, 299827-299830, 299832-299834, 299837, 299840, 299842-299843, 299845, 299848, 299850, 299853-299856, 299858-299859, 299861-299862, 299864, 299871-299872, 299874-299875, 299877-299879, 299881, 299884, 299886-299887, 299889, 299891, 299893, 299895-299901, 299903-299906, 299908-299916, 299919-299926, 299929-299932, 299939-299940, 299942, 299946-299947, 299951, 299953-299956, 299958-299960, 299963-299964, 299966-299967, 299969, 299971, 299973-299976, 299979, 299981-299985, 299987, 299991-299996, 299998-299999, 300001-300006, 300008, 300010, 300012-300017, 300021-300025, 300029-300030, 300032, 300034-300045, 300047, 300049-300050, 300052-300059, 300061-300064, 300066-300067, 300069-300070, 300072, 300075-300081, 300084-300085, 300089-300092, 300094, 300096-300097, 300099-300100, 300102, 300104, 300106-300113, 300115-300119, 300121-300125, 300127, 300133, 300135-300138, 300140-300141, 300143, 300146-300148, 300151, 300154, 300157-300161, 300163-300171, 300173, 300175-300179, 300185-300187, 300189-300195, 300198-300199, 300202, 300204-300209, 300211-300214, 300217-300218, 300220-300221, 300223, 300227, 300229-300237, 300239, 300242-300245, 300247, 300249-300255, 300260-300261, 300265-300266, 300268, 300272-300273, 300278-300279, 300281-300284, 300286, 300292-300293, 300295-300296, 300298, 300300, 300303-300305, 300309-300311, 300313-300325, 300329, 300331-300333, 300335-300337, 300339, 300342, 300344, 300346, 300352-300356, 300359, 300364-300367, 300370-300371, 300373-300383, 300385-300387, 300390-300394, 300396-300397, 300399-300402, 300404, 300407, 300410-300416, 300418-300419, 300421, 300423-300424, 300426, 300428, 300430-300431, 300434-300441, 300443, 300445-300446, 300448-300449, 300451-300452, 300454-300455, 300458, 300460-300461, 300464-300467, 300469, 300471-300473, 300475, 300480, 300484, 300487-300490, 300492, 300494-300495, 300497, 300500-300504, 300507-300508, 300513-300517, 300519, 300521, 300523-300527, 300529-300530, 300533-300537, 300539-300540, 300542-300543, 300545-300549, 300552-300554, 300558, 300560-300561, 300563-300567, 300569-300570, 300572, 300574-300578, 300580, 300582, 300584, 300586-300593, 300595, 300597-300599, 300601-300607, 300610-300613, 300615-300619, 300621, 300624-300626, 300628-300630, 300632, 300638-300639, 300641, 300643, 300645-300646, 300648-300650, 300652, 300655, 300659-300662, 300665-300666, 300670-300671, 300676-300684, 300686, 300688, 300690, 300692-300695, 300698-300703, 300706-300707, 300709, 300711, 300713-300715, 300718-300719, 300721, 300723-300725, 300728, 300730-300732, 300735-300737, 300741, 300743-300747, 300749-300751, 300753-300755, 300757-300760, 300762, 300765, 300767-300771, 300773, 300775, 300778, 300780-300781, 300783, 300786-300788, 300794, 300797-300800, 300802-300803, 300805-300807, 300810, 300812-300816, 300820-300822, 300824-300837, 300840, 300842-300843, 300845, 300849-300852, 300863-300864, 300866-300867, 300869, 300871-300875, 300879-300880, 300882-300885, 300887-300888, 300890, 300893, 300896, 300898-300899, 300902-300903, 300905-300916, 300924-300926, 300928, 300930-300931, 300934, 300936-300937, 300939-300940, 300946-300948, 300950-300951, 300954-300956, 300959-300960, 300962, 300965-300967, 300969, 300977, 300982-300985, 300988-300989, 300991-300992, 300995-300997, 300999-301000, 301003-301008, 301010-301012, 301014-301018, 301020-301025, 301027, 301029-301031, 301033, 301035, 301037-301040, 301042, 301044-301047, 301049-301053, 301056-301058, 301060-301065, 301067-301068, 301070-301072, 301074-301075, 301077-301079, 301082-301083, 301088, 301091, 301093, 301095-301096, 301100-301102, 301106, 301112, 301114, 301121-301123, 301125-301126, 301134-301135, 301139, 301141-301144, 301147-301148, 301151-301158, 301160-301164, 301166-301171, 301173-301176, 301178-301179, 301181-301182, 301184, 301186-301190, 301193-301199, 301201-301202, 301204, 301206, 301208-301216, 301218-301222, 301225, 301227, 301229-301230, 301232, 301235, 301237-301238, 301243-301244, 301247, 301249-301254, 301256-301258, 301260-301263, 301265-301266, 301269-301271, 301273, 301275, 301277, 301280, 301283-301287, 301289-301290, 301292, 301295-301296, 301299, 301301-301304, 301306-301308, 301311-301313, 301316, 301319-301327, 301330-301332, 301335-301337, 301339-301340, 301345, 301347, 301349-301351, 301357-301360, 301362-301365, 301367-301368, 301370-301376, 301380, 301382, 301385-301388, 301390-301394, 301396-301397, 301402-301411, 301413-301414, 301416-301417, 301419, 301423-301435, 301437-301438, 301440, 301442, 301450-301451, 301456-301457, 301462, 301464-301465, 301467-301468, 301473-301475, 301479-301486, 301489-301492, 301494-301497, 301500, 301502-301507, 301509, 301511, 301513-301516, 301525-301526, 301528-301529, 301531, 301540, 301544-301545, 301547, 301551, 301562, 301566-301571, 301573, 301575, 301578, 301580-301581, 301584-301586, 301588-301590, 301592-301594, 301598, 301607, 301612, 301615-301618, 301620, 301623-301630, 301632-301640, 301646-301648, 301650, 301652, 301654, 301656-301657, 301659-301660, 301662, 301664, 301666, 301668, 301672, 301674-301679, 301684-301687, 301689, 301691-301694, 301696-301697, 301699, 301703-301707, 301709-301714, 301719, 301721, 301724, 301727-301729, 301731-301732, 301734-301735, 301737-301741, 301744, 301749-301752, 301754-301755, 301757-301758, 301762, 301767, 301771, 301774-301779, 301782-301788, 301796-301797, 301800-301808, 301815-301831, 301834-301838, 301840-301841, 301844, 301846-301848, 301851, 301853-301855, 301861-301866, 301870-301871, 301873-301874, 301876, 301878-301882, 301884-301885, 301887-301888, 301890-301892, 301894, 301897-301902, 301904, 301906, 301908-301909, 301912-301914, 301916, 301921-301926, 301928, 301930-301936, 301938-301942, 301946-301949, 301952-301956, 301958, 301960-301961, 301963-301964, 301966-301968, 301977-301983, 301985-301990, 301993, 301995, 301999-302007, 302011, 302013, 302015-302016, 302022-302023, 302025, 302027-302032, 302034, 302036-302044, 302046-302049, 302051-302052, 302055-302057, 302061-302064, 302067-302072, 302074-302077, 302079, 302081-302082, 302091, 302098-302099, 302104, 302107-302108, 302110, 302112, 302114-302117, 302119, 302121-302122, 302124-302126, 302128-302131, 302133, 302135-302148, 302151, 302154, 302157-302158, 302160-302163, 302169, 302171, 302181-302183, 302186, 302188-302189, 302191-302200, 302206-302213, 302215, 302217-302226, 302230-302231, 302236-302242, 302244-302246, 302248, 302252, 302256, 302259-302263, 302266, 302268-302269, 302279, 302281-302284, 302287-302292, 302295, 302298-302300, 302302-302303, 302307, 302310-302313, 302315-302316, 302322, 302325-302327, 302329-302330, 302332-302333, 302336, 302339-302345, 302348-302349, 302352-302356, 302358-302359, 302361, 302363-302364, 302366-302372, 302375-302376, 302378, 302381-302384, 302386-302387, 302389, 302393-302395, 302399-302401, 302403, 302406, 302408, 302411-302413, 302422, 302424, 302426-302431, 302434, 302436, 302438-302448, 302451-302453, 302459, 302461, 302464-302465, 302467, 302469-302471, 302473-302475, 302477-302482, 302484-302485, 302487-302488, 302490-302491, 302499-302500, 302502-302505, 302507, 302509-302510, 302512, 302514, 302516, 302518, 302520-302521, 302524-302525, 302527-302529, 302531, 302533-302535, 302537, 302542-302544, 302546-302549, 302552, 302554-302555, 302557, 302559-302563, 302565, 302567-302571, 302575-302576, 302578, 302580, 302583-302586, 302588-302594, 302596, 302600, 302603, 302606-302609, 302613-302614, 302620, 302622-302626, 302628, 302630-302632, 302635-302636, 302638, 302640-302641, 302643-302644, 302647, 302651, 302653-302654, 302656-302659, 302661-302663, 302668-302671, 302675, 302677, 302681-302691, 302693, 302695-302696, 302698, 302701-302702, 302704-302707, 302710-302711, 302715-302716, 302718-302720, 302722-302723, 302726, 302732, 302734-302738, 302740-302742, 302744-302747, 302751-302755, 302757, 302759-302760, 302762, 302764, 302767-302776, 302778-302780, 302782-302786, 302788-302790, 302792-302794, 302796, 302799, 302803-302804, 302807-302808, 302810, 302814, 302816-302821, 302824-302826, 302828-302830, 302836-302843, 302848-302853, 302855, 302857-302861, 302863-302864, 302866-302868, 302870-302876, 302878-302880, 302883-302887, 302889, 302891, 302893-302898, 302900, 302902-302904, 302906-302907, 302910-302912, 302914-302915, 302917-302918, 302921, 302923, 302926-302931, 302934, 302936, 302938, 302941, 302943-302950, 302953-302954, 302958-302961, 302963-302966, 302969, 302971-302975, 302977-302979, 302981, 302983-302984, 302986-302992, 302994-302995, 302997-302999, 303001-303003, 303006-303008, 303011-303014, 303016-303018, 303021-303023, 303025-303027, 303029, 303031-303036, 303040, 303042, 303044-303048, 303053-303058, 303061-303065, 303069-303070, 303076-303079, 303081-303083, 303085, 303087-303091, 303094, 303096-303104, 303106, 303108-303110, 303112, 303114-303115, 303118-303124, 303126-303127, 303132-303133, 303140-303142, 303144-303145, 303147, 303152-303156, 303158, 303160, 303162, 303164-303165, 303167-303168, 303171-303172, 303174-303179, 303181-303182, 303184-303185, 303189-303190, 303192, 303194, 303197-303207, 303209-303214, 303217-303228, 303230-303231, 303233, 303235-303236, 303238, 303240-303242, 303244, 303246-303250, 303252, 303258, 303260, 303262, 303264-303266, 303270-303273, 303277, 303279-303281, 303283, 303286-303294, 303296-303298, 303300-303301, 303303-303306, 303310-303312, 303314-303315, 303317, 303319-303320, 303322-303325, 303327-303329, 303331-303332, 303334-303336, 303338-303339, 303341, 303343-303344, 303346-303356, 303359-303363, 303366-303367, 303369, 303371-303372, 303374-303375, 303378-303379, 303381-303383, 303385-303387, 303391-303393, 303396-303397, 303399-303405, 303408-303414, 303417-303418, 303421, 303423-303425, 303427-303428, 303430-303432, 303434-303435, 303437-303440, 303443-303447, 303449-303451, 303454-303455, 303457-303458, 303460-303461, 303466, 303469-303472, 303474-303476, 303478, 303480-303484, 303486-303488, 303491-303494, 303496-303500, 303503-303508, 303514-303517, 303521, 303525, 303527-303528, 303530, 303533-303535, 303537, 303540-303545, 303547-303549, 303551-303552, 303554, 303556-303560, 303562-303563, 303566-303568, 303570, 303572-303573, 303575-303579, 303581-303585, 303588, 303590, 303592-303593, 303599, 303601-303608, 303610, 303613-303618, 303620-303624, 303628-303634, 303636-303642, 303644-303648, 303650, 303653-303654, 303656-303657, 303660-303662, 303665-303672, 303675-303680, 303682-303685, 303688-303691, 303693-303696, 303698-303699, 303701-303702, 303704, 303707, 303711-303716, 303721, 303723-303724, 303726-303727, 303729, 303731-303734, 303736-303745, 303747-303750, 303754, 303756-303758, 303764-303766, 303768, 303771-303772, 303776-303789, 303791-303793, 303795-303803, 303806-303808, 303810, 303812-303816, 303818-303820, 303822, 303825, 303827-303831, 303833-303835, 303839-303844, 303846, 303848-303858, 303861, 303864-303865, 303867-303874, 303877-303879, 303886-303887, 303889-303891, 303893-303896, 303899, 303901-303904, 303907-303913, 303915-303920, 303923-303924, 303926-303930, 303933, 303935, 303937-303938, 303941, 303943, 303945-303946, 303949-303950, 303952-303954, 303956-303957, 303960-303961, 303964-303965, 303967-303970, 303972, 303974-303978, 303980-303984, 303987-303988, 303991, 303993-303995, 303998-303999, 304001-304003, 304005-304009, 304011, 304013-304016, 304018, 304020-304022, 304025, 304027-304032, 304034-304035, 304038-304039, 304042, 304045-304049, 304051, 304055-304057, 304059, 304061-304063, 304065-304070, 304074, 304076-304083, 304087, 304089-304092, 304094, 304096, 304100-304102, 304106, 304110-304112, 304115, 304119-304120, 304124-304126, 304128, 304130-304136, 304138, 304140, 304144-304146, 304160, 304162-304165, 304171, 304174-304175, 304177, 304179-304185, 304187, 304190-304192, 304195, 304197, 304199-304200, 304202, 304205-304208, 304210-304212, 304214-304224, 304226, 304233, 304235-304240, 304244, 304247-304250, 304252-304255, 304257-304261, 304263, 304266-304267, 304269-304270, 304274-304276, 304278-304283, 304285-304289, 304292-304293, 304295-304297, 304300-304304, 304306, 304311-304315, 304318, 304321, 304323-304328, 304334-304338, 304340-304341, 304343-304344, 304346-304350, 304352, 304354-304355, 304357-304359, 304361-304363, 304365, 304367, 304369-304374, 304377, 304380-304382, 304384-304386, 304388, 304391-304405, 304409, 304413-304418, 304420-304425, 304427, 304429-304436, 304438-304439, 304442-304444, 304448-304449, 304452-304453, 304455-304460, 304463-304469, 304471-304473, 304475-304478, 304480-304481, 304483-304485, 304488-304492, 304495, 304499, 304501-304503, 304505-304508, 304511-304513, 304515-304519, 304521-304525, 304527-304529, 304532, 304535-304537, 304539-304540, 304544-304546, 304548-304550, 304554-304556, 304561-304563, 304565, 304570-304571, 304573-304574, 304576, 304580-304581, 304584, 304587-304588, 304590-304591, 304593-304600, 304602-304613, 304616-304620, 304623-304624, 304626, 304629-304630, 304632-304634, 304637, 304639, 304641-304642, 304645-304646, 304654, 304657, 304660-304661, 304663-304664, 304667-304668, 304670, 304672-304675, 304678, 304682, 304685, 304687-304689, 304691-304692, 304694-304697, 304699-304701, 304703, 304707-304708, 304710-304718, 304721, 304723-304724, 304726, 304728-304729, 304732, 304735, 304737-304738, 304740, 304742-304746, 304748-304749, 304755-304757, 304759, 304761-304773, 304776-304778, 304780-304782, 304785, 304788-304794, 304796-304800, 304803, 304805, 304807-304811, 304813, 304815, 304818, 304820-304821, 304823-304827, 304829-304830, 304832-304838, 304841, 304845-304854, 304856-304857, 304860-304868, 304871-304873, 304875, 304877-304879, 304881-304882, 304884-304891, 304895-304896, 304898-304899, 304901-304903, 304905-304908, 304910-304911, 304918, 304921-304925, 304930-304931, 304933-304948, 304950-304951, 304953-304956, 304960, 304963, 304967, 304969-304972, 304974, 304976, 304978, 304980-304991, 304995-305002, 305005-305008, 305010-305012, 305015-305017, 305019, 305022-305032, 305034-305035, 305037-305042, 305044, 305046-305048, 305050, 305052-305064, 305066, 305069-305076, 305078-305080, 305082, 305084-305086, 305089, 305091-305095, 305097, 305100, 305102-305103, 305105-305106, 305112, 305114-305118, 305122-305128, 305130-305133, 305135, 305137-305138, 305141-305145, 305150-305151, 305153, 305158-305161, 305163-305165, 305169-305170, 305172-305177, 305179-305180, 305183-305184, 305186, 305188-305191, 305193-305196, 305198-305200, 305202, 305204, 305206-305209, 305214, 305216, 305218-305221, 305223, 305227-305228, 305230, 305236, 305238, 305241-305243, 305245, 305247, 305249-305250, 305252-305254, 305257-305258, 305260, 305263, 305266-305271, 305274-305275, 305277-305278, 305281-305284, 305287, 305289-305291, 305293-305299, 305302-305303, 305305-305306, 305308-305310, 305314-305317, 305319-305320, 305322, 305324, 305328-305330, 305332-305333, 305335, 305337-305344, 305346-305349, 305351, 305354-305357, 305359-305362, 305365-305372, 305374, 305376, 305378-305387, 305389-305390, 305392-305398, 305400-305401, 305404-305406, 305408, 305410-305411, 305414, 305417-305422, 305428, 305432-305434, 305436-305437, 305444-305445, 305447-305448, 305450, 305452-305456, 305458-305462, 305468, 305471-305474, 305476, 305478-305480, 305486-305487, 305491-305492, 305494, 305497-305502, 305504, 305508, 305512, 305514-305529, 305532, 305534, 305536-305539, 305541-305542, 305544-305545, 305549, 305551-305552, 305554, 305557-305558, 305560-305573, 305575-305576, 305579-305581, 305583, 305585-305595, 305597-305598, 305602-305603, 305608, 305610-305617, 305619, 305621-305622, 305624, 305626-305628, 305630, 305632, 305634, 305636, 305638, 305643-305645, 305647-305650, 305652, 305658-305666, 305668-305670, 305675, 305679, 305682-305684, 305687-305691, 305694-305698, 305701-305721, 305724-305730, 305732-305740, 305743-305746, 305749-305751, 305753, 305755-305756, 305759-305769, 305772, 305774-305776, 305778, 305783-305784, 305786-305788, 305790-305793, 305796, 305802, 305805-305807, 305809, 305811, 305813, 305815, 305818-305820, 305822, 305826, 305829-305835, 305837-305838, 305843-305847, 305849, 305851-305857, 305859, 305862, 305865-305869, 305871, 305874-305875, 305879-305881, 305886-305887, 305891-305899, 305902-305905, 305908-305910, 305912-305916, 305918-305921, 305923-305925, 305927, 305929, 305931-305932, 305936-305938, 305942, 305944-305945, 305948-305949, 305951-305952, 305955-305957, 305960, 305964-305965, 305967-305977, 305979, 305981-305982, 305984, 305986, 305988-305991, 305994-305995, 305998, 306002, 306005, 306008-306015, 306017, 306020-306021, 306023, 306025, 306027-306033, 306035-306038, 306040-306041, 306043-306045, 306053-306055, 306063-306065, 306067-306068, 306073, 306077, 306079-306084, 306088-306097, 306099, 306103, 306105-306106, 306112-306113, 306115-306118, 306121, 306123-306124, 306127, 306130, 306133-306134, 306138-306140, 306143-306146, 306152-306155, 306164-306165, 306167, 306173-306176, 306180-306187, 306191, 306194-306196, 306199-306202, 306205-306207, 306209-306210, 306215-306222, 306225-306226, 306231, 306233-306234, 306236-306238, 306240-306241, 306244-306245, 306247, 306251-306252, 306254-306262, 306265, 306270, 306274-306276, 306278-306279, 306281-306282, 306285, 306288-306289, 306291, 306295, 306297-306298, 306300, 306302-306303, 306306-306312, 306314, 306317, 306321-306322, 306324-306328, 306333, 306337, 306339-306341, 306343-306344, 306346-306347, 306349-306354, 306356-306359, 306363, 306365, 306369, 306372-306376, 306378-306380, 306382-306386, 306390-306393, 306395-306403, 306406-306407, 306411-306412, 306415-306417, 306419-306420, 306425-306429, 306431-306439, 306441, 306443-306449, 306452, 306455-306468, 306471, 306473-306479, 306481, 306483, 306486, 306488-306489, 306491, 306493-306494, 306498, 306503, 306505-306507, 306509, 306511-306517, 306519-306520, 306522, 306524, 306526, 306529, 306534-306535, 306537, 306542, 306544, 306547, 306549, 306551, 306553-306555, 306557-306558, 306562, 306565, 306568, 306571, 306573, 306575, 306577, 306579-306581, 306583, 306585, 306589-306590, 306592-306593, 306595, 306597, 306599, 306601-306603, 306605, 306608-306610, 306615-306616, 306618, 306621-306622, 306628, 306630, 306633-306635, 306638, 306641-306643, 306646-306649, 306653, 306655-306658, 306664, 306666-306669, 306673-306677, 306680-306681, 306683-306684, 306688-306693, 306695, 306699-306701, 306703-306704, 306706, 306708, 306710, 306713, 306716-306717, 306719, 306721-306722, 306725, 306728-306730, 306735, 306737-306741, 306743-306749, 306751-306752, 306754-306755, 306757, 306759-306761, 306763-306764, 306766-306768, 306770, 306772, 306774-306776, 306778, 306781, 306783-306788, 306791, 306796-306804, 306806-306808, 306815-306816, 306821-306824, 306826, 306828-306829, 306831-306835, 306838-306840, 306843-306844, 306846-306848, 306850-306851, 306853-306854, 306856-306858, 306863-306865, 306867, 306869, 306872-306874, 306878-306880, 306886-306887, 306891-306896, 306898, 306900-306901, 306903-306904, 306907, 306909-306911, 306913, 306917, 306920, 306922, 306924-306928, 306930, 306933-306941, 306943-306946, 306948-306949, 306951-306955, 306957-306961, 306964-306966, 306971-306974, 306976-306978, 306980, 306983-306985, 306987-306988, 306991-306993, 306996, 306998, 307001-307008, 307010-307011, 307014-307015, 307017-307019, 307021, 307023, 307025, 307028-307033, 307038-307040, 307042-307045, 307049, 307051, 307057-307062, 307065-307066, 307068-307069, 307072-307075, 307077-307080, 307082-307084, 307087, 307089-307090, 307093-307100, 307102-307106, 307108-307113, 307117-307119, 307121-307122, 307124, 307126-307127, 307129-307135, 307137-307138, 307141-307145, 307148-307149, 307152-307155, 307157-307165, 307172-307174, 307176, 307182-307198, 307200-307201, 307203-307205, 307209-307210, 307213-307215, 307218-307220, 307223-307224, 307227-307229, 307231, 307233-307235, 307237-307240, 307242, 307246-307248, 307251-307253, 307255-307259, 307262, 307264-307265, 307267-307270, 307272, 307274-307278, 307280, 307282, 307284-307287, 307289, 307292, 307295, 307297-307299, 307301-307303, 307305-307310, 307312, 307314, 307316, 307318-307328, 307330-307331, 307335, 307341, 307343-307346, 307352, 307357-307360, 307363-307375, 307377, 307380-307381, 307383-307388, 307390, 307392-307397, 307399-307402, 307404-307405, 307407-307409, 307412, 307415, 307417, 307419-307431, 307433-307436, 307438, 307441-307443, 307447-307448, 307452-307453, 307455-307458, 307461-307462, 307464, 307466-307467, 307469, 307471, 307473-307476, 307478-307480, 307482, 307484-307485, 307487-307493, 307495-307507, 307509, 307511-307513, 307515-307524, 307526-307527, 307530-307532, 307534-307543, 307545-307548, 307552-307553, 307555-307558, 307561, 307563-307569, 307571, 307573, 307577-307579, 307582-307583, 307585, 307587, 307591-307593, 307595-307597, 307599-307600, 307602, 307604-307606, 307608, 307611-307621, 307623-307628, 307631, 307634-307636, 307638-307643, 307645, 307649-307651, 307658-307660, 307662, 307665-307666, 307670-307677, 307679-307685, 307692-307693, 307696-307697, 307699-307700, 307702-307707, 307709-307710, 307712-307722, 307724-307727, 307729-307730, 307732-307733, 307735-307741, 307744-307746, 307748-307752, 307754, 307757-307764, 307766-307768, 307770-307773, 307775-307781, 307785-307788, 307790-307791, 307796, 307799, 307801-307804, 307807, 307809-307813, 307816-307819, 307821, 307827-307832, 307834-307839, 307841-307848, 307850-307868, 307876, 307878-307880, 307882-307883, 307885-307889, 307891, 307893-307894, 307897, 307899-307900, 307902, 307905-307907, 307909, 307913-307916, 307918-307920, 307922-307924, 307928, 307931, 307933, 307935-307937, 307939-307940, 307944-307945, 307947, 307949, 307951-307955, 307959-307960, 307962-307965, 307970, 307972, 307974-307980

Single Strand Oligonucleotides (Sense Strand of Target Gene)
SeqID range: 306018-497728
SeqIDs w/o G Runs:
306020-306042, 306049-306054, 306057-306106, 306108-306112, 306115-306132, 306138-306149, 306163-306164, 306179-306216, 306225-306228, 306230-306247, 306250-306302, 306305-306310, 306312-306329, 306335-306346, 306354-306379, 306382-306394, 306396-306422, 306427-306433, 306435-306502, 306506-306520, 306522-306531, 306534, 306541-306544, 306548-306550, 306556-306597, 306602-306623, 306630-306659, 306664-306685, 306687-306690, 306693-306697, 306699-306703, 306715-306723, 306728-306736, 306738-306749, 306752-306782, 306788-306798, 306803-306804, 306807, 306814-306815, 306833-306854, 306856-306858, 306862-306864, 306867-306869, 306871-306905, 306909, 306920-306952, 306963-307021, 307023-307037, 307041-307048, 307052-307053, 307062-307063, 307067-307084, 307086-307104, 307111-307113, 307115-307148, 307154-307164, 307171-307286, 307295-307309, 307312-307314, 307316-307322, 307324-307352, 307355-307388, 307392-307444, 307446-307644, 307658-307679, 307694-307784, 307790-307882, 307888-307926, 307928-307940, 307942-307975, 307977-307980, 307997-308001, 308016-308023, 308038-308085, 308111-308124, 308138, 308153-308154, 308170-308181, 308203-308261, 308284-308344, 308359-308360, 308373-308436, 308457-308463, 308477-308480, 308495-308516, 308541-308550, 308564-308678, 308693, 308707-308854, 308869-308893, 308907-308928, 308942-308956, 308988-309010, 309024-309055, 309069-309083, 309098-309141, 309155-309157, 309171-309241, 309256-309279, 309300-309305, 309320-309344, 309374-309385, 309410-309449, 309464-309469, 309483-309488, 309507-309553, 309583-309626, 309641-309676, 309691-309800, 309814-309832, 309846-309867, 309881-309905, 309919-309948, 309962-309988, 310011-310021, 310039-310067, 310083-310118, 310132-310177, 310191-310201, 310221-310233, 310254-310268, 310282-310291, 310305-310335, 310349-310368, 310382-310830, 310844-310905, 310934-310952, 310966-311057, 311081-311300, 311314-311393, 311407-311442, 311456-311459, 311473-311571, 311585-311939, 311942-311974, 311976-312015, 312029-312073, 312083-312921, 312935-312995, 312998-313018, 313027-313437, 313451-313868, 313882-314226, 314240-314459, 314474-314543, 314558-314648, 314663-315017, 315031-315137, 315151-315832, 315846-316025, 316058-316076, 316090-316096, 316110-316111, 316124-316158, 316173-316198, 316212-316222, 316236-316242, 316256-316286, 316302-316615, 316629-316652, 316666-316719, 316734-316746, 316761-316765, 316779-316826, 316854-316906, 316931-316991, 317019-317056, 317070-317106, 317126-317208, 317222-317251, 317261-317316, 317337-317353, 317367-317370, 317379-317410, 317423-317635, 317649-317681, 317708-317776, 317790-317863, 317877-317933, 317947-318052, 318066-318212, 318226-318324, 318338-318555, 318569-318642, 318656-318755, 318769-318780, 318803-318877, 318889-319319, 319333-319506, 319520-320079, 320095-320146, 320161-320309, 320330-320353, 320367-320651, 320670-320764, 320779-320800, 320814-320938, 320952-320968, 320982-321111, 321126-321134, 321141-321223, 321234-321312, 321326-321726, 321741-321811, 321839-321857, 321871-322082, 322096-322122, 322137-322228, 322242-322361, 322380-322460, 322474-322567, 322604-322834, 322864-322964, 322991-323056, 323070-323081, 323095-323194, 323208-323239, 323253-323279, 323293-323336, 323350-323436, 323450-323515, 323529-323564, 323578-323622, 323636-323693, 323714-323727, 323752-323776, 323794-323817, 323830-323831, 323844-323852, 323867-323919, 323934-323966, 323980-324049, 324063-324088, 324102-324166, 324180-324194, 324208-324209, 324223-324338, 324353-324392, 324406-324624, 324638-324791, 324797-324932, 324949-324961, 324970-324984, 324991-325063, 325069-325582, 325596-325614, 325628-325734, 325748-325772, 325798-325817, 325829-325866, 325880-325950, 325964-325968, 325981-326039, 326054-326065, 326079-326444, 326458-326483, 326506-326576, 326591-326623, 326637-326853, 326867-327076, 327090-327174, 327189-327353, 327367-327609, 327623-327637-327778, 327822-327882, 327896-327936, 327950-327961, 327975-327979, 328008-328208, 328222-328260, 328274-329045, 329059-329437, 329455-329565, 329579-329603, 329617-329632, 329646-329675, 329689-329696, 329710-329714, 329728-329746, 329760-329777, 329798-329903, 329918-330225, 330239-330336, 330360-330377, 330391-330503, 330517-330639, 330663-330717, 330731-330766, 330780-331138, 331145-331210, 331215-331372, 331386-331398, 331412-331522, 331536-331821, 331834-331909, 331919-331945, 331949-331984, 331998-332011, 332015-332050, 332064-332083, 332097-332220, 332234-332435, 332452-332538, 332552-332582, 332596-332625, 332639-332683, 332697-332852, 332869-332906, 332920-332990, 333004-333085, 333099-333113, 333127-333149, 333159-333206, 333220-333242, 333245-333285, 333319-333363, 333371-333376, 333390-333975, 333988-334010, 334016-334063, 334076-334433, 334448-334547, 334561-334696, 334698-334752, 334766-334850, 334864-334891, 334905-335417, 335437-335475, 335489-335520, 335535-335636, 335655-336575, 336589-336703, 336717-337484, 337498-337683, 337697-337791, 337805-337924, 337938-338003, 338018-338029, 338043-338094, 338108-338195, 338209-338220, 338246, 338273-338280, 338298-338436, 338460-338705, 338719-338849, 338863-338997, 339005-339058, 339072-339289, 339297-339324, 339335-339368, 339372-339720, 339734-339824, 339850-339997, 340011-340120, 340133-340148, 340158-340172, 340186-340194, 340198-340252, 340256-340290, 340305-340525, 340539-340644, 340658-340702, 340716-340992, 341006, 341020-341032, 341046-341068, 341091-341149, 341163-341210, 341224-341277, 341295-341497, 341511-341539, 341542-341565, 341578-341580, 341594-341693, 341707-341882, 341900-342018, 342032-342297, 342311-342369, 342383-342406, 342421-342423, 342437-342468, 342496-342592, 342606-342635, 342643-342744, 342759-342893, 342907-343048, 343061-343127, 343138-343199, 343204-343527, 343544-343653, 343667-343679, 343693-343809, 343830-343913, 343928-343962, 343976-344005, 344025-344212, 344226-344266, 344280-344488, 344503-344701, 344716-344830, 344844-344901, 344915-345481, 345496-345528, 345556-345564, 345592-345768, 345783-346146, 346160-346315, 346330-346531, 346545-346607, 346621-346647, 346661-346917, 346938-346999, 347014-347429, 347443-347637, 347651-347816, 347830-347835, 347849-348068, 348082-348368, 348382-348495, 348509-348599, 348613-348701, 348716-348720, 348734-349089, 349103-349128, 349131-349160, 349174-349198, 349203-349296, 349310-349867, 349881-350079, 350101-350133, 350147-350175, 350189-350237, 350251-350300, 350314-350421, 350436-350530, 350544-350806, 350820-351095, 351109-351120, 351134-351253, 351268-351287, 351301-351615, 351635-351708, 351722-351732, 351744-352173, 352187-352192, 352207-352283, 352297-352430, 352444-352481, 352496-352597, 352611-352616, 352630-352831, 352845-352925, 352939-353117, 353131-353314, 353317-353347, 353353-353384, 353400-353594, 353609-354202, 354217-354871, 354885-355050, 355064-355229, 355256-355280, 355294-355306, 355320-355382, 355396-355557, 355580-355590, 355604-355609, 355624-355713, 355727-355795, 355809-355859, 355873-355913, 355927-356036, 356040-356052, 356066-356143, 356152-356155, 356160-356185, 356189-356217, 356225-356226, 356240-356258, 356268-356301, 356315-356421, 356435-356471, 356485-356550, 356564-356576, 356590-356745, 356759-356779, 356793-356823, 356847-356893, 356897-356945, 356949-357027, 357041-357065, 357079-357101, 357115-357140, 357154-357209, 357223-357498, 357512-357542, 357556-357567, 357582-357673, 357687-357723, 357742-357780, 357794-357836, 357845-357848, 357862-358129, 358135-358147, 358149-358185, 358191-358884, 358899-358940, 358954-359094, 359108-359121, 359142-359165, 359179-359584, 359590-359615, 359617-359627, 359641-359826, 359840-360125, 360134-360330, 360344-360381, 360395-360727, 360741-360760, 360774-360956, 360970-360991, 361009-361031, 361036-361060, 361062-361267, 361282-361326, 361342-361372, 361386-361407, 361412-361418, 361441-361449, 361457-361545, 361560-361717, 361731-361857, 361871-361937, 361951-361983, 362003-362062, 362076-362371, 362385-362426, 362440-362630, 362644-362816, 362830-363127, 363142-363705, 363723-363745, 363759-363802, 363816, 363831-363880, 363894-364039, 364064-364249, 364259-364283, 364298-364374, 364377-364383, 364397-364450, 364465-364505, 364519-364654, 364668-364701, 364715-365632, 365646-365783, 365797-365989, 366003-366097, 366111-366298, 366312-366677, 366702-366780, 366788-367055, 367069-367532, 367546-367641, 367655-367679, 367694-367788, 367803-367899, 367913-367931, 367948-368024, 368034-368052, 368061-368087, 368109-368503, 368517-368946, 368960-369231, 369245-369415, 369439-369442, 369456-369460, 369474-369596, 369610-369795, 369809-369830, 369845-369903, 369930-370027, 370041-370115, 370136-370150-370262, 370293-370343-370352, 370366-370414, 370446-370483, 370497-370576, 370596-370610, 370625-370667, 370682-370725, 370740-371095, 371109-371157, 371171-371180, 371194-371209, 371224, 371238-371338, 371365-371746, 371764-371938, 371953-371990, 372004-372034, 372048-372069, 372083-372111, 372125-372210, 372224-372826, 372840-372888, 372902-373767, 373780-373787, 373804-373817, 373822, 373824-374003, 374018-374033, 374047-374060, 374087-374103, 374117-374157, 374171-374463, 374477-374578, 374592-374599, 374613-375187, 375202-375368, 375382-375704, 375718-375754, 375768-376014, 376030-376034, 376049-376071, 376085-376086, 376100-376114, 376128-376164, 376178-376491, 376505-376526, 376541-376582, 376596-376662, 376676-376688, 376702-376991, 377005-377012, 377026-377681, 377695-377879, 377894-377957, 377972-378009, 378023-378062, 378076-378410, 378424-378500, 378514-378568, 378582-378727, 378742-379014, 379030-379051, 379065-379071, 379085-379408, 379421-379432, 379435-379448, 379450-379573, 379587-379766, 379780-379813, 379828-379845, 379855-379872, 379884-379890, 379906-379934, 379937-380118, 380132-380286, 380300-380453, 380467-380648, 380674-380698, 380712-380713, 380727-380785, 380811-380863, 380877-381302, 381316-381326, 381340-381362, 381377-381412, 381426-381507, 381521-381545, 381558-381584, 381599-381705, 381720-381772, 381782-382599, 382613-382670, 382684-382805, 382819-382884, 382898-383046, 383061-383088, 383102-383186, 383200-383628, 383645-383696, 383710-383747, 383761-384323, 384338-384529, 384543-384733, 384748-384879, 384901-385184, 385199-385465, 385479-385508, 385522-385887, 385902-386011, 386026-386162, 386177-386411, 386425-387086, 387100-387143, 387157-387195, 387209-387392, 387406-387477, 387491-387620, 387635-387665, 387680-387706, 387720-387733, 387747-387748, 387774-388076, 388090-388122, 388136-388294, 388309-388314, 388329-388686, 388700-388720, 388734-389017, 389031-389065, 389079-389285, 389300-389443, 389457-389521, 389535-389537, 389553-389565, 389579-389620, 389634-389669, 389683-389737, 389751-389785, 389800-389914, 389928-389947, 389964-390104, 390118-390308, 390322-390511, 390525-390843, 390857-391180, 391194-391344, 391358-391473, 391487-391726, 391741-391821, 391836-391885, 391900-392355, 392369-392391, 392407-392439, 392453-392498, 392512-392521, 392535-392693, 392707-392794, 392808-393225, 393239-393298, 393312-393352, 393367-393493, 393507-393615, 393635-393666, 393680-393868, 393889-393890, 393905-393916, 393930, 393945-394058, 394072-394363, 394377-394409, 394423-394546, 394560-394791, 394805-395017, 395031-395197, 395211-395301, 395315-395402, 395416-395513, 395527-395801, 395815-395827, 395841-395908, 395936-396015, 396029-396062, 396076-396307, 396322-396579, 396606-396661, 396675-396687, 396701-396853, 396876-397049, 397063-397361, 397372-397673, 397687-397712, 397718-397733, 397737-397774, 397788-397857, 397871-397902, 397916-397937, 397945-397970, 397984-397988, 398003-398031, 398042-398067, 398080-398091, 398102-398498, 398512-398826, 398840-398912, 398927-398947, 398961-398962, 398976-399135, 399160-399286, 399300-399408, 399440-399491, 399506-399521, 399535-399781, 399797-399809, 399823-400201, 400205-400208, 400216-400509, 400511-400776, 400790-401156, 401173-401285, 401299-401376, 401389-401416, 401430-401438, 401444-401462, 401467-401510, 401524-401587, 401601-401668, 401676-401710, 401721-401729, 401732-401793, 401807-401964, 401978-402273, 402287-402304, 402318-402325, 402369-402394, 402403-402659, 402673-402960, 402974-402995, 402998-403023, 403035-403089, 403092-403364, 403378-403546, 403560-403594, 403608-403622, 403636-404052, 404067-404239, 404253-404256, 404270-404280, 404294-404428, 404442-404628, 404643-404651, 404653-404741, 404761-404801, 404815-404886, 404900-405515, 405529-405539, 405553-405559, 405574-405601, 405615-405654, 405668-405673, 405700-405818, 405832-406317, 406331-406419, 406434-406735, 406749-406827, 406841-406880, 406895-406906, 406913-406955, 406973-406977, 406996-407064, 407091-407107, 407122-407191, 407206-407300, 407317-407324, 407338-407787, 407801-407942, 407956-408142, 408156-408291, 408306-408350, 408365-408417, 408431-408459, 408475-408502, 408516-408848, 408862-408954, 408971-409200, 409219-409229, 409235-409245, 409261-409266, 409279-409517, 409531-409580, 409594-409878, 409892-409899, 409913-410103, 410117-410194, 410204-410588, 410603-410654, 410668-410893, 410908-411511, 411525-411590, 411605-411614, 411628-411638, 411671-411732, 411747-411787, 411801-411892, 411906-411950, 411964-412204, 412219-412258, 412272-412384, 412399-412442, 412456-412560, 412574-412598, 412612-412788, 412802-412821, 412835-412957, 412971-412991, 413005-413070, 413098-413406, 413421-413525, 413539-413555, 413569-413586, 413600-413683, 413697-413796, 413810-413891, 413911-414075, 414089-414141, 414156-414318, 414331-414690, 414704-414924, 414939-414972, 414986-415164, 415178-415302, 415316-415332, 415346-415349, 415363-415382, 415396-415469, 415483-415519, 415534-415588, 415602-415609, 415641-415770, 415783-415950, 415964-416024, 416038-416316, 416330-416523, 416537-416539, 416584-416586, 416600-416655, 416669-417359, 417373-417402, 417416-417420, 417432-417518, 417532-417882, 417897-417965, 417980-418109, 418123-418199, 418213-418268, 418295-418334, 418348-418572, 418586-418753, 418767-418770, 418793-418963, 418977-418981, 418984-419057, 419066-419226, 419240-419290, 419304-419479, 419496-419614, 419628-420252, 420266-420448, 420462-420463, 420476-420498, 420511-420599, 420613-421059, 421073-421375, 421389-421440, 421454-421534, 421548-421554, 421580-421623, 421637-422030, 422041-422088, 422100-422754, 422768-423214, 423228-423382, 423394-423414, 423422-424074, 424088-424281, 424295, 424309-424488, 424503-424616, 424630-424871, 424886-424896, 424905-424931, 424935-424978, 424993-425045, 425054-425068, 425079-425090, 425104-425193, 425208-425236, 425250-425446, 425460-425617, 425631-425652, 425666-425734, 425747-425971, 425986-426138, 426152-426190, 426204-426559, 426574-426979, 426993-427301, 427315-427320, 427334-427488, 427502-427590, 427604-427625, 427639-427711, 427725-427878, 427892-428436, 428450-428790, 428802-428813, 428825-428945, 428959-429104, 429123-429130, 429140-429300, 429312-429430, 429444-429447, 429461-429472, 429486-429643, 429657-429690, 429704-429720, 429734-429776, 429800-429823, 429837-429890, 429916-430182, 430187-430231, 430245-430300, 430314-430458, 430472-430554, 430568-430581, 430595-430621, 430636-430653, 430667-430675, 430690-430730, 430745-430787, 430802-430923, 430938-431114, 431128-431202, 431216-431334, 431351-432022, 432036-432131, 432145-432286, 432301-432523, 432537-432611, 432625-432641, 432655-432753, 432767-432897, 432920-433696, 433718-433769, 433784-434257, 434271-434366, 434380-434447, 434461-434779, 434793-434796, 434810-434811, 434825-434903, 434918-434957, 434971-435074, 435088-435112, 435126-435142, 435164-435224, 435238-435356, 435370-435700, 435714-436018, 436032-436520, 436534-436563, 436578-436579, 436615-436672, 436686-436772, 436789-436792, 436806-436963, 436977-437033, 437047-437115, 437129-437626, 437640-437770, 437787-438491, 438505-438575, 438589-438602, 438616-438637, 438651-438818, 438832-438839, 438858-438867, 438898-

438953, 438967-439293, 439310-439330, 439335-439522, 439536-439598, 439612-439665, 439679-439806, 439820-439884, 439899-440222, 440236-440529, 440545-440611, 440625-440962, 440976-441625, 441639-441768, 441795-441935, 441949-441999, 442013-442032, 442046-442221, 442235-442562, 442576-442636, 442650-442790, 442804-443177, 443191-443545, 443560-443784, 443798-443920, 443934-444371, 444385-444406, 444420-445224, 445238-445707, 445721-445939, 445953-445971, 445986-446111, 446125-446177, 446191-446582, 446596-446638, 446652-446664, 446678-446682, 446697-446700, 446715-446805, 446819-446867, 446881-447023, 447037-447090, 447104-447253, 447268-447269, 447284-447457, 447472-447498, 447512-447516, 447530-447672, 447698-447701, 447715-448296, 448310-448389, 448403-448699, 448714-448716, 448732-448880, 448894-448949, 448963-449033, 449047-449454, 449470-449495, 449509-449564, 449578-449752, 449766-449917, 449932-450046, 450060-450079, 450094-450144, 450158-450213, 450227-450356, 450370-450434, 450448-450553, 450567-450617, 450632-450869, 450884-451167, 451189-451205, 451219-451250, 451264-451269, 451283-451413, 451427-451577, 451591-451659, 451673-452001, 452015-452023, 452037-452100, 452114-452131, 452153-452200, 452216-452266, 452281-452351, 452365-452378, 452392-452455, 452470-452490, 452504, 452518-452591, 452615-452629, 452643-452742, 452756-452815, 452829-452845, 452859-452915, 452929-452955, 452969-452999, 453014-453034, 453055-453082, 453096-453287, 453310-453364, 453378-454219, 454233-454498, 454512-454717, 454731-454797, 454811-454923, 454937-455034, 455048-455107, 455121-455211, 455225-455569, 455583-455597, 455611-455785, 455800-455929, 455943-455998, 456012-456185, 456199-456246, 456261-456680, 456694-456786, 456800-456805, 456821-456855, 456869-456886, 456937-457150, 457165-457179, 457193-457194, 457208-457219, 457233-457242, 457256-457260, 457274-457303, 457340-457368, 457390-457477, 457492-457516, 457530, 457551-457629, 457643-457690, 457705, 457720-457867, 457881-458116, 458130-458159, 458173-458204, 458218-458245, 458260-458346, 458361-458620, 458634-458659, 458675-458698, 458713-458717, 458731-458833, 458846-458992, 459006-459062, 459076-459370, 459385-459472, 459486-459718, 459733-459775, 459789-459795, 459809-459835, 459849-459877, 459901-460073, 460088-460476, 460491-460871, 460885-461220, 461234-461498, 461512-461589, 461603-461629, 461643-461807, 461822-461909, 461923-461973, 461987-462014, 462028-462104, 462118-462227, 462241-462298, 462312-462373, 462387-462431, 462445-463129, 463143-463258, 463272-463370, 463385-463543, 463557-463584, 463598-463888, 463902-464205, 464219-464561, 464575-465250, 465263-465331, 465345-465591, 465605-466000, 466014, 466053-466166, 466189-466273, 466287-466337, 466351-466418, 466433-466450, 466475-466525, 466548-466725, 466740-466934, 466948-466955, 466969-466985, 467000-467045, 467062-467131, 467145-467196, 467232-467315, 467330-467341, 467357-469068, 469083-469187, 469201-469413, 469427-469451, 469466-469678, 469692-470136, 470150-470353, 470362-470517, 470519-470527, 470541-470590, 470604-470657, 470671-470697, 470712-470862, 470877-470895, 470909-470959, 470971-470972, 470983-471009, 471011-471026, 471038-471048, 471056-471092, 471106-471122, 471147-471261, 471275-471318, 471332-471435, 471450-471459, 471501-471549, 471563-471616, 471630-471936, 471951-472191, 472205-472667, 472684-472954, 472968-473152, 473167-473939, 473953-474130, 474144-474307, 474312-474353, 474377-474744, 474758-474955, 474971-475001, 475015-475087, 475101-475324, 475338-475484, 475498-475563, 475578-475720, 475734-475745, 475760-475793, 475813-475829, 475844-475928, 475942-476016, 476030-476038, 476052-476320, 476334-476389, 476403-477147, 477161-477191, 477205-478047, 478061-478678, 478692-478763, 478790-478939, 478953-479161, 479176-479177, 479191-479199, 479213-479245, 479259-479268, 479283-479812, 479827-480029, 480043-480118, 480132-480279, 480290-480688, 480702-480726, 480740-481058, 481072-481143, 481157-481246, 481261-481303, 481317-481386, 481400-481548, 481562-481564, 481580-481857, 481871-481984, 481998-482388, 482402-482567, 482581-482854, 482868-482969, 482983-482993, 483007-483098, 483112-483166, 483180-483291, 483305-483320, 483336-483344, 483358-483560, 483576-483757, 483771-483809, 483823-484059, 484073-484234, 484248-484449, 484463-484590, 484604-484699, 484714-485037, 485051-485069, 485083-485106, 485108-485280, 485294-485446, 485465-485566, 485580-486138, 486153-486265, 486279-486329, 486336-486362, 486369-486782, 486796-486814, 486828-486871, 486885-486938, 486952-487216, 487232-487270, 487284-487480, 487494-487640, 487655-487920, 487934-488009, 488031-488079, 488088-488113, 488121-488136, 488143-488443, 488451-488464, 488469-488492, 488502-488921, 488936-488984, 488998-489467, 489481-489588, 489602-489712, 489725-489754, 489768-489823, 489837-490416, 490431-490812, 490826-491020, 491034-491054, 491068-491184, 491198-491227, 491243-491288, 491303-491368, 491382-491454, 491479-491553, 491597-491780, 491794-491883, 491897-492178, 492201-492398, 492413-492535, 492549-492614, 492628-492645, 492661-492762, 492780-492832, 492846-492860, 492887-492908, 492922-493011, 493025-493180, 493194-493201, 493215-493220, 493235-493237, 493251-493284, 493323-493387, 493401-493457, 493471-493512, 493526-493545, 493560-493576, 493590-493658, 493672-493677, 493691-493728, 493743-493841, 493855-493879, 493893-493924, 493938-493949, 493963-493996, 494010-494165, 494183-494627, 494655-495051, 495065-495438, 495452-495740, 495754-495755, 495769-495812, 495844-496225, 496239-496769, 496783-497095, 497109-497179, 497193-497201, 497215-497728

SeqIDs w/o miR Seeds:
306020-306021, 306023, 306025, 306027-306033, 306035-306038, 306040-306041, 306043-306045, 306053-306055, 306063-306065, 306067-306068, 306073, 306077, 306079-306084, 306088-306097, 306099, 306103, 306105-306106, 306112-306113, 306115-306118, 306121, 306123-306124, 306127, 306130, 306133-306134, 306138-306140, 306143-306146, 306152-306155, 306164-306165, 306167, 306173-306176, 306180-306187, 306191, 306194-306196, 306199-306202, 306205-306207, 306209-306210, 306215-306222, 306225-306226, 306231, 306233-306234, 306236-306238, 306240-306241, 306244-306245, 306247, 306251-306252, 306254-306262, 306265, 306270, 306274-306276, 306278-306279, 306281-306282, 306285, 306288-306289, 306291, 306295, 306297-306298, 306300, 306302-306303, 306306-306312, 306314, 306317, 306321-306322, 306324-306328, 306333, 306337, 306339-306341, 306343-306344, 306346-306347, 306349-306354, 306356-306359, 306363, 306365, 306369, 306372-306376, 306378-306380, 306382-306386, 306390-306393, 306395-306403, 306406-306407, 306411-306412, 306415-306417, 306419-306420, 306425-306429, 306431-306439, 306441, 306443-306449, 306452, 306455-306468, 306471, 306473-306479, 306481, 306483-306486, 306488-306489, 306491, 306493-306494, 306498, 306503, 306505-306507, 306509, 306511-306517, 306519-306520, 306522, 306524, 306526, 306529, 306534-306535, 306537, 306542, 306544, 306547, 306549, 306551, 306553-306555, 306557-306558, 306562, 306565, 306568, 306571, 306573, 306575, 306577, 306579-306581, 306583, 306585, 306589-306590, 306592-306593, 306595, 306597, 306599, 306601-306603, 306605, 306608-306610, 306615-306616, 306618, 306621-306622, 306628, 306630, 306633-306635, 306638, 306641-306643, 306646-306649, 306653, 306655-306658, 306664, 306666-306669, 306673-306677, 306680-306681, 306683-306684, 306688-306693, 306695, 306699-306701, 306703-306704, 306706, 306708, 306710, 306713, 306716-306717, 306719, 306721-306722, 306725, 306728-306730, 306735, 306737-306741, 306743-306749, 306751-306752, 306754-306755, 306757, 306759-306761, 306763-306764, 306766-306768, 306770, 306772, 306774-306776, 306778, 306781, 306783-306788, 306791, 306796-306804, 306806-306808, 306815-306816, 306821-306824, 306826, 306828-306829, 306831-306835, 306838-306840, 306843-306844, 306846-306848, 306850-306851, 306853-306854, 306856-306858, 306863-306865, 306867, 306869, 306872-306874, 306878-306880, 306886-306887, 306891-306896, 306898, 306900-306901, 306903-306904, 306907, 306909-306911, 306913, 306917, 306920, 306922, 306924-306928, 306930, 306933-306941, 306943-306946, 306948-306949, 306951-306955, 306957-306961, 306964-306966, 306971-306974, 306976-306978, 306980, 306983-306985, 306987-306988, 306991-306993, 306996, 306998, 307001-307008, 307010-307011, 307014-307015, 307017-307019, 307021, 307023, 307025, 307028-307033, 307038-307040, 307042-307045, 307049, 307051, 307057-307062, 307065-307066, 307068-307069, 307072-307075, 307077-307080, 307082-307084, 307087, 307089-307090, 307093-307100, 307102-307106, 307108-307113, 307117-307119, 307121-307122, 307124, 307126-307127, 307129-307135, 307137-307138, 307141-307145, 307148-307149, 307152-307155, 307157-307165, 307172-307174, 307176, 307182-307198, 307200-307201, 307203-307205, 307209-307210, 307213-307215, 307218-307220, 307223-307224, 307227-307229, 307231, 307233-307235, 307237-307240, 307242, 307246-307248, 307251-307253, 307255-307259, 307262, 307264-307265, 307267-307270, 307272, 307274-307278, 307280, 307282, 307284-307287, 307289, 307292, 307295, 307297-307299, 307301-307303, 307305-307310, 307312, 307314, 307316, 307318-307328, 307330-307331, 307335, 307341, 307343-307346, 307352, 307357-307360, 307363-307375, 307377, 307380-307381, 307383-307388, 307390, 307392-307397, 307399-307402, 307404-307405, 307407-307409, 307412, 307415, 307417, 307419-307431, 307433-307436, 307438, 307441-307443, 307447-307448, 307452-307453, 307455-307458, 307461-307462, 307464, 307466-307467, 307469, 307471, 307473-307476, 307478-307480, 307482, 307484-307485, 307487-307493, 307495-307507, 307509, 307511-307513, 307515-307524, 307526-307527, 307530-307532, 307534-307543, 307545-307548, 307552-307553, 307555-307558, 307561, 307563-307569, 307571, 307573, 307577-307579, 307582-307583, 307585, 307587, 307591-307593, 307595-307597, 307599-307600, 307602, 307604-307606, 307608, 307611-307621, 307623-307628, 307631, 307634-307636, 307638-307643, 307645, 307649-307651, 307658-307660, 307662, 307665-307666, 307670-307677, 307679-307685, 307692-307693, 307696-307697, 307699-307700, 307702-307707, 307709-307710, 307712-307722, 307724-307727, 307729-307730, 307732-307733, 307735-307741, 307744-307746, 307748-307752, 307754, 307757-307764, 307766-307768, 307770-307773, 307775-307781, 307785-307788, 307790-307791, 307796, 307799, 307801-307804, 307807, 307809-307813, 307816-307819, 307821, 307827-307832, 307834-307839, 307841-307848, 307850-307868, 307876, 307878-307880, 307882-307883, 307885-307889, 307891, 307893-307894, 307897, 307899-307900, 307902, 307905-307907, 307909, 307913-307916, 307918-307920, 307922-307924, 307928, 307931, 307933, 307935-307937, 307939-307940, 307944-307945, 307947, 307949, 307951-307955, 307959-307960, 307962-307965, 307970, 307972, 307974-307980, 307983, 307989-307991, 307995, 307997-308003, 308005-308011, 308017-308020, 308022-308024, 308026-308027, 308029-308030, 308038-308039, 308042, 308044, 308046-308053, 308055-308056, 308058-308059, 308061-308062, 308064-308074, 308078-308082, 308084-308089, 308091-308092, 308095-308096, 308098-308100, 308102, 308105, 308110-308114, 308116-308117, 308119-308123, 308125, 308129-308132, 308136, 308138-308140, 308143, 308146, 308152-308156, 308158, 308160-308163, 308171-308172, 308174-308175, 308177-308180, 308185, 308187, 308190, 308192-308193, 308195, 308197-308198, 308204-308212, 308214, 308217, 308219-308220, 308223-308225, 308227, 308230, 308233-308238, 308240, 308248, 308250-308252, 308254, 308257-308260, 308265, 308267-308269, 308271, 308274, 308282, 308284-308285, 308288, 308291-308294, 308296, 308298, 308300-308302, 308304-308306, 308309-308311, 308315, 308317, 308319, 308321, 308324, 308326-308327, 308329, 308331-308332, 308336-308339, 308342-308345, 308347-308348, 308351-308353, 308359, 308364-308368, 308386, 308388-308390, 308392, 308396-308400, 308402, 308405-308406, 308408-308414, 308416, 308420-308422, 308424, 308428-308435, 308437-308438, 308440-308441, 308450-308451, 308454, 308463-308469, 308471-308472, 308474, 308478-308479, 308482-308483, 308485-308489, 308494, 308504, 308506, 308508, 308510-308512, 308515-308517, 308519-308523, 308525, 308530, 308533-308536, 308540-308542, 308544, 308546-308547, 308549-308550, 308552, 308555-308563, 308566-308568, 308570, 308573-308574, 308577-308578, 308582, 308585, 308588-308592, 308594-308595, 308597, 308599, 308604-308607, 308613, 308616-308617, 308620, 308622, 308624-308626, 308629, 308631-308633, 308635-308638, 308640, 308642-308643, 308645-308649, 308651-308653, 308656-308659, 308661-308663, 308674-308676, 308678-308680, 308682, 308684-308687, 308692-308695, 308698-308704, 308706, 308708-308714, 308717-308734, 308737-308741, 308743-308746, 308752, 308759-308761, 308763-308788, 308790-308797, 308800-308801, 308803-308810, 308813-308814, 308816-308817, 308819-308822, 308824-308827, 308829-308830, 308833-308834, 308836-308840, 308842-308843, 308854-308855, 308857, 308860-308861, 308863-308865, 308867, 308869-308870, 308872-308873, 308875-308878, 308880, 308882-308885, 308887, 308889-308890, 308901-308902, 308904, 308911-308917, 308919-308921, 308924, 308927-308930, 308933-308937, 308939, 308944-308948, 308950, 308952-308954, 308956-308957, 308961-308962, 308964-308965, 308975, 308980-308981, 308983-308985, 308994, 308996, 308998, 309000-309002, 309004-309006, 309012-309013, 309016, 309023-309025, 309027-309030, 309032, 309035, 309038-309039, 309042-309045, 309047-309048, 309051-309053, 309057-309060, 309063-309065, 309067-309069, 309071-309073, 309075-309076, 309078-309082, 309085-309086, 309088, 309090-309093, 309095, 309098-309099, 309101, 309103-309112, 309114-309115, 309119, 309121-309125, 309127-309129, 309131-309133, 309135, 309139-309142, 309145-309146, 309148, 309150, 309154-309157, 309160-309163, 309170, 309173, 309175-309177, 309179-309182, 309185, 309187-309201, 309205-309206, 309209-309210, 309212-309213, 309216-309222, 309225, 309228-309237, 309239-309240, 309243-309246, 309248-309252, 309254-309255, 309257-309258, 309263-309265, 309269, 309271, 309274-309280, 309282, 309285, 309292-309294, 309299-309300, 309304-309307, 309309-309310, 309313-309314, 309316, 309319-309321, 309324, 309328-309330, 309333, 309338-309343, 309345-309346, 309348-309351, 309354-309355, 309358, 309360, 309367, 309373-309379, 309381-309382, 309384-309388, 309391, 309393-309396, 309400, 309402, 309405-309407, 309409-309410, 309413-309414, 309417-309421, 309423, 309425-309427, 309430-309431, 309433-309434, 309436-309438, 309440-309444, 309448-309450, 309452-309457, 309463-309467, 309470-309472, 309474-309476, 309479, 309484-309489, 309491-309492, 309494-309499, 309506-309509, 309519-309520, 309522-309529, 309531-309532, 309534-309535, 309541, 309543-309546, 309552, 309555-309556, 309560, 309564, 309566-309568, 309575, 309583-309584, 309586-309592, 309594-309598, 309602, 309604-309616, 309618-309619, 309621-309626, 309628, 309630-309631, 309640, 309644-309649, 309651, 309653-309654, 309657-309658, 309662-309665, 309668-309676, 309678, 309680-309681, 309684, 309686-309687, 309689-309694, 309698-309700, 309702-309705, 309707-309708, 309713, 309715-309717, 309719-309720, 309724-309726, 309729, 309732, 309735-309741, 309744, 309747, 309749, 309751, 309753-309756, 309761-309762, 309764, 309767-309768, 309770, 309772-309773, 309775-309777, 309781-309786, 309789, 309791-309797, 309801-309806, 309809, 309811, 309813-309816, 309818-309819, 309824-309834, 309841, 309844, 309847, 309850-309853, 309855-309871, 309873-309875, 309881, 309885-309893, 309895-309897, 309899-309900, 309902-309904, 309910, 309912, 309914-309915, 309919, 309921-309922, 309924, 309926-309930, 309932-309939, 309944, 309946, 309949-309952, 309955-309957, 309962, 309964-309965, 309967, 309970-309974, 309978-309984, 309986-309989, 309991-309993, 310001, 310004-310006, 310008, 310010-310012, 310014, 310017-310018, 310020, 310022-310023, 310025-310028, 310034-310035, 310037-310038, 310045-310053, 310055-310061, 310063, 310065, 310067, 310069, 310071, 310074, 310076-310077, 310084, 310086-310088, 310093-310098, 310100, 310102-310103, 310105-310107, 310110, 310112-310118, 310120-310125, 310127-310128, 310130, 310132-310133, 310135-310136, 310138, 310140-310143, 310145-310152, 310154-310159, 310161, 310163, 310165-310168, 310171-310172, 310174, 310177-310184, 310193-310195, 310199-310202, 310204-310205, 310207, 310209, 310214-310216, 310219, 310221-310227, 310233-310234, 310236-310239, 310243, 310245-310247, 310249-310250, 310252, 310254-310255, 310257, 310259, 310263, 310265-310271, 310274, 310276, 310278, 310281, 310283, 310285, 310287, 310289, 310291-310301, 310303, 310305-310310, 310312-310315, 310317-310318, 310321-310322, 310324-310325, 310328-310330, 310332-310334, 310336-310337, 310339-310343, 310345, 310348, 310350-310353, 310357, 310359-310360, 310362, 310364, 310366-310367, 310370-310371, 310373-310374, 310377-310378, 310382-310388, 310390-310391, 310395-310401, 310404, 310407, 310409-310410, 310414-310415, 310417-310419, 310421, 310427-310430, 310432-310436, 310438, 310443-310445, 310447-310449, 310451-310455, 310458-310461, 310465, 310467, 310472-310473, 310475-310478, 310481-310491, 310493-310494, 310497-310501, 310504-310507, 310516-310518, 310520-310522, 310525-310526, 310528-310534, 310536-310549, 310552-310558, 310562-310564, 310566, 310568-310569, 310572, 310576-310590, 310592-310595, 310597-310599, 310601, 310603-310604, 310606, 310608-310609, 310613-310616, 310618-310620, 310622-310624, 310628-310631, 310635-310636, 310640, 310642, 310644-310646, 310649-310654, 310656-310659, 310661-310663, 310665-310670, 310672, 310674, 310676, 310678, 310681, 310683, 310685-310686, 310688-310689, 310691, 310693, 310695, 310697-310698, 310700, 310703, 310705-310708, 310710, 310712-310713, 310715-310716, 310718, 310720-310722, 310725-310729, 310731, 310734-310738, 310740-310742, 310744-310745, 310747, 310749-310750, 310754-310763, 310765-310777, 310779-310783, 310785-310789, 310791-310792, 310794-310797, 310799-310803, 310805-310808, 310810-310818, 310820, 310822-310826, 310829-310834, 310836-310837, 310842, 310845, 310847-310848, 310851, 310854-310864, 310866, 310869-310870, 310872, 310875-310876, 310878, 310881-310882, 310886-310889, 310891, 310893, 310896, 310898-310905, 310907, 310910-310912, 310924-310929, 310933, 310936, 310938-310939, 310941-310942, 310944-310948, 310951, 310953-310956, 310959-310960, 310965-310966, 310968, 310970, 310972, 310974, 310980-310986, 310988-310989, 310991, 310993-311002, 311004, 311006-311009, 311012-311017, 311023, 311026, 311030-311033, 311036, 311039, 311041, 311043-311053, 311060-311061, 311063-311067, 311069-311071, 311073-311076, 311080-311081, 311084, 311086, 311088-311090, 311092-311097, 311099-311106, 311109, 311111-311112, 311120-311129, 311132, 311135-311136, 311138, 311140-311142, 311144-311147, 311151, 311154-311156, 311159, 311161-311162, 311164-311169, 311173-311175, 311179, 311181-311182, 311184-311185, 311187, 311191, 311193-311196, 311199, 311201, 311203, 311205-311206, 311208-311209, 311214-311219, 311221-311223, 311225-311229, 311231, 311233, 311239-311245, 311247, 311249-311252, 311255, 311257-311262, 311264-311266, 311268-311271, 311274-311285, 311289, 311292-311297, 311299-311301, 311304, 311307-311309, 311311-311312, 311314-311315, 311317-311319, 311321, 311323-311327, 311329-311330, 311333-311334, 311338-311343, 311348-311350, 311352-311353, 311357, 311364, 311366, 311368-311371, 311373, 311377-311380, 311382-311383, 311386-311387, 311392-311397, 311399-311401, 311403-311405, 311407, 311410, 311413-311415, 311417, 311422, 311424-311427, 311429-311430, 311432-311438, 311440-311442, 311446-311450, 311452, 311454-311455, 311458-311459, 311461, 311463-311464, 311466, 311468-311469, 311472-311480, 311482, 311484, 311487-311497, 311501-311502, 311504-311506, 311508-311509, 311512-311515, 311517, 311519-311522, 311524-311526, 311528-311530, 311532-311533, 311535-311536, 311539, 311542-311546, 311550, 311552, 311555-311556, 311558, 311560, 311564-311565, 311567, 311569-311571, 311573-311575, 311582-311583, 311585-311591, 311594-311596, 311599-311601, 311603-311607, 311609-311617, 311619-311620, 311622, 311625, 311627-311628, 311630, 311633-311635, 311637-311642, 311646, 311648, 311652-311653, 311655-311664, 311668-311669, 311671-311672, 311676, 311681-311688, 311690-311691, 311693-311697, 311699-311703, 311705, 311708-311710, 311713-311715, 311718, 311722-311732, 311735-311738, 311742, 311745-311746, 311749-311750, 311752-311755, 311758-311759, 311763-311767, 311769-311776, 311778, 311780-311785, 311787, 311789-311795, 311798-311802, 311804, 311806-311810, 311813-311816, 311818-311824, 311826-311834, 311837-311844, 311850-311851, 311854-311856, 311858-311868, 311873, 311879, 311884, 311886-311895, 311898, 311901, 311904-311905, 311907-311912, 311914, 311920-311921, 311923-311925, 311927-311931, 311934, 311936, 311938-311942, 311944, 311948, 311950-311953, 311956-311961, 311964-311966, 311969-311970, 311972-311976, 311978, 311984, 311986, 311990-311992, 311994, 311996-311997, 311999, 312001-312002, 312004-312016, 312020-312021, 312023-312024, 312028-312029, 312031, 312033-312034, 312036-312038, 312040-312041, 312048, 312051, 312053-312057, 312060, 312062, 312064-312065, 312068-312071, 312073, 312077-312078, 312081-312083, 312085, 312090-312095, 312097-312099, 312102-312107, 312109, 312111-312116, 312118, 312121-312127, 312129-312131, 312133, 312135-312137, 312139-312140, 312144-312149, 312151, 312154-312155, 312158-312160, 312162-312163, 312166-312167, 312170-312171, 312173-312174, 312176-312187, 312189, 312191, 312193-312195, 312197-312198, 312200-312202, 312204, 312207-312211, 312217-312221, 312223, 312225-312227, 312229-312231, 312233-312234, 312236, 312239-312244, 312246-312251, 312253-312255, 312259-312262, 312264-312266, 312268-312274, 312276-312277, 312279-312285, 312288, 312290, 312292, 312294-312295, 312297, 312300-312301, 312303-312305, 312307-312310, 312313-312314, 312316-312317, 312321-312322, 312324-312325, 312327, 312329-312341, 312343, 312345-312347, 312349, 312351, 312354-312355, 312359-312364, 312366, 312368-312369, 312372-312373, 312375-312380, 312382-312384, 312386-312387, 312389-312393, 312400-312403, 312410-312411, 312413-312416, 312420, 312423-312433, 312439, 312442, 312445-312446, 312448-312455, 312457-312460, 312462-312464, 312466-312471, 312473, 312475-312477-312480, 312482-312483, 312485-312487, 312489-312491, 312493-312494, 312497, 312501-312507, 312509, 312512, 312514-312518, 312521-312523, 312526-312527, 312531-312538, 312540, 312542, 312544, 312546-312548, 312551-312553, 312555, 312561-312572, 312575, 312578, 312581-312582, 312584, 312586-312587, 312589, 312591-312595, 312601-312602, 312604, 312610-312620, 312622-312628, 312630, 312633, 312635, 312638, 312640, 312642-312644, 312646-312647, 312650-312651, 312653-312662, 312664-312666, 312668-312670, 312673, 312676, 312678-312681, 312683-312688, 312690, 312692-312696, 312701, 312703-312708, 312710, 312713, 312715-312717, 312719-312723, 312725-312728, 312730-312732, 312736-312739, 312745-312754, 312759-312761, 312763, 312765-312772, 312774-312776, 312778, 312780-312781, 312783-312784, 312786, 312789, 312791-312792, 312794, 312796, 312800-312801, 312803, 312805-312806, 312808, 312811-312813, 312815, 312817-312822, 312824-312828, 312830-312831, 312833, 312835-312844, 312846, 312852-312855, 312857-312859, 312861, 312863-312864, 312867, 312872-312874, 312879-312880, 312883-312886, 312889-312893, 312895-312898, 312900-312910, 312913-312914, 312917, 312919, 312921-312924, 312926-312928, 312931-312932, 312935, 312940-312946, 312949-312954, 312957, 312960, 312962-312965, 312967, 312969, 312971-312975, 312977-312979, 312981-312982, 312984, 312988-312989, 312992-312998, 313000, 313004-313008, 313010-313013, 313015-313017, 313021-313023, 313026-313027, 313029, 313035-313036, 313040-313041, 313044, 313047-313050, 313052-313053, 313055, 313057-313060, 313062-313063, 313066, 313068-313069, 313071-313074, 313076-313079, 313081-313083, 313086-313102, 313107-313114, 313116, 313118, 313120-313121, 313124, 313127, 313130-313138, 313140-313145, 313148-313151, 313153-313155, 313157-313158, 313160, 313162-313163, 313166, 313168, 313170, 313173, 313177, 313179, 313181, 313183-313185, 313188-313189, 313197-313202, 313205-313206, 313210, 313212-313215, 313218-313220, 313222-313223, 313227, 313229-313230, 313233, 313236-313238, 313241, 313243-313248, 313250, 313252-313253, 313256-313259, 313265-313266, 313268-313269, 313271, 313274-313276, 313278, 313280-313281, 313284-313286, 313288, 313290-313292, 313294-313302, 313305, 313307-313308, 313311-313320, 313326-313328, 313330, 313332, 313334-313336, 313339, 313341-313346, 313348-313352, 313356-313358, 313360-313363, 313367-313369, 313371-313376, 313378-313382, 313385, 313387, 313389-313391, 313393-313395, 313397-313399, 313401-313407, 313409, 313413-313414, 313416, 313420, 313423-313429, 313436-313437, 313439, 313441-313444, 313452-313456, 313458-313464, 313467-313469, 313471, 313473, 313475-313479, 313482-313483, 313485-313486, 313495-313496, 313498-313499, 313502-313508, 313510-313511, 313513-313517, 313521-313522, 313524-313525, 313527-313530, 313532, 313534-313536, 313539-313540, 313542-313543, 313547-313552, 313554-313558, 313560, 313562-313564, 313566-313569, 313571, 313573-313578, 313581-313582, 313585, 313587-313588, 313590-313591, 313593, 313596-313598, 313600, 313602, 313604-313612, 313614-313615, 313617, 313619, 313625-313630, 313633-313642, 313644-313646, 313649-313651, 313653-313661, 313663-313666, 313668-313671, 313673-313690, 313692-313693, 313697-313699, 313702, 313705-313715, 313720, 313722, 313725, 313727-313729, 313734-313744, 313749-313753, 313755-313759, 313761-313762, 313764-313766, 313769, 313771-313774, 313776, 313779-313781, 313783-313785, 313787-313793, 313795, 313799-313800, 313802-313807, 313809-313811, 313813-313814, 313816-313822, 313825-313826, 313828, 313832, 313834, 313837, 313839-313841, 313847-313850, 313856-313860, 313863, 313865-313866, 313868-313869, 313871, 313873-313876, 313878-313879, 313881, 313884-313889, 313892, 313897, 313900, 313902-313908, 313912-313914, 313916, 313918-313920, 313922-313927, 313930, 313932-313939, 313941-313942, 313944-313945, 313947, 313949-313954, 313956-313964, 313967-313972, 313974-313976, 313978, 313981-313988, 313990, 313992, 313994, 313999-314002, 314004, 314006-314009, 314012, 314014, 314018-314020, 314026-314030, 314033-314034, 314037, 314041, 314047-314049, 314052-314055, 314057, 314059, 314062-314069, 314073-314076, 314079-314082, 314086-314087, 314091-314093, 314101, 314104, 314107-314108, 314110-314114, 314116-314118, 314120-314123, 314125-314126, 314128, 314131-314133, 314136-314138, 314141-314142, 314144-314146, 314148, 314151-314155, 314157, 314159-314160, 314162, 314164, 314166, 314168, 314170-314171, 314174, 314176-314180, 314183, 314185-314189, 314191, 314193-314195, 314197-314199, 314202, 314204-314205, 314207-314210, 314214-314216, 314218, 314220-314224, 314229-314233, 314237-314241, 314243-314247, 314249-314252, 314255-314256, 314258, 314264-314265, 314267, 314269-314273, 314275, 314280-314282, 314284-314288, 314290, 314293, 314295-314300, 314302-314311, 314313-314318, 314320-314321, 314324-314327, 314331, 314333, 314335, 314340-314347, 314352-314353, 314355, 314358-314359, 314362, 314364-314365, 314368, 314370, 314372-314376, 314378-314381, 314383, 314389, 314391, 314395-314398, 314402, 314405-314410, 314412-314423, 314425-314427, 314429-314430, 314433, 314436, 314439-314440, 314442-314444, 314447-314448, 314451, 314453-314458, 314460, 314462-314468, 314472-314473, 314475-314476, 314478-314487, 314489-314490, 314493, 314495, 314497-314506, 314508, 314510-314513, 314515-314516, 314520, 314522, 314524-314527, 314531, 314536, 314538-314539, 314542-314545, 314547-314550, 314552, 314556, 314558-314565, 314568, 314570-314572, 314574-314575, 314578-314584, 314586-314589, 314592-314595, 314597-314601, 314603-314604, 314606, 314610-314612, 314615-314625, 314628-314629, 314633-314634, 314636-314640, 314647-314652, 314655-314657, 314659, 314661, 314663-314664, 314666-314668, 314670-314675, 314679, 314683, 314685-314687, 314689-314691, 314693, 314696, 314698-314700, 314702-314703, 314705, 314707-314709, 314711, 314713, 314715-314717, 314726, 314728-314730, 314733, 314736-314743, 314745-314752, 314755-314762, 314764, 314767-314768, 314771, 314773-314774, 314776-314779, 314784, 314786, 314788-314790, 314792-314794, 314797-314799, 314801-314805, 314807-314808, 314810, 314812, 314814-314815, 314818-314821, 314823-314828, 314830, 314832-314835, 314837-314845, 314847, 314849-314851, 314859-314868, 314870-314872, 314875-314876, 314879, 314882-314884, 314886-314889, 314891, 314893, 314895-314899, 314901-314903, 314905-314907, 314909-314917, 314921, 314923-314928, 314931-314936, 314939, 314942-314951, 314953-314955, 314957, 314959-314964, 314966, 314968-314977, 314979-314980, 314983-314984, 314987-314988, 314990-314991, 314996-314999, 315001, 315004-315005, 315007, 315009-315012, 315014, 315016-315019, 315022-315028, 315030-315036, 315041-315044, 315048-315049, 315051-315065, 315067-315073, 315079-315080, 315086-315087, 315089, 315092-315094, 315098-315101, 315103-315112, 315115-315118, 315123-315128, 315130-315134, 315137, 315141-315142, 315144-315146, 315148-315151, 315153, 315155-315156, 315158, 315160, 315163, 315165-315166, 315169-315170, 315172-315173, 315175, 315177-315181, 315185, 315188, 315190-315191, 315193-315194, 315197-315200, 315203-315206, 315213, 315216, 315220-315235, 315237-315238, 315241-315245, 315248-315249, 315252-315255, 315257-315258, 315260-315264, 315266, 315274-315276, 315278-315279, 315281, 315283-315284, 315286-315292, 315298-315299, 315301, 315305-315306, 315308-315311, 315313-315315, 315318-315320, 315322-315325, 315327-315336, 315338-315349, 315352-315356, 315358-315359, 315361-315366, 315368-315371, 315374, 315378-315379, 315381-315388, 315391-315392, 315394, 315397-315402, 315405, 315408-315412, 315414, 315416-315420, 315422-315426, 315429-315432, 315434, 315436-315446, 315448, 315450-315451, 315453-315459, 315461-315466, 315468-315470, 315472, 315477-315481, 315483, 315485, 315492-315493, 315495-315496, 315498-315500, 315502-315506, 315508-315509, 315512-315513, 315516-315517, 315519-315521, 315523-315528, 315530-315534, 315538-315543, 315545-315552, 315555-315557, 315560-315568, 315570-315572, 315575-315580, 315582-315585, 315587-315594, 315599-315601, 315605-315607, 315611-315614, 315616-315617, 315619, 315621-315623, 315625-315626, 315628-315635, 315637-315641, 315643, 315645-315646, 315648-315650, 315652-315653, 315655-315657, 315659, 315661, 315663, 315666-315668, 315670-315671, 315673, 315676-315687, 315690-315693, 315698-315702, 315704, 315706-315707, 315710-315715, 315717-315718, 315720-315721, 315724-315727, 315731-315735, 315737, 315739-315740, 315742, 315744-315745, 315747-315750, 315752, 315755, 315757-315772, 315775-315776, 315779-315789, 315792-315793, 315795, 315797-315799, 315801, 315803-315805, 315807, 315809, 315812-315813, 315815-315818, 315821, 315828, 315830-315833, 315835-315840, 315842-315843, 315845, 315849, 315853-315856, 315858-315866, 315870-315878, 315880-315889, 315891-315893, 315895, 315897-315902, 315904, 315906-315911, 315914-315916, 315918, 315920-315921, 315923, 315926, 315928-315930, 315934, 315936-315938, 315943-315946, 315948-315949, 315953-315954, 315956-315961, 315963, 315965, 315969, 315971, 315974-315976, 315979-315982, 315986, 315989, 315991-315993, 315997-315999, 316001, 316003-316005, 316009-316014, 316016-316018, 316021-316024, 316026, 316028, 316030, 316032-316033, 316040, 316043, 316046-316047, 316051, 316058-316059, 316062-316064, 316069-316070, 316072-316076, 316078-316081, 316089-316092, 316094-316096, 316098-316104, 316110-316111, 316113, 316116, 316118-316119, 316124-316125, 316129, 316131, 316133, 316135, 316137-316139, 316141-316148, 316150, 316152-316159, 316161-316163, 316173-316174, 316176-316177, 316179, 316181-316186, 316189-316192, 316195-316198, 316200-316201, 316203, 316209, 316217, 316220, 316222-316226, 316228-316229, 316233-316234, 316239-316243, 316245-316246, 316250-316252, 316256, 316258, 316266-316267, 316269-316271, 316274-316275, 316277, 316279-316280, 316282, 316286-316289, 316292, 316294, 316302-316304, 316306-316308, 316310-316312, 316314, 316316, 316318, 316321, 316324, 316332-316336, 316342-316343, 316345, 316348-316351, 316353, 316356-316357, 316359-316361, 316363, 316366, 316368, 316370-316373, 316375-316384, 316386-316389, 316392, 316394-316396, 316398, 316400-316402, 316404-316406, 316409-316410, 316413-316414, 316416, 316418-316419, 316422, 316427-316429, 316431, 316433-316437, 316440, 316442-316452, 316458, 316460, 316462-316467, 316469-316470, 316472, 316475-316476, 316480, 316482, 316485-316491, 316494-316495, 316499, 316502-316503, 316505-316507, 316510-316511, 316513-316514, 316517-316518, 316520, 316522, 316526-316531, 316535, 316537, 316540-316542, 316545-316554, 316556-316565, 316569-316573, 316576-316582, 316584-316585, 316587, 316589-316595, 316597-316600, 316602, 316604-316605, 316607-316611, 316614, 316616, 316619, 316623-316624, 316626, 316632, 316635-316636, 316639, 316641-316642, 316644, 316647, 316651, 316654-316656, 316658, 316661, 316665-316669, 316671-316673, 316678-316682, 316684, 316686, 316694-316695, 316697, 316703-316704, 316706, 316708-316714, 316716-316718, 316723-316725, 316734, 316736, 316738-316739, 316744-316746, 316748, 316750-316752, 316761-316762, 316764, 316768, 316770-316771, 316774-316775, 316778-316779, 316783-316785, 316788, 316790-316791, 316796-316802, 316806-316809, 316812-316815, 316819-316820, 316822, 316824-316825, 316828, 316831-316834, 316837, 316845, 316847-316848, 316850, 316852, 316855-316863, 316865-316868, 316872-316873, 316879, 316881-316882, 316884-316889, 316892-316893, 316895-316897, 316899-316900, 316902-316907, 316911, 316914-316916, 316920-316921, 316926-316927, 316935-316937, 316940, 316942, 316945, 316948-316949, 316951-316956, 316958, 316960, 316962-316968, 316971-316972, 316975, 316977-316988, 316990, 316992, 316994, 316996, 316999-317000, 317008, 317010-317013, 317015, 317017, 317019-317027, 317032-317033, 317035, 317037-317038, 317040-317043, 317045-317046, 317048, 317050-317051, 317056, 317059-317060, 317062-317063, 317067, 317070, 317072-317073, 317075, 317079, 317083, 317085, 317087-317091, 317094-317095, 317097, 317099-317101, 317103-317104, 317109, 317112-317114, 317116, 317132, 317134-317135, 317142, 317146, 317148, 317152, 317155-317157, 317160-317162, 317164, 317171, 317174-317176, 317178-317181, 317183-317184, 317186-317187, 317189-317190, 317192, 317195-317197, 317199, 317201-317203, 317210, 317212-317213, 317215, 317217-317219, 317223-317225, 317228-317230, 317232-317233, 317236-317239, 317242-317248, 317253-317256, 317259, 317261, 317263-317266, 317268, 317271-317273, 317275, 317277, 317279, 317281-317282, 317290-317292, 317295-317296, 317298-317302, 317304, 317306-317307, 317309-317316, 317319-317323, 317327, 317330-317331, 317335-317342, 317344-317345, 317348-317350, 317353-317355, 317357, 317359, 317361-317364, 317366-317369, 317371-317374, 317380, 317382, 317388, 317390, 317392, 317394, 317397-317399, 317401, 317403-317404, 317406, 317408, 317414-317415, 317419, 317422, 317424-317425, 317431-317432, 317434, 317437-317438, 317441-317450, 317454-317457, 317459-317461, 317466, 317468, 317470-317484, 317486-317491, 317495-317497, 317499-317501, 317503-317505, 317510, 317512-317513, 317515-317516, 317519, 317521-317525, 317531, 317533, 317536-317538, 317540-317541, 317543, 317545-317548, 317553-317555, 317559-317562, 317565-317566, 317568, 317572-317573, 317575-317582, 317584, 317586-317595, 317598-317599, 317604-317623, 317625-317626, 317628, 317631-317638, 317641-317645, 317648-317652, 317656, 317659, 317663-317664, 317666-317668, 317672-317674, 317676-317683, 317685-317686, 317689-317691, 317695-317698, 317703, 317706, 317708, 317712-317714, 317717-317718, 317720-317721, 317723-317726, 317729-317731, 317734, 317737-317738, 317740, 317744-317745, 317747-317750, 317752-317755, 317757, 317760-317764, 317766, 317769, 317771-317786, 317788-317792, 317794, 317796-317797, 317799-317801, 317803, 317805, 317807-317809, 317812-317814, 317816, 317819-317835, 317838-317842, 317844, 317846-317850, 317857-317858, 317861, 317864, 317869-317871, 317873, 317875-317879, 317882-317889, 317892-317903, 317906-317909, 317912, 317914, 317916, 317918, 317920-317922, 317924, 317926-317929, 317932, 317934-317940, 317943, 317946-317947, 317951-317953, 317955-317959, 317962-317963, 317965, 317969, 317973-317974, 317976-317980, 317982-317987, 317989-317999, 318001, 318003-318004, 318007-318008, 318012-318013, 318015-318017, 318020, 318022-318023, 318025-318028, 318030, 318032-318036, 318038-318039, 318041-318042, 318046, 318048, 318052, 318055-318059, 318062, 318064, 318070-318072, 318074-318075, 318077-318079, 318082-318087, 318089-318090, 318092, 318094, 318096, 318098-318099, 318102-318117, 318119-318123, 318125-318129, 318133-318138, 318140-318141, 318143-318145, 318148, 318151, 318153-318154, 318156-318158, 318161, 318163-318164, 318166-318167, 318169-318174, 318176-318178, 318180, 318182, 318184, 318187-318190, 318192, 318194-318216, 318218-318219, 318222, 318225-318233, 318235, 318238, 318240, 318246, 318252-318253, 318256, 318260-318270, 318277-318281, 318283, 318285, 318287-318297, 318302-318309, 318311-318316, 318318, 318322-318328, 318334, 318339-318343, 318347-318349, 318353, 318355, 318357, 318359-318362, 318367, 318369-318375, 318377-318379, 318381, 318385, 318387-318390, 318392-318393, 318395, 318397-318398, 318400-318404, 318407-318408, 318410-318411, 318414, 318419-318420, 318424, 318427-318428, 318430, 318433, 318437, 318439, 318441-318444, 318446-318447, 318449-318450, 318452-318456, 318458-318459, 318461-318463, 318465-318469, 318471-318472, 318476-318477, 318479, 318481, 318483, 318485, 318487, 318489-318497, 318499, 318501-318504, 318506-318510, 318515-318523, 318525-318528, 318530, 318532-318535, 318537, 318539-318540, 318543-318556, 318560-318562, 318564-318565, 318568-318570, 318572-318573, 318575-318579, 318581, 318583, 318585, 318587, 318589-318590, 318593-318594, 318596-318598, 318601, 318603-318606, 318608-318610, 318613-318616, 318623-318627, 318631-318635, 318637-318639, 318642-318643, 318648-318650, 318652, 318655-318657, 318659, 318661-318662, 318664, 318666, 318670, 318672-318675, 318677, 318679-318684, 318686-318688, 318690, 318692, 318696-318703, 318705, 318707, 318710, 318712-318713, 318715-318719, 318721-318730, 318732-318735, 318737-318741, 318743, 318745, 318747, 318750-318751, 318754-318756, 318758-318760, 318768-318769, 318775-318776, 318778, 318780, 318784, 318786, 318788-318791, 318793-318796, 318802-318805, 318807-318810, 318813-318820, 318822-318823, 318825, 318827, 318829-318833, 318836, 318838, 318840-318841, 318843, 318846-318855, 318857-318863, 318865-318866, 318868-318870, 318872-318878, 318880, 318884-318885, 318890-318894, 318896-318909, 318911-318915, 318917, 318919-318926, 318929-318931, 318933-318935, 318937-318940, 318942-318943, 318945, 318948-318951, 318953, 318956-318959, 318962-318964, 318966-318968, 318970-318975, 318977-318993, 318995-318996, 318998, 319000-319004, 319008-319010, 319012-319016, 319018-319020, 319023-319025, 319027-319030, 319033-319034, 319036, 319039-319046, 319048-319049, 319052, 319056-319058, 319060-319061, 319064, 319068-319069, 319072, 319075, 319077, 319079, 319081, 319083-319089, 319092, 319094-319097, 319102-319103, 319105, 319107-319109, 319111, 319113-319118, 319120-319122, 319124-319130, 319132-319136, 319142-319152, 319154, 319158, 319160, 319163, 319166, 319169-319178, 319180-319184, 319186-319187, 319189, 319191, 319193-319194, 319196-319202, 319204, 319206-319207, 319209, 319211-319213, 319215-319219, 319221, 319226-319232, 319234-319236, 319238-319240, 319242-319247, 319249-319254, 319256, 319259-319260, 319262-319264, 319269, 319271-319272, 319279-319280, 319283, 319285-319287, 319289-319290, 319292-319296, 319298, 319303-319305, 319308-319309, 319312-319314, 319316-319319, 319322, 319324-319327, 319330, 319333-319334, 319336, 319338-319340, 319342-319343, 319345-319347, 319349, 319354-319356, 319359, 319363-319364, 319366, 319368-319373, 319375-319380, 319382-319383, 319385, 319387, 319389-319395, 319397-319398, 319400, 319402-319404, 319407-319410, 319412, 319414, 319416, 319419, 319421, 319424-319427, 319429, 319431-319433, 319435-319437, 319439, 319441-319444, 319446-319449, 319452-319456, 319458-319462, 319464, 319468, 319471-319472, 319474, 319477-319478, 319480, 319483-319491, 319493, 319495-319497, 319499-319500, 319502, 319504-319510, 319512-319513, 319515, 319520, 319524, 319526, 319528-319529, 319531-319532, 319539-319540, 319542-319543, 319545, 319547-319551, 319561-319564, 319566-319570, 319572, 319578, 319581, 319583-319584, 319586, 319590-319594, 319596-319600, 319602, 319604-319606, 319608, 319611, 319613, 319616, 319618-319620, 319622-319624, 319628-319638, 319641-319642, 319644-319645, 319647, 319650-319651, 319656-319661, 319663-319666, 319669-319677, 319679, 319681, 319683-319685, 319687-319688, 319690-319695, 319698-319700, 319702, 319704-319705, 319707-319708, 319710, 319714-319715, 319718-319720, 319722, 319724-319728, 319730-319734, 319736, 319740-319742, 319744, 319747-319748, 319750, 319752, 319754-319756, 319758, 319760-319763, 319766, 319768, 319770, 319773-319777, 319779, 319781-319782, 319784-319788, 319792-319793, 319796-319798, 319806-319807, 319809-319811, 319815, 319818-319827, 319829-319837, 319839, 319841, 319843-319854, 319856, 319859-319863, 319865, 319867, 319869-319871, 319873, 319875-319879, 319881-319883, 319886-319888, 319890-319894, 319896, 319898-319899, 319901-319904, 319906, 319908-319912, 319914-319918, 319921, 319924, 319929, 319931-319932, 319934-319935, 319937, 319939, 319941, 319943, 319948, 319950-319953, 319958-319967, 319969-319980, 319982-319983, 319987-319995, 319997, 319999, 320002-320003, 320005-320012, 320015-320019, 320021, 320024-320029, 320031, 320035-320044, 320046, 320051-320054, 320056, 320058-320059, 320061-320062, 320064-320065, 320068-320069, 320071, 320073, 320075-320077, 320081-320082, 320084-320085, 320097-320098, 320101-320108, 320110-320112, 320114, 320116-320117, 320119-320120, 320124-320134, 320137, 320139-320141, 320144, 320147, 320149-320150, 320152-320154, 320166-320167, 320169, 320171-320181, 320183, 320185, 320187-320188, 320191, 320193-320197, 320199-320209, 320211-320212, 320214, 320218, 320220-320221, 320223-320227, 320229, 320232-320237, 320239-320242, 320248, 320252, 320254-320255, 320257-320260, 320262-320263, 320265-320266, 320268-320274, 320277, 320279-320280, 320282-320286, 320289-320291, 320294, 320297-320298, 320301-320302, 320304, 320307-320308, 320311, 320314-320318, 320322, 320330, 320333, 320337, 320339-320349, 320355-320356, 320363, 320365-320368, 320370-320373, 320376-320385, 320387-320395, 320401-320405, 320407-320409, 320411-320412, 320414-320416, 320419-320420, 320423-320424, 320427, 320433-320435, 320439, 320441-320449, 320451-320452, 320455-320457, 320460-320461, 320463-320464, 320466-320469, 320471, 320475-320476, 320478-320483, 320486, 320488-320494, 320496-320497, 320500-320501, 320503-320504, 320510-320512, 320514-320516, 320518, 320520, 320522, 320524, 320526-320529, 320531-320532, 320534-320536, 320538, 320543, 320545-320548, 320550-320568, 320570-320573, 320575-320576, 320578-320581, 320584, 320586-320590, 320592-320594, 320597-320603, 320605-320609, 320611-320613, 320615-320616, 320619-320621, 320624-320627, 320629-320632, 320635, 320637-320639, 320641-320646, 320648, 320650-320651, 320653-320654, 320657-320658, 320660, 320662, 320666, 320670-320672, 320675-320677, 320679, 320681, 320683, 320687-320688, 320690, 320692-320694, 320698-320700, 320703, 320706, 320709-320710, 320712-320724, 320726, 320728, 320731-320734, 320736, 320739, 320741-320744, 320749, 320751-320752, 320754-320756, 320758-320759, 320762, 320764-320765, 320767-320770, 320772, 320777-320783, 320785-320786, 320788-320790, 320792-320794, 320796-320798, 320800-320801, 320803, 320805-320808, 320810-320811, 320813-320816, 320818-320825, 320828, 320830-320831, 320834-320836, 320838-320839, 320841-320842, 320845-320846, 320848, 320852, 320856-320857, 320859, 320861-320863, 320866-320867, 320869, 320872, 320875-320883, 320886-320888, 320890-320892, 320894-320896, 320900-320901, 320905, 320908-320912, 320915-320916, 320918-320924, 320926-320928, 320930, 320935-320937, 320939-320940, 320942-320946, 320953, 320956-320957, 320959, 320965-320966, 320968-320969, 320971, 320973-320976, 320978, 320981-320990, 320992-320994, 320996, 320998, 321001-321003, 321005-321006, 321009-321011, 321017-321019, 321024-321029, 321031, 321035-321036, 321041, 321044-321048, 321053-321061, 321063-321066, 321068-321070, 321073, 321075-321079, 321081-321082, 321084-321088, 321091-321096, 321099-321101, 321106, 321108, 321114, 321116-321118, 321120, 321123, 321125, 321129, 321132, 321134-321136, 321138-321141, 321145-321150, 321152-321156, 321159-321166, 321168-321170, 321172-321173, 321175, 321177, 321179, 321181, 321184-321188, 321190, 321194, 321196-321197, 321199, 321201, 321203-321205, 321209-321210, 321212-321215, 321217-321223, 321225-321226, 321230, 321232-321233, 321235-321237, 321240, 321242-321251, 321253, 321255-321257, 321259-321263, 321266-321274, 321276-321279, 321281-321283, 321285-321294, 321296-321297, 321299-321301, 321304-321305, 321307-321309, 321312, 321314-321315, 321317-321319, 321322, 321326-321333, 321335, 321338, 321340-321348, 321350-321356, 321358-321360, 321362, 321364-321373, 321377, 321380, 321382-321386, 321390-321397, 321399-321406, 321408-321410, 321413-321414, 321416-321423, 321427-321432, 321435, 321439-321442, 321444-321456, 321458-321459, 321461-321467, 321469-321470, 321472-321477, 321479-321481, 321483-321486, 321488-321490, 321492-321494, 321497-321498, 321500, 321504-321505, 321507-321519, 321523-321524, 321528, 321530-321532, 321534, 321536-321542, 321544-321553, 321555, 321557-321560, 321562, 321566-321569, 321571, 321573-321576, 321579, 321581-321582, 321584-321585, 321589-321594, 321596-321597, 321599, 321602-321614, 321616-321621, 321625, 321636, 321638, 321640-321646, 321648-321650, 321652, 321654-321655, 321657-321661, 321665, 321667, 321669, 321671, 321673-321675, 321677, 321680-321682, 321685, 321688-321689, 321691-321694, 321697, 321699, 321701, 321704-321705, 321707, 321709, 321711-321723, 321726-321728, 321730-321732, 321734, 321736-321737, 321740, 321742-321747, 321749-321752, 321754-321755, 321757, 321759-321762, 321764, 321767-321768, 321770, 321773, 321775, 321777, 321782, 321784-321796, 321798-321799, 321801-321803, 321805, 321807, 321810, 321812, 321814, 321817-321819, 321821, 321823-321826, 321830-321832, 321836, 321841-321847, 321849-321853, 321855-321856, 321858-321860, 321862-321864, 321868, 321870-321872, 321874, 321877, 321879-321880, 321884-321885, 321887-321889, 321892, 321895-321898, 321900-321903, 321908-321910, 321912-321913, 321915-321920, 321923-321928, 321930-321931, 321933-321935, 321937-321939, 321941, 321944-321950, 321952, 321955-321957, 321960-321965, 321967-321968, 321970, 321973-321975, 321977, 321980, 321982-321986, 321988, 321990-321993, 321995-321996, 321998-322004, 322006-322008, 322010, 322012-322014, 322018-322019, 322021-322024, 322026, 322028-322030, 322033, 322035-322041, 322044, 322046-322048, 322053, 322058, 322060-322066, 322069-322073, 322076-322079, 322081-322087, 322089, 322091, 322097, 322099-322100, 322104-322105, 322107-322108, 322110-322112, 322114, 322116, 322119-322120, 322122-322123, 322126-322128, 322130, 322142, 322146-322147, 322152, 322154-322156, 322158-322163, 322166-322172, 322174-322177, 322179-322182, 322184-322187, 322189, 322191, 322193-322194, 322196, 322199-322200, 322202-322203, 322205-322209, 322211, 322213-322214, 322216-322227, 322229-322232, 322234-322238, 322244-322255, 322257-322258, 322260-322264, 322266-322268, 322270-322271, 322275-322277, 322279-322281, 322283-322285, 322288-322289, 322291-322293, 322295-322296, 322298, 322301-322304, 322307, 322309, 322311, 322316-322318, 322321, 322323-322324, 322326, 322330-322332, 322336, 322338, 322340-322342, 322347, 322349-322351, 322353, 322356-322358, 322360-322362, 322364, 322366-322370, 322372, 322376, 322380-322381, 322383, 322385-322388, 322390-322393, 322395-322397, 322399, 322401-322402, 322404-322405, 322409-322411, 322413-322414, 322416-322422, 322427, 322429, 322431-322432, 322437, 322439-322441, 322443-322445, 322451, 322454-322460, 322462, 322465-322466, 322468, 322471, 322473-322474, 322476-322477, 322479-322481, 322485, 322487-322488, 322490-322494, 322500-322501, 322504-322507, 322509, 322518, 322520, 322525-322527, 322529, 322531-322534, 322538-322542, 322544-322549, 322553, 322555-322556, 322558-322559, 322561, 322563-322566, 322569-322570, 322572-322575, 322581, 322583-322584, 322586-322587, 322597-322601, 322605, 322610, 322615-322617, 322619-322620, 322624-322627, 322630-322632, 322634, 322636, 322641-322643, 322646-322647, 322649, 322651-322657, 322660, 322665-322669, 322675-322676, 322678, 322680-322682, 322684-322694, 322696-322697, 322701-322702, 322704-322705, 322709-322710, 322714-322718, 322720, 322722-322725, 322730-322739, 322741, 322743, 322745, 322748-322749, 322751-322753, 322755-322759, 322764, 322766, 322768-322774, 322777-322778, 322780-322781, 322783-322785, 322787-322789, 322791-322793, 322795-322804, 322806-322809, 322811, 322813, 322819-322829, 322833, 322837, 322842-322843, 322847, 322855, 322857-322859, 322868, 322871-322874, 322876-322887, 322891-322893, 322896-322897, 322900, 322903-322905, 322909-322914, 322916, 322919-322921, 322923-322926, 322928-322929, 322931-322933, 322942, 322945-322951, 322955, 322957, 322959-322966, 322968-322969, 322971, 322973, 322978, 322982-322984, 322988, 322990-322992, 322994, 322997, 322999-323014, 323016-323018, 323021-323026, 323030-323035, 323039-323040, 323042-323046, 323049-323051, 323056-323060, 323062-323064, 323066, 323068, 323070-323071, 323073, 323080-323081, 323083-323085, 323089-323090, 323095-323097, 323100, 323102, 323105-323107, 323109-323113, 323126, 323128, 323130-323137, 323139-323149, 323152, 323154, 323156-323161, 323163, 323167, 323169, 323171-323177, 323182, 323189-323190, 323193, 323196-323197, 323200-323202, 323206, 323209, 323212-323213, 323216-323219, 323222, 323226, 323228, 323230-323234, 323236, 323238-323243, 323245-323250, 323253-323255, 323257-323261, 323264, 323267-323270, 323272-323273, 323275, 323277-323278, 323282, 323285-323287, 323289, 323291, 323293-323294, 323296, 323299-323303, 323305, 323307-323308, 323310-323313, 323315-323318, 323320-323323, 323325-323328, 323331-323338, 323350-323351, 323353-323354, 323356-323358, 323360-323361, 323363-323366, 323368-323383, 323385-323389, 323393-323395, 323398-323400, 323402-323404, 323408-323411, 323413, 323417-323426, 323429-323433, 323436, 323440, 323442-323445, 323448-323449, 323452, 323454-323456, 323459-323460, 323462-323465, 323468-323470, 323472-323476, 323479, 323482, 323486-323488, 323490-323492, 323494-323496, 323498-323501, 323503-323505, 323507-323511, 323514-323517, 323520-323525, 323527-323530, 323532-323533, 323535, 323537-323540, 323542-323545, 323547, 323550-323560, 323562-323566, 323569-323570, 323574, 323576-323580, 323584-323588, 323590, 323593, 323596-323598, 323601, 323603, 323605, 323607, 323612-323615, 323621, 323623-323624, 323628-323631, 323633-323635, 323637-323640, 323645-323646, 323648-323651, 323654, 323656, 323658, 323660-323662, 323665-323669, 323671-323672, 323674-323675, 323677, 323679-323681, 323683, 323686, 323688-323697, 323699-323702, 323704, 323708-323709, 323714, 323717-323720, 323723-323725, 323727-323728, 323730-323732, 323734, 323741-323745, 323747-323748, 323753-323754, 323756, 323762, 323764-323768, 323770, 323772-323774, 323776, 323779, 323782-323787, 323791-323795, 323800-323801, 323803, 323805-323806, 323808, 323810-323811, 323813-323815, 323817, 323820, 323823, 323825, 323827-323829, 323831, 323833, 323835-323838, 323841-323842, 323847, 323849-323852, 323855-323856, 323858, 323860, 323862-323863, 323866-323868, 323871, 323873-323874, 323877, 323879-323881, 323884-323886, 323888, 323890-323891, 323893, 323896, 323901-323904, 323906, 323908, 323910, 323912-323916, 323918, 323920, 323922-323924, 323926-323928, 323933-323934, 323937-323947, 323949, 323951-323952, 323954, 323957-323958, 323960-323961, 323964, 323967, 323969, 323973, 323980-323981, 323984-323985, 323989, 323991, 323993-323995, 323997-323998, 324000-324006, 324009, 324011, 324014, 324016-324025, 324028, 324030, 324036-324041, 324043, 324046, 324048, 324050-324056, 324062, 324064-324068, 324071-324072, 324075, 324079-324080, 324083-324088, 324091-324097, 324100, 324102, 324105, 324107-324112, 324114-324126, 324128-324130, 324132-324134, 324136-324137, 324139-324144, 324146-324149, 324151, 324153, 324155, 324157-324162, 324166, 324169-324170, 324175-324176, 324178-324179, 324182, 324185-324186, 324188-324197, 324201-324204, 324206, 324208, 324210-324213, 324215-324216, 324218, 324222-324233, 324235-324236, 324238, 324240-324243, 324245-324253, 324255-324258, 324260-324263, 324265-324271, 324273, 324275-324278, 324281, 324284-324288, 324290, 324292, 324294, 324296, 324298-324299, 324301, 324304-324311, 324313-324320, 324324-324327, 324329-324331, 324333-324337, 324340, 324343, 324345-324346, 324348-324349, 324352, 324354-324357, 324359-324365, 324367-324369, 324371-324374, 324376, 324379-324381, 324383-324389, 324392-324394, 324396, 324399-324400, 324403, 324405-324409, 324411, 324413-324417, 324419-324420, 324422-324425, 324427-324428, 324430-324431, 324433-324435, 324438-324442, 324445, 324447-324468, 324470, 324472-324477, 324479-324481, 324484-324486, 324488-324489, 324492-324502, 324504, 324506, 324510-324516, 324518-324519, 324522-324524, 324528-324535, 324537-324548, 324550-324554, 324556, 324558, 324560, 324563, 324566, 324568, 324570-324571, 324575-324582, 324584-324590, 324592, 324597, 324599-324601, 324603-324605, 324607-324608, 324610-324614, 324617-324622, 324625, 324627-324629, 324632, 324634, 324637-324649, 324651-324659, 324661, 324663-324665, 324667-324669, 324672-324676, 324678-324682, 324685, 324687, 324689, 324691-324693, 324696-324697, 324700, 324702-324703, 324705-324707, 324710-324713, 324715-324717, 324720-324722, 324726-324728, 324732-324737, 324741, 324743-324744, 324746-324757, 324760-324761, 324763, 324765-324769, 324771-324780, 324782-324784, 324786, 324788-324789, 324795-324797, 324799, 324801-324803, 324805-324809, 324815-324817, 324820-324821, 324825-324826, 324828-324829, 324832-324834, 324836-324838, 324841-324849, 324851, 324853-324854, 324856-324861, 324864, 324866-324869, 324871, 324874-324876, 324878-324887, 324889, 324891-324894, 324898, 324900, 324904, 324907-324908, 324910-324919, 324924-324925, 324928, 324931, 324934, 324939, 324941, 324949, 324951, 324953, 324956, 324958-324964, 324966, 324968, 324972, 324974-324977, 324979, 324981-324986, 324991-324992, 324997, 324999-325002, 325004-325018, 325021-325027, 325030, 325032-325034, 325036, 325039, 325042-325046, 325048-325050, 325054-325055, 325058, 325060, 325067-325069, 325071-325072, 325074-325075, 325077-325080, 325084-325090, 325092-325094, 325096-325097, 325099-325113, 325117-325118, 325120-325121, 325123, 325125-325126, 325128-325129, 325132, 325134, 325137-325138, 325141-325142, 325146-325147, 325149, 325151-325156, 325158-325159, 325161-325162, 325165-325167, 325171-325173, 325175-325179, 325181-325182, 325184-325201, 325203, 325205-325206, 325208-325210, 325213-325214, 325217-325228, 325231-325234, 325236, 325238, 325240-325244, 325246, 325249, 325252, 325254-325266, 325269, 325271, 325273-325275, 325279-325280, 325282-325283, 325285-325286, 325288, 325290-325293, 325295, 325297-325300, 325302-325306, 325309-325311, 325314, 325316-325324, 325326-325329, 325332-325333, 325335, 325337, 325339, 325341-325343, 325346-325350, 325352-325364, 325366, 325369-325372, 325377-325380, 325382-325385, 325390, 325393-325394, 325396, 325398-325399, 325401-325403, 325405-325408, 325411-325414, 325418-325423, 325425-325428, 325430, 325432-325434, 325436-325438, 325440, 325442-325445, 325447, 325451-325452, 325454, 325457, 325459, 325461, 325463, 325466, 325468-325475, 325479-325480, 325482, 325484-325485, 325487, 325490-325491, 325493-325494, 325497-325498, 325501-325503, 325505-325516, 325518-325520, 325522-325524, 325532, 325540, 325544-325546, 325552-325554, 325557-325559, 325561-325562, 325564, 325568-325570, 325572-325576, 325578, 325581-325582, 325586, 325588, 325590, 325592, 325594-325595, 325597-325598, 325600-325601, 325603-325608, 325610, 325612, 325615-325617, 325621-325624, 325627-325629, 325631-325633, 325635-325637, 325641-325642, 325644-325645, 325647, 325649, 325651-325654, 325656-325657, 325660-325662, 325664, 325666, 325670, 325672-325673, 325677-325681, 325683-325684, 325687-325692, 325694-325698, 325700, 325703-325704, 325706-325707, 325710, 325715-325716, 325718, 325721-325722, 325724-325740, 325743-325745, 325748-325751, 325753, 325756, 325758, 325762-325763, 325765-325769, 325771, 325773, 325778-325782, 325786, 325788-325790, 325792, 325795, 325804-325806, 325811-325818, 325822-325823, 325832, 325838, 325842-325847, 325849, 325853-325861, 325863, 325868, 325870-325871, 325873, 325875, 325878-325881, 325885-325887, 325892, 325895, 325897-325899, 325901-325902, 325905, 325907, 325910-325913, 325915, 325918-325919, 325922-325924, 325926-325927, 325930-325939, 325941-325942, 325944-325945, 325948, 325950, 325952-325957, 325959, 325962, 325965-325966, 325969, 325971, 325973, 325976, 325981-325982, 325985-325990, 325992-325994, 325996-325997, 325999-326002, 326004-326008, 326010, 326012, 326015-326016, 326019-326021, 326027-326039, 326041, 326043-326046, 326054-326055, 326059-326061, 326063, 326065-326072, 326079-326083, 326086-326089, 326093, 326095-326100, 326106-326108, 326110-326111, 326113-326115, 326117, 326119-326121, 326123-326129, 326131-326132, 326134, 326136, 326138, 326143-326145, 326147-326150, 326152, 326154-326156, 326158-326160, 326163, 326165-326170, 326175-326179, 326181-326185, 326188-326189, 326191-326195, 326197, 326199-326200, 326202, 326204-326205, 326207-326208, 326211-326214, 326220-326224, 326226-326231, 326235-326240, 326242-326243, 326245-326246, 326251-326254, 326256, 326258, 326260-326264, 326266-326271, 326273-326274, 326279, 326281, 326287-326290, 326294, 326300-326304, 326309, 326313, 326315-326320, 326322, 326324-326325, 326327, 326331, 326334-326335, 326337-326340, 326342-326344, 326346-326347, 326352, 326357-326360, 326362, 326366, 326370-326372, 326374-326376, 326379-326384, 326386-326393, 326397-326401, 326403, 326405, 326409, 326412-326417, 326419, 326424-326425, 326428, 326430, 326434, 326437, 326442, 326444, 326446, 326449, 326451, 326453-326454, 326457-326458, 326460-326462, 326464, 326467, 326473, 326475-326476, 326478-326480, 326483-326484, 326486-326487, 326489-326491, 326493-326494, 326497-326498, 326508, 326510-326512, 326514-326518, 326520-326523, 326525, 326527-326532, 326535-326539, 326544-326548, 326551-326559, 326562-326566, 326569-326570, 326572, 326574-326575, 326580-326585, 326587-326591, 326594-326596, 326599, 326601, 326604, 326606, 326608-326609, 326611-326612, 326614, 326616, 326618-326619, 326622, 326626-326627, 326631-326632, 326635, 326638, 326640-326643, 326645-326649, 326651-326652, 326657, 326659-326662, 326664-326665, 326667-326673, 326676, 326678, 326681, 326683, 326685-326689, 326691, 326693-326695, 326697-326698, 326700-326701, 326704, 326707, 326709, 326711-326712, 326717, 326719-326720, 326722, 326728-326732, 326735-326740, 326742, 326744-326747, 326750-326753, 326755-326756, 326758-326759, 326762-326764, 326766-326769, 326771-326772, 326774, 326776-326780, 326783-326784, 326788-326792, 326794, 326797-326799, 326801-326804, 326806-326808, 326810-326815, 326817, 326819, 326821-326823, 326825-326830, 326832, 326834-326835, 326837-326838, 326841-326843, 326846-326848, 326851-326855, 326859-326860, 326863, 326865-326867, 326869-326873, 326875, 326877-326885, 326887-326896, 326899-326900, 326902-326908, 326910-326911, 326913, 326915-326917, 326919-326925, 326927-326928, 326930-326932, 326935-326942, 326946-326947, 326949, 326951, 326953-326957, 326959-326960, 326962-326966, 326969-326971, 326973-326986, 326988-326989, 326991-326993, 326995, 326997-327000, 327002, 327005-327010, 327012-327013, 327015, 327017, 327021-327024, 327026-327029, 327031, 327033, 327039-327043, 327045-327047, 327049, 327051-327057, 327059-327062, 327064-327068, 327070-327071, 327073, 327075-327078, 327080, 327082-327083, 327085-327089, 327094, 327096-327108, 327110-327112, 327114, 327116, 327118-327121, 327123-327125, 327127-327129, 327132, 327134-327138, 327143-327149, 327151-327157, 327161, 327164-327165, 327167, 327171-327173, 327175, 327178-327179, 327181-327182, 327186, 327189-327190, 327192-327197, 327199, 327202-327204, 327206-327208, 327210-327211, 327213, 327218, 327221-327224, 327227-327233, 327235-327239, 327241, 327243, 327246-327247, 327249-327252, 327254-327256, 327259-327260, 327262-327265, 327269-327270, 327273-327274, 327276, 327278-327281, 327283-327285, 327287-327289, 327291-327294, 327296-327299, 327302-327304, 327307-327313, 327316-327318, 327322-327327, 327329-327330, 327332, 327335, 327338-327339, 327344-327351, 327353-327354, 327356, 327359, 327361, 327369, 327372-327376, 327379, 327381-327382, 327385-327395, 327397-327400, 327402-327409, 327412, 327414, 327418-327419, 327423, 327425-327429, 327431-327434, 327438, 327440-327444, 327447-327455, 327457-327458, 327460-327463, 327466-327471, 327473-327475, 327480-327483, 327485-327488, 327490-327493, 327497-327501, 327503-327510, 327512, 327514-327515, 327517-327518, 327520-327524, 327527-327528, 327530-327532, 327534, 327536, 327539-327550, 327553, 327555, 327558, 327561, 327563-327566, 327568, 327571, 327573-327575, 327577-327580, 327582, 327585, 327587-327590, 327592, 327594-327596, 327604, 327606, 327608, 327610-327614, 327617, 327619, 327622-327624, 327626, 327637, 327639-327641, 327643, 327645-327647, 327649, 327653, 327655, 327658-327660, 327663-327667, 327670, 327674-327676, 327678, 327681-327685, 327688-327689, 327691-327692, 327695, 327697-327698, 327701-327703, 327706-327708, 327710-327711, 327713-327715, 327717-327721, 327723, 327725, 327728-327730, 327732-327736, 327739, 327741, 327743-327746, 327748-327750, 327752-327760, 327764, 327766, 327768-327769, 327772, 327774, 327776-327778, 327780, 327782-327787, 327793, 327799, 327803-327804, 327807, 327812-327813, 327824-327825, 327827-327833, 327835, 327839, 327842, 327844-327847, 327849-327855, 327857, 327859-327860, 327862-327868, 327871-327873, 327875-327887, 327889, 327892-327894, 327899-327900, 327902, 327904, 327906-327910, 327912, 327915-327919, 327921-327932, 327935-327944, 327946-327947, 327950-327956, 327958-327963, 327965, 327968-327971, 327975, 327977, 327979-327981, 327983-327988, 327994-327997, 327999, 328002, 328004, 328006-328008, 328011, 328014-328017, 328020, 328023, 328025, 328032, 328034-328037, 328039-328042, 328044-328048, 328050, 328054-328059, 328061-328068, 328074-328084, 328086, 328088-328096, 328098-328110, 328112-328114, 328117, 328123, 328126, 328134, 328137, 328139-328145, 328150-328161, 328163-328170, 328174-328175, 328179, 328181-328188, 328190-328191, 328194-328197, 328199-328204, 328206, 328209-328214, 328224-328228, 328230-328231, 328233, 328235-328236, 328239-328240, 328242, 328244-328245, 328248-328250, 328253, 328255-328256, 328258-328259, 328261-

328268, 328275, 328284, 328288-328291, 328293, 328296-328297, 328301, 328304-328310, 328312-328314, 328316-328318, 328320-328324, 328330, 328334-328336, 328338-328345, 328347, 328349, 328351-328353, 328359, 328361-328362, 328364, 328366-328368, 328370-328375, 328377, 328381-328388, 328390-328392, 328396-328397, 328399-328402, 328406-328407, 328409, 328413-328417, 328419-328425, 328427-328436, 328441, 328443, 328445-328447, 328451, 328453-328454, 328457-328458, 328461-328466, 328468-328472, 328474, 328476-328479, 328481, 328483, 328485-328488, 328492-328494, 328496-328500, 328502-328504, 328506-328508, 328512, 328514-328515, 328517-328520, 328523-328526, 328528, 328530, 328533-328534, 328537-328540, 328542-328550, 328552-328555, 328559-328570, 328573-328580, 328583, 328585, 328587-328590, 328593-328602, 328604-328614, 328616, 328619-328620, 328622-328627, 328631-328632, 328634-328635, 328639, 328641-328642, 328647-328648, 328652, 328654-328656, 328660-328661, 328663-328665, 328668-328674, 328677, 328681-328682, 328684-328689, 328691-328694, 328696, 328698-328702, 328704-328707, 328710, 328712, 328717-328721, 328723-328726, 328730-328731, 328733, 328738-328746, 328748-328750, 328752-328756, 328761, 328763, 328766-328772, 328775-328779, 328782-328785, 328788-328789, 328791-328795, 328797, 328804-328805, 328807-328811, 328815-328817, 328820, 328823, 328825, 328827-328830, 328835-328841, 328843-328844, 328846, 328848-328849, 328851, 328854, 328857, 328859, 328861, 328863-328873, 328875-328876, 328878-328881, 328883, 328892-328893, 328895, 328897-328899, 328904-328906, 328909, 328911, 328915, 328917-328922, 328924-328926, 328928-328929, 328931, 328935, 328937, 328941-328943, 328947, 328949-328951, 328953-328954, 328958-328960, 328968, 328970-328973, 328975-328977, 328979-328989, 328991, 328996, 328998-329004, 329006-329007, 329009, 329012-329013, 329015-329021, 329023-329024, 329027-329034, 329036-329037, 329039-329040, 329042, 329045, 329051-329052, 329056, 329058-329063, 329065, 329067-329068, 329070, 329072-329073, 329075, 329077-329080, 329084, 329087-329090, 329093-329096, 329099-329104, 329107-329111, 329113, 329116, 329119-329120, 329125, 329127-329130, 329135-329137, 329139, 329141, 329143, 329145, 329149, 329154, 329156-329158, 329163-329165, 329167, 329170-329171, 329174, 329176-329177, 329179-329181, 329184-329185, 329187-329192, 329194-329197, 329199-329200, 329202, 329205, 329209-329213, 329215, 329217-329219, 329221, 329223, 329225, 329229-329231, 329234-329240, 329242-329245, 329247, 329249-329252, 329254, 329256, 329258, 329260, 329264-329268, 329271-329274, 329276, 329278, 329281-329283, 329285, 329288-329289, 329294-329295, 329298-329299, 329301-329305, 329307-329309, 329312-329313, 329315, 329318, 329320, 329322, 329325-329327, 329330, 329332, 329334, 329337, 329339, 329341-329349, 329351-329356, 329358-329359, 329361-329364, 329366-329369, 329371-329373, 329375, 329377-329382, 329385-329388, 329390-329394, 329397, 329402-329403, 329405-329410, 329412-329415, 329417, 329419-329421, 329427-329432, 329435, 329439-329440, 329442, 329446-329447, 329451, 329455, 329457-329458, 329460-329469, 329471, 329476-329482, 329487, 329490-329492, 329497, 329499-329501, 329504, 329506-329509, 329511, 329514-329518, 329522, 329525-329527, 329530, 329532-329533, 329535-329540, 329542, 329553-329557, 329559-329561, 329565-329567, 329569, 329571, 329576-329579-329581, 329583-329584, 329587, 329592-329598, 329601-329602, 329604-329605, 329607-329609, 329611, 329616, 329619, 329621-329622, 329624, 329626, 329631, 329633, 329640, 329646, 329648-329650, 329654, 329656-329658, 329661-329662, 329669, 329672, 329674-329675, 329680, 329683-329684, 329688-329689, 329693, 329697-329698, 329700-329701, 329705-329710, 329712-329713, 329715-329717, 329719, 329721-329722, 329725, 329727-329730, 329732-329735, 329738, 329740-329746, 329748-329758, 329760-329761, 329763-329764, 329766-329768, 329770, 329774, 329776-329779, 329781-329782, 329784-329785, 329790-329791, 329797-329798, 329800-329801, 329804-329808, 329811, 329813, 329816, 329819-329821, 329824, 329827-329829, 329831, 329834, 329843-329845, 329847-329853, 329857, 329862-329863, 329865, 329867, 329869, 329872, 329876-329886, 329888-329889, 329891, 329893-329895, 329898-329901, 329903, 329906, 329908-329912, 329917, 329919, 329921, 329923, 329928-329929, 329938, 329941, 329943, 329949, 329952-329961, 329963, 329967-329969, 329971-329975, 329978-329981, 329983-329991, 329993, 329997, 330000, 330002, 330005-330007, 330009-330015, 330017, 330020, 330022, 330024, 330028-330029, 330031-330033, 330035-330036, 330038-330039, 330042-330043, 330045, 330049-330051, 330056-330061, 330063-330067, 330069, 330074, 330078, 330082-330086, 330088, 330091-330092, 330095, 330097-330099, 330101, 330104-330105, 330107-330108, 330110-330111, 330113-330116, 330118-330120, 330125-330127, 330131-330132, 330134-330135, 330137-330141, 330144, 330146-330148, 330151-330155, 330162, 330164, 330167-330170, 330173-330178, 330180-330181, 330184-330197, 330199-330201, 330203-330210, 330213-330222, 330224-330226, 330229-330232, 330234-330235, 330237, 330239-330245, 330247-330258, 330266-330268, 330270-330271, 330273, 330275-330278, 330280, 330282-330283, 330285-330287, 330292, 330296, 330299-330305, 330308-330309, 330311-330312, 330314, 330319, 330321, 330324, 330327, 330330, 330334, 330336-330338, 330340, 330349-330351, 330353, 330357, 330360-330361, 330364-330367, 330369, 330371-330372, 330374, 330377-330378, 330380-330383, 330386-330387, 330389-330393, 330398, 330407-330409, 330411, 330413, 330420-330429, 330432, 330434-330436, 330439, 330441, 330443, 330446-330449, 330451, 330455, 330457, 330459, 330461-330466, 330468, 330475-330476, 330479-330483, 330485, 330487-330489, 330495, 330497, 330503-330504, 330506-330508, 330511-330513, 330516-330517, 330520, 330524, 330527, 330531-330533, 330536-330548, 330550-330552, 330555, 330559, 330562-330564, 330567, 330571-330573, 330575, 330579-330580, 330582, 330584-330586, 330588, 330590, 330592, 330594-330597, 330599-330600, 330604, 330606-330608, 330611, 330613-330614, 330617, 330619, 330621, 330624-330625, 330627-330629, 330631, 330633, 330635, 330638, 330641-330644, 330648, 330652-330654, 330666-330667, 330674, 330676, 330679-330682, 330684-330686, 330689-330692, 330694-330696, 330698, 330700-330709, 330711, 330713-330716, 330720, 330722, 330726, 330729, 330732-330733, 330735-330737, 330739, 330741-330742, 330744, 330746-330747, 330749-330753, 330755, 330757, 330760-330763, 330765, 330767-330768, 330770-330773, 330775-330776, 330780, 330782-330784, 330786-330790, 330792, 330794-330797, 330801-330807, 330812, 330814, 330816-330819, 330821-330823, 330826-330827, 330829-330830, 330833-330834, 330837, 330840, 330842-330844, 330846, 330849-330852, 330854, 330859-330861, 330863-330871, 330873, 330875-330887, 330890-330892, 330895-330898, 330902-330906, 330909-330913, 330915-330920, 330922-330924, 330926-330931, 330934-330937, 330939-330940, 330942, 330944-330946, 330948-330950, 330952-330957, 330961, 330963-330964, 330966-330971, 330973, 330977-330978, 330980-330982, 330984, 330986-330991, 330994, 330997-330999, 331001-331002, 331004-331006, 331008-331010, 331012, 331016-331018, 331020-331021, 331023-331028, 331030-331033, 331036, 331039, 331042, 331045-331048, 331050-331052, 331055-331056, 331058-331059, 331062, 331066, 331068-331070, 331075, 331079-331080, 331082-331085, 331088-331089, 331092-331093, 331096-331099, 331101-331104, 331108, 331111-331112, 331116, 331118-331119, 331122-331126, 331128-331130, 331132, 331134, 331142-331145, 331147, 331152-331156, 331158-331160, 331164, 331166-331167, 331169, 331171-331176, 331179-331180, 331187, 331189-331194, 331196-331197, 331199, 331201-331206, 331208, 331210, 331213, 331215-331218, 331221, 331224, 331226-331230, 331232-331240, 331246-331253, 331255-331257, 331259-331260, 331262-331266, 331269-331270, 331274-331285, 331288, 331292-331299, 331302-331306, 331308, 331312-331314, 331316, 331320-331323, 331325-331327, 331331-331332, 331341-331342, 331345-331351, 331355-331356, 331359, 331362, 331365-331367, 331371-331374, 331376-331379, 331390-331391, 331394, 331396-331398, 331400-331405, 331407-331408, 331411, 331415-331417, 331419-331431, 331433-331436, 331439-331441, 331443, 331445-331446, 331448-331449, 331451, 331454-331455, 331457, 331459, 331461, 331463, 331465, 331468-331469, 331471-331474, 331476, 331479-331481, 331485, 331487-331491, 331493-331498, 331500, 331502-331503, 331505-331523, 331525, 331528-331532, 331534-331539, 331541-331552, 331557, 331560-331561, 331563, 331565-331566, 331568-331570, 331572-331575, 331577-331589, 331591-331592, 331596, 331599-331605, 331607, 331609-331624, 331626-331627, 331629, 331631-331632, 331634-331636, 331639-331648, 331651-331652, 331656-331660, 331662-331670, 331672-331679, 331682-331685, 331687, 331690-331697, 331700-331708, 331712-331715, 331717, 331719, 331722-331723, 331725, 331727, 331729-331732, 331734, 331736-331737, 331739, 331742-331745, 331749-331751, 331759-331760, 331762-331764, 331766-331767, 331769, 331771-331773, 331778-331779, 331781-331783, 331785-331786, 331788-331790, 331792-331796, 331798-331800, 331803-331804, 331806, 331808-331813, 331815, 331817, 331819, 331821-331822, 331828, 331832, 331834-331843, 331850, 331854, 331856-331860, 331863-331869, 331871-331873, 331875-331886, 331888-331889, 331891, 331893, 331896-331900, 331905, 331907-331910, 331912, 331914-331916, 331919-331920, 331923, 331925-331928, 331931-331933, 331935-331942, 331944-331946, 331953, 331955-331957, 331960-331962, 331965, 331967-331969, 331975-331976, 331978-331981, 331983, 331987, 331990-331993, 331995, 331997, 331999, 332001-332002, 332005-332006, 332009, 332011, 332013-332015, 332017, 332019-332022, 332024-332026, 332028-332033, 332035-332040, 332042-332043, 332045-332046, 332049, 332053-332057, 332059-332060, 332065-332068, 332070-332071, 332075, 332079-332081, 332083, 332085-332090, 332093, 332095-332096, 332100, 332103, 332105, 332107-332108, 332111, 332113-332115, 332118-332122, 332125, 332127-332128, 332130-332135, 332138-332139, 332141-332143, 332145-332147, 332149-332150, 332152-332153, 332157-332160, 332162-332168, 332170-332174, 332176-332180, 332182-332183, 332185, 332189, 332191-332194, 332198-332209, 332211, 332213, 332215-332218, 332220-332221, 332223, 332225-332231, 332234, 332236-332239, 332241-332242, 332244-332249, 332253, 332255-332258, 332260, 332265, 332267-332271, 332274-332275, 332277, 332279, 332281-332283, 332285-332286, 332288, 332290-332292, 332295-332297, 332299-332319, 332321-332324, 332326-332327, 332330, 332332, 332334, 332337-332338, 332340-332347, 332349, 332351-332356, 332359-332363, 332367-332368, 332370, 332372-332377, 332379-332382, 332384-332393, 332396-332406, 332408-332411, 332413-332414, 332416, 332418-332423, 332425-332429, 332431, 332433-332434, 332437-332438, 332443-332444, 332452-332457, 332460-332468, 332470-332473, 332475-332477, 332479-332482, 332484-332487, 332491-332494, 332496-332497, 332500-332505, 332507, 332509-332542, 332544, 332546-332547, 332552-332553, 332557, 332560-332570, 332572-332574, 332576-332579, 332581-332582, 332585, 332587-332589, 332595-332596, 332601-332605, 332607-332610, 332613, 332615-332619, 332621-332625, 332627, 332632-332636, 332641, 332643, 332646, 332648-332650, 332653, 332655, 332657-332660, 332664-332666, 332669, 332672, 332675, 332678, 332680-332682, 332685, 332687, 332690, 332693, 332696, 332698-332704, 332706-332707, 332709, 332711-332717, 332719, 332722, 332724, 332726-332732, 332737-332738, 332742-332743, 332745-332752, 332754-332756, 332758-332770, 332772-332775, 332777-332781, 332783-332790, 332792-332794, 332800-332805, 332807-332811, 332816-332818, 332820-332826, 332828-332829, 332831-332833, 332835, 332840-332841, 332843, 332845, 332849, 332851-332852, 332854, 332856-332860, 332867, 332869-332872, 332874-332877, 332879-332881, 332885-332891, 332895-332896, 332899, 332906, 332908-332909, 332911-332912, 332916, 332920, 332922-332923, 332926-332928, 332931, 332933-332934, 332937-332940, 332942-332948, 332953-332956, 332958, 332960, 332962-332964, 332967-332969, 332972-332973, 332976, 332979-332986, 332988, 332991-332996, 332998, 333002, 333005, 333007, 333009, 333011, 333013-333014, 333016, 333018-333019, 333023-333028, 333031, 333033-333034, 333037-333042, 333048-333053, 333056, 333060-333069, 333073-333074, 333076-333079, 333081-333082, 333084-333086, 333089-333091, 333093, 333095-333096, 333098-333099, 333102-333103, 333105-333114, 333116, 333118, 333120-333121, 333123, 333126-333127, 333129-333134, 333136, 333140-333142, 333145-333151, 333154-333155, 333158-333159, 333161-333165, 333171-333172, 333174-333175, 333177-333178, 333183, 333185-333190, 333192-333195, 333197, 333199-333200, 333202-333203, 333205, 333209, 333219-333220, 333223, 333227, 333229, 333233, 333235, 333237-333238, 333240, 333242, 333244-333246, 333251, 333253-333255, 333258, 333260-333262, 333264, 333266-333274, 333276-333285, 333288-333291, 333293-333299, 333301-333302, 333304-333306, 333308-333313, 333315, 333320, 333322-333324, 333326, 333328-333342, 333345, 333347-333348, 333350, 333352-333355, 333357-333358, 333361-333365, 333367, 333372-333375, 333377-333378, 333380, 333383-333385, 333387, 333392-333396, 333398, 333400-333401, 333404-333405, 333407-333409, 333412, 333414-333416, 333418, 333420-333421, 333423-333424, 333427-333428, 333431, 333433, 333436-333439, 333442-333447, 333449, 333451-333452, 333455, 333458, 333462-333463, 333466-333468, 333473-333478, 333481, 333487-333488, 333490-333493, 333495-333498, 333500, 333505-333510, 333512-333515, 333517-333526, 333530-333531, 333533-333536, 333539, 333541, 333544, 333547, 333549-333553, 333555, 333557-333561, 333564-333573, 333576-333578, 333580-333584, 333587-333593, 333595, 333597, 333599, 333601-333603, 333605-333607, 333609, 333611-333616, 333618, 333620-333623, 333626-333631, 333633-333637, 333639-333649, 333651, 333653-333668, 333670-333672, 333674-333675, 333677, 333679-333685, 333688-333689, 333691-333692, 333694, 333696, 333699, 333701, 333703-333712, 333717-333718, 333720-333724, 333727-333730, 333732-333740, 333743-333748, 333750-333751, 333754-333756, 333759-

333760, 333763-333767, 333770-333773, 333777-333779, 333781-333789, 333791-333793, 333795, 333799-333804, 333806, 333808-333809, 333811-333814, 333816, 333819-333822, 333824, 333826-333830, 333834-333836, 333839-333842, 333846, 333851, 333854-333859, 333862, 333865-333871, 333873-333874, 333876-333877, 333880, 333884-333891, 333893, 333895-333898, 333900, 333905-333910, 333913-333922, 333928-333931, 333933, 333935-333938, 333940, 333942, 333944-333950, 333952, 333955-333957, 333959, 333961, 333963-333965, 333967-333981, 333983-333984, 333987, 333998-334006, 334009-334013, 334015, 334018, 334020-334022, 334024-334025, 334027-334028, 334031-334032, 334035, 334037-334038, 334040-334046, 334048, 334052, 334054-334055, 334057-334059, 334062-334065, 334067, 334070, 334072-334073, 334080-334081, 334084-334085, 334087-334088, 334092-334093, 334095, 334097-334105, 334107-334111, 334113-334116, 334118-334123, 334125, 334128-334132, 334135, 334140-334147, 334149-334150, 334152-334153, 334158-334160, 334162, 334164, 334166, 334172-334178, 334181, 334183-334190, 334192, 334197-334198, 334200-334203, 334205-334206, 334208-334213, 334215-334226, 334228-334235, 334237-334240, 334246-334249, 334251-334253, 334256-334260, 334265-334267, 334269-334270, 334272, 334274, 334276-334277, 334279-334284, 334286, 334288-334299, 334301-334305, 334307, 334311-334315, 334319-334320, 334322, 334325, 334329-334332, 334334-334335, 334338-334342, 334344, 334348-334349, 334351, 334355, 334360, 334362, 334364, 334367-334368, 334370-334371, 334373-334376, 334378-334388, 334390, 334396, 334400, 334402, 334404, 334406, 334408-334415, 334420-334424, 334431-334433, 334435, 334439-334441, 334448, 334450-334451, 334456, 334458, 334462-334463, 334466, 334468-334471, 334473, 334475-334476, 334478-334481, 334486-334489, 334493-334495, 334497-334506, 334508-334509, 334511, 334515, 334517, 334519-334523, 334525, 334529, 334533-334536, 334538-334540, 334544, 334546-334551, 334555-334556, 334559-334561, 334566-334569, 334571-334574, 334581-334583, 334586-334589, 334592-334604, 334606-334607, 334613-334614, 334616-334618, 334623, 334626, 334630, 334632-334635, 334637, 334639, 334641-334643, 334645, 334647, 334649-334656, 334660, 334664-334665, 334667-334673, 334677-334684, 334687-334689, 334691-334695, 334697-334698, 334700-334701, 334703-334705, 334710, 334714-334715, 334717, 334720-334723, 334725-334736, 334738, 334740-334741, 334745-334746, 334748, 334751-334752, 334755, 334757-334759, 334762, 334764-334765, 334770, 334772, 334774, 334776, 334782-334783, 334786-334788, 334790, 334794, 334796-334799, 334802-334814, 334816, 334819-334822, 334826-334828, 334831-334832, 334834-334836, 334839, 334841, 334845, 334847-334850, 334856-334858, 334864-334866, 334869, 334871-334875, 334877-334886, 334888-334890, 334893-334900, 334902-334908, 334910, 334913, 334915-334918, 334921-334923, 334927, 334929, 334933-334938, 334940, 334942-334943, 334946-334948, 334950-334952, 334955, 334957, 334959-334961, 334963-334965, 334969-334973, 334975, 334977-334979, 334981-334992, 334994-334998, 335000-335001, 335003-335016, 335018, 335020, 335023-335025, 335027-335035, 335037, 335039-335040, 335042-335047, 335049-335051, 335054-335057, 335061-335063, 335066-335067, 335069-335070, 335072-335076, 335078, 335081-335082, 335084-335087, 335090, 335092-335094, 335096, 335098-335103, 335105-335111, 335114-335115, 335119-335120, 335122, 335127-335137, 335139-335144, 335146, 335148, 335150-335151, 335155-335159, 335161-335164, 335166-335169, 335172-335173, 335175-335180, 335183-335184, 335187, 335189-335191, 335194-335201, 335203-335204, 335207-335210, 335212, 335214, 335217, 335219-335220, 335223-335224, 335228-335232, 335234, 335236-335238, 335240-335241, 335243-335251, 335253-335256, 335258, 335260-335261, 335263-335264, 335267-335269, 335271-335277, 335281-335282, 335284-335286, 335288-335289, 335293-335294, 335296, 335298-335299, 335302-335303, 335305-335307, 335309-335314, 335316-335319, 335321, 335325-335328, 335330, 335332, 335335, 335337-335340, 335345, 335347-335349, 335351-335353, 335356-335360, 335362-335364, 335366-335367, 335369-335371, 335373-335377, 335379-335381, 335383-335385, 335387-335388, 335392-335393, 335396, 335398-335400, 335402-335407, 335409-335414, 335416, 335418-335422, 335426, 335430-335431, 335433, 335436-335439, 335441, 335443-335444, 335446, 335449-335461, 335464-335468, 335470, 335472-335476, 335478-335480, 335482, 335486, 335488-335489, 335491-335492, 335495-335496, 335499-335508, 335512, 335514-335516, 335520-335521, 335523, 335526-335530, 335533, 335535-335539, 335541, 335543-335546, 335550-335557, 335559, 335566-335574, 335576-335584, 335586, 335588, 335591, 335593-335594, 335596-335599, 335601-335605, 335607-335608, 335614-335627, 335629-335634, 335636-335638, 335641-335647, 335653, 335655-335663, 335667, 335671, 335673-335687, 335689-335690, 335692-335694, 335696-335698, 335702-335703, 335705-335707, 335709-335712, 335715, 335717-335718, 335726, 335730-335732, 335735, 335737-335739, 335741-335743, 335745-335751, 335753-335762, 335764, 335767, 335769-335775, 335778, 335780-335784, 335786-335789, 335791-335793, 335797-335799, 335801-335802, 335804-335807, 335809, 335811-335813, 335815, 335817, 335819, 335822-335827, 335829-335834, 335837-335840, 335842-335845, 335847-335852, 335855-335857, 335859, 335862-335865, 335867, 335870-335872, 335874-335876, 335881-335884, 335886-335887, 335889-335890, 335892, 335894-335898, 335900, 335902-335905, 335908-335917, 335919-335921, 335924, 335926-335929, 335931, 335934, 335939-335940, 335943, 335945-335947, 335949, 335951-335952, 335954-335955, 335957-335958, 335960-335961, 335965-335968, 335973-335974, 335976-335983, 335986, 335988, 335991-335992, 335994-335996, 335998-336010, 336013-336020, 336022-336029, 336031-336034, 336038-336039, 336041-336044, 336048-336054, 336058-336059, 336061, 336064, 336066, 336068-336072, 336074-336075, 336077-336079, 336081-336082, 336084-336092, 336094-336096, 336098-336100, 336103-336105, 336107-336118, 336120-336123, 336125-336126, 336129-336130, 336133-336146, 336148-336149, 336151-336152, 336154-336159, 336161, 336163, 336167-336176, 336179-336186, 336188-336190, 336192, 336194, 336196-336197, 336199-336203, 336205-336212, 336214-336217, 336219, 336223, 336225, 336227, 336229-336233, 336235-336236, 336238-336247, 336250-336256, 336258-336260, 336262-336264, 336266, 336268, 336270-336276, 336278-336281, 336285-336289, 336291, 336294, 336297, 336300, 336302-336305, 336310-336311, 336313-336314, 336317, 336320-336322, 336326-336327, 336329, 336331, 336333, 336335-336337, 336343, 336345-336347, 336349-336353, 336355-336356, 336360, 336362-336363, 336365, 336367-336371, 336374-336375, 336377-336378, 336381-336384, 336387-336390, 336392, 336394-336395, 336397-336403, 336405-336412, 336414-336415, 336417-336420, 336426, 336428-336429, 336431-336433, 336435-336436, 336441-336442, 336444, 336446-336452, 336455-336458, 336460-336462, 336465-336473, 336475, 336478-336484, 336486-336489, 336491-336492, 336496, 336498, 336501-336503, 336506-336507, 336509-336510, 336512-336517, 336519-336520, 336524-336526, 336528-336529, 336536-336545, 336548-336549, 336554, 336556-336561, 336563, 336566, 336572-336575, 336580-336581, 336583, 336585, 336587, 336589-336595, 336597-336599, 336608, 336610-336611, 336613, 336616, 336618, 336621-336624, 336626-336632, 336634, 336636-336638, 336643, 336647-336648, 336651, 336653, 336655-336662, 336664-336665, 336667, 336669, 336671, 336675-336679, 336681-336688, 336690, 336693-336694, 336696-336699, 336701-336705, 336708-336709, 336711-336712, 336717-336720, 336722-336723, 336727-336729, 336731-336732, 336734-336735, 336737, 336739-336743, 336745, 336747-336751, 336754-336756, 336758, 336760-336763, 336768, 336771, 336775, 336789-336790, 336793-336794, 336796-336800, 336802, 336804, 336807-336809, 336811-336817, 336820-336824, 336827-336830, 336832, 336834-336836, 336838, 336840, 336846-336847, 336850, 336852-336853, 336856-336861, 336863-336875, 336879-336881, 336883-336886, 336888-336889, 336892-336894, 336896, 336900-336910, 336914-336915, 336918, 336920-336926, 336928, 336930-336931, 336933-336934, 336936-336938, 336940, 336942-336944, 336946-336947, 336950, 336955-336960, 336963-336966, 336968, 336970, 336973-336975, 336977-336981, 336983-336987, 336989, 336993, 336995, 336998-337000, 337002, 337004-337006, 337008, 337010-337012, 337014, 337016, 337020, 337022, 337026, 337028-337031, 337033, 337036, 337039-337041, 337045-337047, 337051-337052, 337054-337057, 337059-337062, 337064, 337066, 337069-337076, 337078-337079, 337081-337086, 337088-337090, 337094-337097, 337100-337102, 337104, 337106, 337108, 337110, 337114-337115, 337117-337121, 337125-337128, 337130-337132, 337136, 337140, 337142, 337144, 337155, 337158-337159, 337162-337163, 337166-337167, 337169-337171, 337173-337176, 337178-337179, 337181-337183, 337185-337187, 337190-337195, 337197-337202, 337205-337209, 337213-337221, 337223-337229, 337232, 337234, 337238-337240, 337245-337247, 337249-337250, 337252-337260, 337262-337263, 337265-337272, 337275-337276, 337280-337282, 337284-337290, 337292-337293, 337296, 337298-337300, 337302-337304, 337306-337307, 337309-337310, 337314-337317, 337319-337324, 337326, 337328-337330, 337334, 337336, 337339-337340, 337342-337343, 337345-337348, 337350, 337352, 337354, 337356-337357, 337362, 337364-337365, 337367-337371, 337373-337380, 337382-337383, 337386-337387, 337390, 337392, 337394-337397, 337399-337402, 337404-337406, 337408, 337411-337421, 337424-337426, 337428, 337431-337432, 337434-337443, 337445-337452, 337454, 337456, 337458, 337460-337461, 337463-337469, 337471, 337473, 337475-337477, 337479-337484, 337489-337490, 337492, 337495-337496, 337498-337503, 337505, 337507-337509, 337512, 337518-337523, 337525-337531, 337533-337535, 337537-337540, 337542-337548, 337550-337553, 337557, 337559, 337562-337566, 337568-337573, 337575-337578, 337580-337583, 337586-337589, 337593, 337600-337603, 337605-337606, 337608-337616, 337618-337619, 337621-337623, 337630-337635, 337638, 337642-337643, 337645, 337647-337648, 337651-337664, 337669, 337671, 337675-337676, 337678-337680, 337682, 337684, 337692, 337694-337704, 337706, 337708, 337710-337712, 337714-337717, 337719, 337721-337729, 337731, 337734-337743, 337745-337746, 337752-337754, 337756-337757, 337760, 337762, 337766-337767, 337770-337772, 337774, 337776-337777, 337781-337787, 337790-337794, 337796-337798, 337800, 337802, 337804, 337806-337808, 337810, 337812-337817, 337819-337820, 337822, 337824-337825, 337827-337829, 337831, 337836, 337838-337840, 337842, 337844-337846, 337848-337854, 337857-337866, 337868-337869, 337871-337872, 337874, 337876-337877, 337879-337881, 337883-337887, 337889-337896, 337899-337903, 337908-337909, 337911, 337914-337917, 337919-337925, 337927, 337929-337931, 337933, 337935-337936, 337938-337941, 337943-337948, 337951, 337954-337958, 337960-337963, 337965-337966, 337970, 337972-337973, 337975-337977, 337979-337980, 337982-337984, 337986-337997, 337999, 338003-338005, 338007-338010, 338016-338017, 338019-338026, 338029, 338031, 338033-338034, 338036-338040, 338042-338043, 338045-338046, 338049, 338055, 338057, 338059-338061, 338064, 338070-338071, 338073-338076, 338079-338081, 338083-338085, 338089-338098, 338100, 338103, 338106, 338109-338112, 338114-338115, 338117-338118, 338120-338121, 338123, 338126-338127, 338129-338140, 338142-338145, 338147, 338150, 338152-338154, 338156, 338159, 338162-338167, 338169, 338171, 338173-338175, 338177, 338180, 338189-338190, 338193, 338196-338198, 338200, 338203-338204, 338212, 338215, 338217, 338220-338221, 338224, 338229, 338235-338240, 338242, 338244, 338247-338249, 338251, 338254, 338259, 338263, 338265-338266, 338272, 338276-338277, 338279, 338281-338284, 338288, 338290, 338294-338295, 338298-338300, 338302-338306, 338308, 338311-338313, 338315, 338317-338323, 338325, 338327-338329, 338332-338339, 338341-338343, 338346-338349, 338351-338353, 338356-338358, 338360, 338362-338374, 338377-338379, 338381-338386, 338388-338390, 338393-338396, 338398-338401, 338403, 338405-338406, 338408-338411, 338413, 338415-338416, 338418, 338420-338422, 338426-338429, 338431-338437, 338442-338443, 338446-338447, 338449-338450, 338452-338453, 338455, 338461, 338463, 338465-338469, 338471-338472, 338475-338482, 338484-338491, 338498-338499, 338502-338504, 338506-338507, 338509-338511, 338513-338516, 338519, 338522, 338525, 338527-338531, 338533-338546, 338550-338551, 338553-338555, 338557-338559, 338561-338562, 338566-338577, 338579-338581, 338583, 338585-338589, 338591-338593, 338595, 338597-338599, 338601-338610, 338612-338615, 338618, 338621-338622, 338624-338637, 338639-338641, 338644-338649, 338651-338661, 338665-338666, 338668-338669, 338671-338674, 338676-338679, 338681-338682, 338686-338691, 338693, 338695-338699, 338701, 338704-338710, 338712, 338714, 338716, 338720, 338724, 338726-338731, 338734-338737, 338740, 338742-338746, 338748, 338750-338752, 338754-338760, 338762-338763, 338766, 338768-338769, 338771, 338773-338780, 338782, 338784-338786, 338788, 338790, 338794, 338796-338797, 338799-338801, 338803-338813, 338815-338816, 338819-338821, 338827-338830, 338832, 338838-338839, 338842-338847, 338849-338853, 338855, 338858, 338861, 338863, 338867, 338869-338873, 338876, 338878-338879, 338882, 338884-338885, 338889-338890, 338892, 338894, 338896, 338898-338902, 338904-338905, 338907, 338909-338911, 338913-338919, 338922-338931, 338934, 338936, 338938-338945, 338947-338949, 338952-338953, 338955-338956, 338958, 338960-338963, 338966, 338968-338975, 338977, 338979-338980, 338983-338984, 338988-338990, 338992-338995, 339000-339003, 339005, 339007-339017, 339019-339020, 339024-339029, 339031, 339036-339039, 339042-339044, 339046-339048, 339051-339052, 339054-339056, 339058, 339060, 339063, 339065-339066, 339068, 339070, 339072-339073, 339075-339076, 339079, 339081-339090, 339092, 339094-339098, 339100, 339102, 339104, 339108-339110, 339112-339113, 339116-339118, 339121, 339123, 339126-339127, 339129, 339131, 339133, 339135-339136, 339139, 339141-339147, 339149-339150, 339153-339154, 339156, 339158, 339161, 339164-339167, 339170, 339173-339182, 339184, 339186, 339189-339193, 339195-339197, 339199, 339201, 339204, 339206, 339208-339209, 339211, 339213-339215, 339217, 339219-339221, 339224-339229, 339231, 339233-339241, 339243-339244, 339249-339254, 339256-339262, 339264, 339270-339272, 339275-339278, 339282-339283, 339285, 339287, 339290-339291, 339301-339305, 339307, 339311-339312, 339314, 339317-339327, 339329-339331, 339334-339335, 339337-339339, 339341-339343, 339345, 339347, 339350-339351, 339356-339357, 339359-339364, 339366-339369, 339371-339373, 339375, 339377-339378, 339380-339382, 339384-339407, 339411-339413, 339415, 339417-339437, 339441, 339444-339446, 339448-339451, 339453-339456, 339459, 339461, 339463, 339469-339470, 339472, 339474, 339476, 339478-339479, 339482-339489, 339491-339492, 339494-339496, 339500-339510, 339512, 339516, 339518-339524, 339527, 339529-339530, 339534, 339536, 339538-339543, 339546-339547, 339549-339550, 339552-339556, 339558, 339560, 339562-339568, 339570-339573, 339575-339579, 339581-339585, 339587-339592, 339594, 339596, 339598, 339601, 339605-339606, 339608-339609, 339611, 339613, 339615, 339617, 339619-339621, 339625-339629, 339631-339634, 339636-339647, 339649, 339651, 339653-339655, 339657-339663, 339667-339669, 339671-339682, 339684-339689, 339691-339692, 339695-339699, 339701, 339704-339707, 339714-339715, 339717, 339719-339720, 339731, 339734-339741, 339744, 339748, 339750, 339752-339760, 339762-339765, 339769-339770, 339772, 339776-339786, 339788, 339792-339798, 339800-339801, 339803-339804, 339807-339809, 339812-339815, 339818, 339822, 339824-339826, 339829-339834, 339839, 339841-339844, 339846-339847, 339850, 339854, 339856-339859, 339861-339863, 339867, 339871, 339873-339874, 339876, 339882-339886, 339888-339890, 339892-339893, 339897-339904, 339906-339908, 339913-339917, 339919-339921, 339923-339928, 339930, 339933, 339935, 339938, 339944, 339947-339948, 339951-339952, 339955, 339957, 339959-339962, 339964, 339966-339968, 339970-339972, 339974-339978, 339980, 339984, 339987, 339990-339992, 339995, 339997, 339999-340008, 340010-340011, 340013-340014, 340016-340018, 340022-340023, 340027, 340031-340041, 340044, 340046, 340048-340054, 340056-340058, 340061-340062, 340064-340070, 340073, 340075, 340080-340081, 340083-340091, 340093-340094, 340096, 340098, 340100-340103, 340106-340108, 340110, 340113, 340115, 340118-340119, 340121-340122, 340125-340126, 340136-340138, 340140-340142, 340147, 340149, 340151, 340159-340160, 340162, 340164-340165, 340167-340169, 340171, 340174, 340177-340180, 340186-340187, 340193-340194, 340199, 340201, 340203, 340206-340209, 340213-340215, 340217-340219, 340222, 340225, 340227, 340231, 340234, 340236-340238, 340240, 340243, 340245-340246, 340248, 340255, 340257, 340259, 340262, 340264, 340268-340269, 340271-340272, 340275-340276, 340278-340283, 340286-340287, 340290-340293, 340295-340296, 340298, 340305, 340307-340315, 340317, 340319-340320, 340322, 340324, 340326-340337, 340340-340344, 340346-340348, 340350, 340352, 340354, 340357, 340362-340365, 340368, 340370-340378, 340380, 340382-340384, 340386-340390, 340393, 340395-340396, 340398-340406, 340410, 340412-340418, 340422-340430, 340432-340438, 340440, 340446-340447, 340449, 340453, 340455-340456, 340458, 340462-340463, 340465-340467, 340471-340474, 340476-340480, 340482-340490, 340494-340498, 340501, 340503-340506, 340509-340510, 340512-340519, 340522-340524, 340526-340528, 340530-340532, 340534-340537, 340539-340543, 340545, 340547, 340549, 340551-340558, 340561, 340564, 340566-340571, 340574, 340577-340578, 340580-340581, 340585-340587, 340589, 340591, 340593, 340596-340602, 340604, 340609-340610, 340612, 340614-340622, 340625-340631, 340634-340635, 340638, 340640-340642, 340645-340651, 340653-340655, 340657, 340660-340662, 340667-340668, 340674-340681, 340683-340693, 340695-340705, 340707, 340709-340711, 340716-340717, 340719-340722, 340726-340732, 340734, 340736-340739, 340741, 340747-340752, 340757, 340759-340764, 340767, 340769, 340771, 340774-340777, 340782, 340785-340788, 340790-340791, 340799-340804, 340806, 340809, 340811-340813, 340815, 340817-340818, 340822, 340828, 340830-340834, 340837-340838, 340842, 340848-340853, 340855, 340864, 340867, 340870-340872, 340874, 340878-340879, 340882-340884, 340888-340889, 340891, 340893, 340898, 340900-340901, 340903, 340905-340912, 340914-340917, 340920-340923, 340925-340930, 340933-340935, 340937-340938, 340940-340941, 340943-340945, 340947, 340949, 340955-340957, 340959, 340961-340964, 340966, 340968, 340970, 340973-340974, 340976-340977, 340981-340990, 340993-340996, 341004-341005, 341007-341009, 341012-341014, 341016, 341018, 341020-341021, 341023-341026, 341029-341030, 341035-341037, 341040-341043, 341048, 341050-341054, 341056-341057, 341059-341060, 341064-341065, 341067-341069, 341072-341074, 341079-341082, 341084-341087, 341089, 341092-341097, 341101-341103, 341105-341107, 341109-341112, 341114, 341116-341117, 341119-341128, 341130, 341132-341135, 341138, 341140, 341142-341144, 341146, 341148-341150, 341153, 341159, 341164-341169, 341173-341179, 341181-341185, 341188-341189, 341191-341198, 341200-341208, 341212-341214, 341216, 341220, 341222-341224, 341226-341227, 341229, 341231-341232, 341235, 341237-341241, 341243-341248, 341250-341251, 341254-341255, 341257-341262, 341264, 341266-341272, 341275, 341277-341281, 341284-341287, 341292-341296, 341298-341300, 341302, 341304, 341307-341308, 341311-341312, 341314-341317, 341319, 341321, 341323-341327, 341329, 341331-341332, 341334-341340, 341343-341346, 341348-341350, 341352-341358, 341360-341362, 341364-341366, 341368-341369, 341371, 341374-341380, 341382, 341384-341385, 341387-341394, 341399-341401, 341403, 341405-341406, 341409, 341411-341414, 341416-341417, 341420, 341423-341425, 341427-341431, 341433-341439, 341441-341446, 341449-341450, 341458-341460, 341462-341466, 341470, 341473-341489, 341491-341493, 341495-341496, 341504, 341506, 341509-341512, 341515, 341520, 341523-341526, 341529, 341533, 341535-341537, 341542-341543, 341549-341552, 341554-341555, 341557-341569, 341572-341573, 341575, 341579, 341581, 341585-341586, 341590, 341593, 341595-341608, 341610-341611, 341614-341616, 341618, 341621, 341625-341628, 341630-341642, 341644, 341646-341651, 341656-341657, 341660-341664, 341666-341671, 341673, 341675-341676, 341678-341683, 341685, 341687-341688, 341690-341703, 341706-341712, 341715, 341717-341718, 341720-341722, 341724-341739, 341741-341745, 341747-341751, 341755-341760, 341762-341763, 341765, 341767-341769, 341771, 341773-341774, 341776, 341778, 341781-341783, 341790-341791, 341793, 341797-341802, 341804, 341806, 341812-341813, 341815-341816, 341818-341826, 341828-341838, 341840-341841, 341843-341844, 341846-341850, 341853, 341855-341859, 341861, 341863-341864, 341866-341875, 341877, 341879-341881, 341883-341884, 341895, 341899-341901, 341903-341906, 341908, 341910-341911, 341913, 341916, 341918-341920, 341922, 341924-341926, 341929-341932, 341934-341936, 341938-341947, 341949-341950, 341953, 341956-341958, 341961, 341963-341967, 341969-341971, 341973-341974, 341976-341979, 341983-341984, 341986-

341989, 341993, 341995, 341999-342001, 342003-342016,
342018, 342021, 342023, 342025, 342028-342029, 342031-
342036, 342038-342039, 342042, 342045-342049, 342051-
342052, 342054-342055, 342057-342058, 342060-342068,
342070-342083, 342085, 342087-342090, 342094-342103,
342105-342106, 342108-342113, 342116, 342118, 342122-
342123, 342125, 342127-342130, 342134-342137, 342139-
342141, 342144-342149, 342154-342159, 342161, 342163,
342166, 342168-342171, 342173, 342175, 342178-342179,
342181-342183, 342186-342188, 342190, 342192-342195,
342198-342201, 342203, 342205, 342211-342213, 342215,
342217, 342219, 342221-342222, 342224-342229, 342231-
342232, 342234, 342237-342238, 342240-342241, 342246,
342250-342251, 342253-342257, 342259, 342261, 342263,
342266-342268, 342270-342272, 342275-342280, 342284-
342285, 342288-342290, 342294, 342297-342300, 342302,
342308, 342312, 342314-342317, 342319, 342324-342328,
342330, 342332-342333, 342336, 342338-342339, 342343-
342344, 342349-342354, 342356-342363, 342365-342372,
342375-342376, 342379-342380, 342383-342386, 342389-
342393, 342395, 342397-342400, 342402-342405, 342407,
342409-342410, 342412-342413, 342421-342423, 342426,
342429, 342436, 342442-342443, 342446, 342450-342451,
342454-342458, 342460-342466, 342468-342476, 342481-
342482, 342484, 342486, 342490, 342498-342499, 342501-
342503, 342506, 342508-342509, 342511-342512, 342514-
342515, 342517, 342519-342521, 342523-342527, 342529-
342534, 342539-342541, 342543-342544, 342546-342547,
342549-342550, 342552-342555, 342557, 342559-342563,
342566-342567, 342569, 342571-342575, 342580, 342582,
342584-342587, 342590, 342592, 342596, 342598, 342600,
342602, 342604-342605, 342607, 342609-342610, 342613-
342615, 342618-342620, 342623-342624, 342626-342629,
342632, 342641, 342644-342646, 342648-342653, 342655-
342661, 342663, 342665-342667, 342669-342670, 342672-
342673, 342675, 342677, 342679-342683, 342685-342687,
342690, 342692-342710, 342714-342715, 342717-342718,
342720-342722, 342724-342731, 342733-342737, 342739-
342740, 342742-342743, 342745-342746, 342750-342752,
342754-342755, 342759-342760, 342763-342764, 342766,
342771, 342773-342777, 342779, 342781, 342783, 342785-
342788, 342790-342795, 342797, 342799-342801, 342803-
342811, 342813, 342816-342821, 342823-342828, 342832-
342837, 342840-342846, 342849-342850, 342852-342857,
342859, 342862-342872, 342874-342875, 342878-342889,
342891-342893, 342896, 342899-342902, 342904, 342908-
342909, 342911-342912, 342915, 342917-342923, 342925-
342926, 342929-342935, 342937-342944, 342946-342951,
342953-342957, 342960-342966, 342968-342977, 342979-
342982, 342984, 342987-342990, 342992, 342995-343000,
343004-343005, 343007, 343011-343013, 343015-343025,
343029, 343031-343032, 343034, 343036-343042, 343044,
343049-343051, 343054, 343062, 343064, 343067-343076,
343078-343084, 343086-343092, 343095-343099, 343101,
343103-343109, 343112, 343114, 343118-343122, 343129,
343131, 343133, 343136, 343140-343142, 343144-343146,
343150-343151, 343154, 343159-343160, 343162-343163,
343169-343170, 343172, 343176-343178, 343181-343182,
343184-343185, 343189, 343192-343195, 343199-343201,
343203, 343205-343206, 343209, 343211, 343213, 343215,
343217, 343219, 343222-343226, 343228-343236, 343239-
343241, 343244-343245, 343247, 343249, 343251-343258,
343260-343262, 343265, 343269, 343271, 343273, 343275,
343277-343281, 343283-343284, 343286-343288, 343293-
343295, 343297-343300, 343303, 343305-343306, 343308,
343310-343311, 343314, 343316-343317, 343320-343323,
343325-343329, 343331, 343333, 343335-343336, 343338-
343339, 343341, 343343-343347, 343349, 343351, 343353,
343357, 343359, 343361-343364, 343367-343368, 343370,
343372, 343374, 343376-343379, 343381-343385, 343387,
343389-343394, 343396, 343400-343409, 343413, 343415-
343416, 343418-343423, 343428-343436, 343442-343445,
343447, 343449, 343451-343452, 343454-343455, 343457,
343459, 343461-343462, 343464-343466, 343468, 343470,
343473-343474, 343476-343477, 343480, 343482, 343484,
343487-343492, 343494-343495, 343497-343500, 343502-
343505, 343507-343511, 343513-343514, 343520, 343525,
343529, 343531-343536, 343540, 343542-343544, 343546-
343547, 343549-343550, 343553, 343555, 343558-343568,
343570-343580, 343583-343587, 343589, 343591, 343593,
343595-343596, 343602-343603, 343606, 343608-343611,
343613-343614, 343616-343617, 343619, 343621-343627,
343629-343632, 343634, 343636-343642, 343645, 343647,
343649-343654, 343656-343663, 343666-343668, 343670-
343671, 343673-343674, 343676-343678, 343682-343688,
343691, 343695-343696, 343698, 343700-343701, 343703-
343706, 343708-343716, 343718-343723, 343725-343727,
343730, 343734-343738, 343740-343744, 343746-343747,
343749-343751, 343753-343755, 343761-343768, 343770-
343776, 343778-343780, 343782, 343784-343785, 343787-
343790, 343792-343798, 343802-343806, 343809-343814,
343816-343817, 343819, 343823, 343825-343826, 343828,
343830, 343832, 343834-343835, 343837, 343839-343841,
343843, 343846-343848, 343850-343853, 343855-343858,
343860-343863, 343866-343870, 343872, 343874-343877,
343880, 343882, 343887, 343889-343891, 343894-343895,
343897-343898, 343900-343902, 343904-343905, 343911-
343912, 343914-343916, 343919, 343921-343922, 343940,
343942, 343944-343945, 343947, 343951, 343953-343962,
343965, 343967-343969, 343974-343978, 343980-343987,
343989, 343994, 343996-343998, 344000-344005, 344008-
344009, 344012-344013, 344023-344027, 344029-344032,
344034-344037, 344039, 344042, 344044, 344046, 344050-
344051, 344053, 344055-344057, 344059, 344062, 344064,
344066-344068, 344071-344076, 344079-344080, 344084-
344088, 344090-344093, 344095, 344097, 344099-344101,
344105-344108, 344111, 344113-344118, 344120-344122,
344124, 344126-344128, 344130-344134, 344136, 344139-
344143, 344146-344149, 344152-344156, 344158-344163,
344166-344167, 344169, 344171, 344174, 344176-344180,
344183-344184, 344191-344195, 344198-344205, 344207-
344208, 344213-344220, 344222-344225, 344228-344229,
344231, 344234-344236, 344238, 344240-344241, 344243,
344245-344246, 344248-344252, 344257, 344261-344266,
344268-344269, 344271, 344273-344280, 344283-344284,
344286-344291, 344293-344294, 344296, 344298, 344301-
344305, 344307, 344309, 344311, 344314-344315, 344319-
344329, 344331-344337, 344340-344345, 344347, 344349-
344350, 344352, 344354, 344358-344362, 344364-344370,
344372-344375, 344378, 344384-344386, 344388-344389,
344391, 344395-344396, 344398-344409, 344411, 344413-
344415, 344417, 344419, 344421-344423, 344425, 344427,
344429-344430, 344433, 344435-344440, 344442-344444,
344447-344448, 344452-344458, 344460-344461, 344463-
344465, 344467, 344469, 344475-344484, 344490-344493,
344495-344497, 344501, 344503-344506, 344509-344517,
344519-344530, 344532-344533, 344535-344538, 344541-
344553, 344555-344559, 344561-344564, 344566-344567,
344570, 344572-344573, 344575, 344577, 344579-344580,
344582-344597, 344599-344602, 344606, 344608-344609,
344616, 344618-344622, 344626-344634, 344636, 344638-
344640, 344642-344646, 344648-344652, 344654-344655,
344657-344658, 344662, 344665-344669, 344671-344675,
344677-344679, 344681, 344684-344686, 344688-344690, 344692-344693, 344695-344699, 344703, 344705-344707, 344715-344721, 344724-344726, 344729-344734, 344736-344740, 344742, 344745-344746, 344748-344759, 344761, 344764-344765, 344767-344768, 344770, 344772-344777, 344780, 344783, 344785-344786, 344792, 344794-344795, 344797-344802, 344804-344805, 344807-344809, 344811-344812, 344815, 344817, 344823-344824, 344826, 344828-344829, 344831, 344834, 344837, 344842-344845, 344847-344853, 344855-344862, 344865-344871, 344873, 344878-344879, 344883, 344885, 344887-344888, 344891, 344896-344898, 344901-344902, 344905-344907, 344909-344911, 344913, 344915-344918, 344920, 344923-344924, 344926, 344928, 344930-344931, 344934, 344937-344938, 344940, 344943, 344945-344948, 344950-344955, 344957, 344959-344963, 344965, 344967-344969, 344972-344974, 344976-344978, 344982-344985, 344988-344989, 344991-344992, 344994, 344996-344999, 345003-345007, 345009-345014, 345016-345024, 345026-345028, 345030-345032, 345034, 345036-345039, 345041-345044, 345048-345056, 345058-345060, 345062-345063, 345065-345069, 345072-345074, 345077-345078, 345082-345084, 345088-345091, 345093-345095, 345097-345100, 345104, 345106-345115, 345117-345118, 345120-345124, 345126-345128, 345130-345133, 345135-345136, 345138, 345141-345143, 345146-345151, 345153-345156, 345158-345164, 345166-345167, 345169-345170, 345172-345175, 345177-345180, 345182-345183, 345186-345188, 345190, 345192-345195, 345197-345205, 345207-345209, 345211-345214, 345216, 345218-345219, 345221-345232, 345234-345240, 345242-345243, 345245-345246, 345248-345250, 345252-345254, 345258-345259, 345261-345263, 345265, 345267-345268, 345271-345275, 345282, 345285-345289, 345292-345294, 345296, 345299, 345302-345308, 345312-345321, 345323-345324, 345327-345332, 345334, 345337-345338, 345340-345343, 345346-345347, 345351, 345353, 345356, 345359-345361, 345363-345364, 345366, 345369, 345372-345374, 345377-345381, 345383-345387, 345389, 345391, 345396, 345398, 345401-345409, 345411, 345413-345414, 345416-345417, 345420-345423, 345426-345433, 345435-345436, 345438-345446, 345448-345452, 345454-345455, 345457-345460, 345462-345465, 345467, 345469-345471, 345473, 345475-345477, 345480-345487, 345490, 345492, 345496, 345499, 345501-345503, 345506-345513, 345515-345519, 345523-345524, 345526-345527, 345533-345534, 345536, 345540, 345543, 345554, 345558-345560, 345564-345567, 345569-345570, 345572, 345574, 345576, 345578-345583, 345585-345586, 345590-345591, 345594, 345596, 345598, 345600, 345602-345603, 345605, 345610-345611, 345614, 345617, 345624-345628, 345631-345634, 345638, 345640-345643, 345646, 345648-345654, 345657-345663, 345665, 345667-345669, 345673-345674, 345676-345678, 345681-345682, 345684-345692, 345698-345699, 345701-345704, 345707-345711, 345713, 345715-345720, 345722-345724, 345726-345729, 345731, 345734-345736, 345740, 345742, 345745-345749, 345752-345753, 345755-345756, 345758-345759, 345762, 345768-345769, 345772, 345776, 345785-345787, 345791, 345793, 345795-345796, 345798-345799, 345802-345803, 345805-345811, 345816, 345819-345828, 345832-345836, 345838, 345840, 345842, 345844, 345846-345847, 345850-345856, 345861-345867, 345869, 345872, 345875, 345877-345879, 345881, 345883-345884, 345886, 345888-345890, 345893, 345895-345898, 345908-345911, 345913-345917, 345919-345922, 345925, 345927, 345931-345935, 345937, 345941-345944, 345946-345947, 345952-345954, 345957-345958, 345961-345962, 345964-345968, 345970-345978, 345980, 345982-345985, 345987-345989, 345991-346002, 346004-346009, 346012, 346015, 346017, 346019-346021, 346024-346028, 346030-346036, 346039, 346042, 346044-346048, 346052, 346054-346055, 346057-346059, 346062-346064, 346066-346067, 346071-346072, 346074, 346081-346082, 346085, 346088-346089, 346091-346094, 346096, 346098, 346100-346103, 346105-346112, 346114-346118, 346121-346123, 346125, 346131-346144, 346146-346147, 346149-346155, 346158, 346161-346165, 346168-346170, 346172-346175, 346177, 346179-346184, 346186-346190, 346193-346195, 346199-346201, 346204, 346208, 346213, 346216-346219, 346221, 346223-346224, 346226-346228, 346230-346231, 346234-346249, 346251, 346254-346257, 346260-346265, 346268, 346270-346271, 346273-346274, 346276-346278, 346280, 346282-346287, 346289, 346291-346293, 346295, 346297, 346300-346302, 346304-346309, 346311-346318, 346325-346326, 346329-346330, 346332-346333, 346335-346337, 346339, 346341-346344, 346346-346351, 346356-346359, 346361-346363, 346365-346367, 346371-346373, 346377, 346381, 346385-346388, 346391-346392, 346395, 346397, 346402, 346408, 346412, 346414-346417, 346420, 346422-346425, 346432-346441, 346443-346447, 346449, 346451, 346453-346455, 346457, 346460, 346463-346469, 346471-346479, 346482-346487, 346489, 346491-346492, 346495, 346499-346511, 346513, 346515-346519, 346523-346528, 346534-346535, 346553-346555, 346557-346562, 346565-346569, 346571, 346573-346574, 346576-346589, 346594-346599, 346601-346607, 346609, 346611-346615, 346617-346618, 346620, 346622, 346628-346631, 346636, 346638-346640, 346642, 346644-346645, 346647-346649, 346651, 346654, 346656, 346659, 346662-346663, 346669, 346671-346675, 346677-346679, 346683-346686, 346688-346689, 346691, 346697-346699, 346703-346705, 346707-346709, 346712-346714, 346716-346718, 346722-346726, 346728, 346730-346733, 346735, 346739-346750, 346754-346755, 346762, 346765, 346767-346768, 346771, 346773, 346776, 346778, 346781, 346783-346787, 346789-346795, 346801-346803, 346806-346808, 346810-346812, 346814, 346816-346817, 346819, 346822-346826, 346828-346832, 346834-346837, 346840-346842, 346844-346846, 346848-346859, 346862-346863, 346865-346869, 346871-346872, 346874-346875, 346877, 346880-346881, 346884, 346889, 346892-346896, 346898-346901, 346903-346904, 346909-346910, 346912, 346914-346919, 346921, 346923, 346925-346926, 346933, 346939-346942, 346944-346949, 346952-346953, 346955, 346957, 346959, 346962, 346964-346966, 346969, 346972, 346975-346985, 346987-346988, 346991-346996, 346998, 347000-347001, 347003-347004, 347006-347011, 347013-347014, 347017, 347021-347023, 347025-347027, 347029-347032, 347034, 347037-347050, 347052-347055, 347059-347060, 347063-347068, 347071-347073, 347075-347078, 347080-347085, 347087, 347089-347090, 347092-347094, 347097, 347100-347103, 347106, 347108-347113, 347116, 347118, 347124, 347126, 347130, 347132-347134, 347136, 347138, 347141, 347143, 347146-347153, 347156, 347160-347162, 347164, 347166, 347170-347171, 347173-347174, 347177, 347182, 347186, 347190, 347192, 347194, 347196-347197, 347199-347201, 347204-347206, 347209-347210, 347212-347216, 347218, 347220-347227, 347231-347232, 347234-347244, 347246, 347248-347249, 347251-347256, 347258-347261, 347265, 347267-347273, 347276, 347278-347280, 347282-347285, 347290, 347293, 347295, 347297-347303, 347305-347307, 347310, 347313-347315, 347317-347320, 347322, 347325-347326, 347329, 347332-347335, 347338-347347, 347350-347351, 347353-347356, 347359-347372, 347374-347376, 347378-347380, 347383-347386, 347388-347394, 347396-347397, 347399-347400, 347402-347405, 347408-347411, 347418-347421, 347427-347431, 347434-

347436, 347438, 347444, 347447-347451, 347453, 347455, 347457-347461, 347464, 347466, 347468, 347470-347479, 347482-347487, 347489, 347491-347492, 347495-347496, 347499-347500, 347502, 347504, 347508, 347511-347515, 347517-347522, 347524, 347526, 347529-347530, 347532-347537, 347540-347544, 347546, 347550-347553, 347557, 347559-347563, 347568, 347570-347577, 347581, 347586, 347588, 347591, 347593-347595, 347597-347604, 347606, 347608-347615, 347617-347630, 347632, 347634, 347638-347640, 347646, 347650, 347652-347653, 347655, 347657-347659, 347662-347663, 347665-347667, 347675, 347677, 347680-347681, 347683-347684, 347686, 347688-347689, 347691-347692, 347695-347696, 347702-347707, 347710-347713, 347716-347720, 347722-347723, 347726-347734, 347736-347742, 347745-347746, 347748-347750, 347752, 347754, 347760-347761, 347763, 347766-347767, 347769-347772, 347774, 347776, 347778-347779, 347782-347785, 347787, 347789-347799, 347804-347805, 347807-347817, 347821-347826, 347829-347831, 347833-347836, 347838-347839, 347841-347844, 347846, 347848, 347850, 347852, 347854, 347856, 347858-347859, 347864, 347866-347871, 347873-347876, 347879, 347881-347882, 347885-347888, 347890-347891, 347894-347897, 347900, 347902, 347905-347906, 347908-347915, 347919, 347929, 347932, 347934, 347937-347940, 347943-347946, 347954, 347956-347958, 347963-347968, 347970-347971, 347976, 347979-347991, 347993-347994, 347997-348000, 348002, 348004-348007, 348009-348010, 348013-348016, 348018-348020, 348022, 348024-348028, 348030, 348032, 348035-348042, 348045-348046, 348048, 348050, 348052-348053, 348055-348056, 348059, 348061-348067, 348070-348071, 348073-348077, 348079, 348081-348084, 348087-348089, 348091, 348093-348095, 348097, 348099-348102, 348104-348105, 348108-348109, 348111, 348113-348115, 348117-348119, 348121, 348130-348135, 348137-348139, 348141-348147, 348152-348153, 348155, 348158-348164, 348166, 348170-348173, 348176, 348178-348182, 348184-348189, 348191-348194, 348198, 348201-348204, 348209, 348212, 348215-348217, 348219, 348222, 348224, 348226, 348228-348229, 348233, 348235-348236, 348238, 348244, 348246-348251, 348253-348255, 348257, 348263-348269, 348272, 348274, 348276-348277, 348279-348280, 348285-348287, 348290-348292, 348294-348300, 348302-348303, 348305, 348315-348316, 348319-348328, 348332, 348334, 348337, 348339-348343, 348345, 348348, 348350-348353, 348356-348363, 348365-348369, 348374, 348377-348378, 348381-348386, 348388-348392, 348394-348398, 348400, 348402-348404, 348406-348412, 348414, 348416-348417, 348420, 348424-348425, 348428, 348430, 348437, 348439, 348441-348449, 348453-348460, 348462, 348466-348467, 348469, 348471, 348475-348477, 348479, 348481-348483, 348485, 348487-348488, 348490-348491, 348494, 348496, 348498-348499, 348501, 348504, 348508, 348511-348514, 348516-348517, 348520-348521, 348523-348525, 348527-348531, 348533, 348535, 348537-348538, 348543, 348545-348552, 348554, 348557, 348563-348565, 348567, 348569, 348571-348573, 348577-348578, 348580-348581, 348584-348596, 348600-348606, 348609-348610, 348612, 348614-348615, 348617-348619, 348621-348622, 348624, 348627-348631, 348635-348639, 348641, 348644-348647, 348649, 348653-348656, 348660-348662, 348665, 348667, 348675, 348677, 348680-348683, 348685, 348693, 348695-348696, 348699-348703, 348705, 348709, 348715-348722, 348724, 348726-348728, 348732-348742, 348744, 348746, 348748-348750, 348752-348753, 348759, 348765-348769, 348773, 348775-348779, 348781-348782, 348784-348785, 348787, 348789-348790, 348792-348793, 348795-348797, 348799-348801, 348803-348807, 348809, 348811, 348814, 348817-348819, 348821, 348823-348825, 348827-348833, 348835, 348837-348845, 348847-348850, 348852, 348854-348856, 348858-348864, 348866-348869, 348871-348873, 348876-348880, 348882, 348885-348887, 348889-348890, 348896-348903, 348905, 348907, 348914-348915, 348917, 348919-348920, 348922, 348926, 348928, 348930-348931, 348934-348936, 348941, 348943, 348948-348955, 348960-348963, 348966-348970, 348972-348975, 348977-348978, 348980-348981, 348983-348986, 348988-348992, 348994, 348996, 348998-348999, 349002, 349004-349005, 349007-349009, 349013, 349017-349020, 349022, 349026-349027, 349029-349031, 349033-349038, 349040-349041, 349043-349046, 349051, 349053, 349062, 349065, 349072-349074, 349077, 349079, 349083-349084, 349086, 349088, 349090-349091, 349093-349094, 349099, 349102-349103, 349105, 349109-349113, 349117-349121, 349123-349124, 349126-349129, 349131-349132, 349135-349137, 349148-349161, 349164-349166, 349170, 349174-349178, 349180-349181, 349185-349187, 349189-349192, 349195, 349197, 349201, 349203, 349206, 349208, 349210-349214, 349216, 349218, 349220, 349222-349225, 349228-349236, 349239-349244, 349247-349248, 349250-349251, 349253-349258, 349260-349263, 349266, 349269, 349271, 349273, 349277-349281, 349285-349293, 349295, 349297, 349299-349303, 349307-349313, 349316-349317, 349319-349320, 349323-349325, 349327-349333, 349342, 349345-349364, 349366-349368, 349371, 349373-349374, 349377-349378, 349381-349385, 349387-349390, 349393, 349395, 349397, 349405, 349407-349411, 349413, 349415, 349417, 349419-349420, 349422-349423, 349429-349432, 349436-349441, 349443, 349446-349447, 349449, 349451, 349454-349458, 349460-349461, 349463, 349465, 349467-349473, 349475-349476, 349478-349479, 349481, 349483, 349485-349488, 349490-349491, 349493, 349496-349503, 349505, 349507, 349509, 349514-349515, 349520-349523, 349526-349527, 349530-349533, 349538-349540, 349542-349544, 349547-349548, 349550-349551, 349553-349556, 349558-349563, 349566, 349569, 349571-349573, 349577-349581, 349585, 349587-349597, 349599, 349602-349606, 349608, 349611, 349613, 349618-349620, 349622-349623, 349625, 349627-349628, 349630-349631, 349634-349636, 349638, 349641-349647, 349649, 349652, 349654-349656, 349658-349660, 349663, 349665, 349667-349670, 349672, 349675-349678, 349682, 349684-349685, 349689-349690, 349692-349694, 349696, 349698, 349701, 349703, 349705-349713, 349715-349716, 349718-349720, 349723-349734, 349738-349741, 349743, 349746, 349748, 349751-349756, 349758, 349762, 349765, 349768, 349773-349774, 349776-349778, 349780-349781, 349784, 349787, 349789, 349791-349793, 349795-349800, 349802, 349804-349808, 349810, 349813, 349816, 349820-349823, 349828, 349832-349834, 349837-349840, 349842, 349844, 349846, 349848, 349850, 349853-349854, 349857-349859, 349862, 349864-349865, 349867-349868, 349871-349874, 349877-349881, 349883, 349886-349888, 349891, 349893-349900, 349902-349906, 349908-349909, 349913, 349915, 349917-349919, 349921-349923, 349925-349926, 349928, 349931, 349936-349937, 349941, 349943-349948, 349950-349956, 349958-349960, 349962, 349965-349966, 349968-349969, 349971, 349974-349975, 349977, 349981, 349984, 349986, 349989, 349991, 349994-350000, 350002, 350004-350009, 350014-350016, 350018, 350021, 350023, 350025, 350027-350030, 350032-350034, 350036-350037, 350040, 350044, 350046, 350050-350052, 350054, 350058-350059, 350064, 350069, 350071-350074, 350076, 350078, 350081-350086, 350089-350094, 350098, 350103-350108, 350110, 350112, 350114-350118, 350122-350123, 350125, 350127, 350129-350130, 350132, 350143, 350147-350150, 350152-350154, 350156-350158, 350160-350161, 350165, 350167-350168, 350173, 350176-350177, 350179, 350181-350182, 350186, 350188-350209, 350212-350219, 350221, 350223-350224, 350227-350228, 350231-350233, 350235-350237, 350239-350241, 350243-350246, 350248-350252, 350254-350257, 350259-350260, 350262-350264, 350266-350267, 350269, 350271-350273, 350275-350278, 350280-350283, 350286-350287, 350290-350291, 350293-350294, 350297-350299, 350302, 350304-350307, 350309-350310, 350312-350317, 350319, 350321-350323, 350328-350330, 350332, 350335-350342, 350345, 350347-350349, 350351, 350353, 350357, 350360, 350363, 350365-350367, 350369-350370, 350372-350373, 350375, 350377-350380, 350384-350392, 350394-350396, 350399-350402, 350404-350405, 350408, 350410, 350412-350415, 350417-350427, 350429-350430, 350435-350436, 350438-350439, 350441-350442, 350445, 350447-350453, 350455-350456, 350459, 350462-350463, 350465-350473, 350476-350477, 350481-350483, 350486-350489, 350492, 350495-350497, 350500-350507, 350512-350513, 350515-350524, 350526-350531, 350533-350535, 350537, 350540, 350544-350545, 350552-350555, 350558-350561, 350568, 350570-350574, 350576-350577, 350579-350580, 350584-350585, 350588, 350591, 350593-350595, 350597-350600, 350603-350607, 350609-350611, 350615, 350617, 350619-350620, 350622, 350626, 350628-350631, 350633-350645, 350649, 350652, 350654, 350664-350665, 350667, 350669-350676, 350679-350680, 350685, 350687-350689, 350691-350692, 350696-350700, 350702, 350707-350712, 350716-350717, 350719-350720, 350722-350725, 350727-350728, 350730-350731, 350733-350734, 350737-350742, 350744-350745, 350748-350751, 350753, 350755-350764, 350769, 350772, 350774, 350776, 350778-350779, 350781, 350783-350785, 350787-350792, 350799-350813, 350816, 350818-350826, 350828-350830, 350833-350835, 350837-350838, 350840-350842, 350844-350846, 350848, 350851-350852, 350854-350856, 350861-350863, 350865-350866, 350868-350870, 350873-350876, 350878-350880, 350882-350886, 350889-350890, 350896-350897, 350899-350904, 350909-350910, 350914-350915, 350917-350918, 350921-350922, 350924, 350926-350928, 350930, 350932-350933, 350936, 350938-350952, 350954, 350956-350957, 350962-350964, 350967-350974, 350976, 350978-350980, 350982, 350984-350987, 350989-350993, 350995, 350997-351007, 351009, 351012-351021, 351025-351036, 351038-351042, 351044, 351047-351048, 351051-351056, 351058-351065, 351067, 351069, 351073, 351075-351078, 351080-351081, 351083-351085, 351088-351091, 351094-351095, 351098-351105, 351109-351113, 351115, 351121, 351124-351128, 351130, 351132, 351134-351135, 351137-351143, 351147-351148, 351150-351156, 351158, 351161-351165, 351167-351168, 351171-351175, 351178-351179, 351181-351182, 351185-351194, 351198-351200, 351202-351206, 351208-351209, 351211-351217, 351219-351222, 351224, 351226-351236, 351238-351257, 351260-351261, 351263-351270, 351272-351273, 351277, 351280, 351282, 351285, 351288-351290, 351292-351294, 351297, 351300, 351302-351307, 351310-351313, 351315-351316, 351318-351324, 351327, 351329-351334, 351336, 351338-351342, 351345, 351347-351349, 351351-351356, 351358, 351361-351362, 351365, 351367-351370, 351375, 351377, 351381-351387, 351391, 351393, 351395, 351397-351398, 351400-351407, 351411, 351413-351419, 351425-351427, 351430, 351433-351437, 351439-351440, 351443-351446, 351449-351450, 351452-351456, 351460-351468, 351470, 351472-351474, 351476-351481, 351483-351489, 351491-351499, 351501, 351504-351515, 351518-351522, 351525-351526, 351528, 351531-351533, 351535-351542, 351545-351547, 351550-351553, 351555-351564, 351566, 351568-351576, 351578-351579, 351582-351583, 351585, 351587-351589, 351591, 351593-351604, 351606-351608, 351611, 351613, 351615-351617, 351619-351624, 351627-351628, 351630-351631, 351633, 351635-351637, 351639-351640, 351642, 351646, 351649-351653, 351655, 351658-351660, 351662-351664, 351667-351672, 351675-351677, 351679-351681, 351683-351684, 351686-351707, 351709, 351711-351714, 351717-351718, 351721-351724, 351726, 351729, 351733-351734, 351736-351738, 351740-351744, 351752-351757, 351760-351767, 351771-351772, 351775, 351777, 351779-351781, 351783, 351786-351788, 351790-351791, 351793, 351797, 351799-351800, 351802, 351804, 351806, 351808-351809, 351811-351812, 351814, 351818-351820, 351828-351833, 351835, 351837, 351839, 351842-351845, 351847-351848, 351850-351851, 351856-351862, 351864-351865, 351867-351868, 351870-351878, 351880-351882, 351884-351885, 351887-351890, 351892-351894, 351896-351901, 351903, 351908, 351911-351914, 351916, 351918-351920, 351922, 351924-351939, 351941-351942, 351944-351947, 351950-351952, 351954, 351956-351961, 351963, 351968-351970, 351972-351973, 351977-351981, 351983-351984, 351987-351988, 351990-352000, 352003, 352006-352007, 352009, 352011-352012, 352014-352015, 352020, 352024-352025, 352028, 352030-352031, 352033-352034, 352036, 352038, 352040, 352043-352047, 352050, 352052, 352054, 352056-352059, 352062, 352064-352070, 352073-352074, 352076, 352078, 352080-352081, 352083-352084, 352086, 352089-352097, 352099, 352102-352103, 352105-352106, 352109-352116, 352118-352128, 352130-352131, 352137-352138, 352140-352141, 352143-352144, 352148-352150, 352153, 352155, 352157, 352159-352161, 352163, 352165-352168, 352170, 352173, 352175, 352178, 352181-352182, 352185, 352187-352197, 352199-352204, 352206-352208, 352210-352215, 352217-352219, 352221-352240, 352243-352251, 352253-352255, 352257-352263, 352265-352269, 352271-352273, 352275-352277, 352279-352280, 352282-352289, 352296-352299, 352301-352305, 352309-352312, 352314-352319, 352322, 352324-352328, 352331, 352333-352334, 352336-352347, 352355-352356, 352358, 352362-352365, 352371-352374, 352376, 352383, 352385, 352387, 352392-352395, 352398-352399, 352401, 352403-352405, 352408-352409, 352413-352414, 352416-352418, 352420, 352422-352424, 352427-352428, 352430-352431, 352433, 352435, 352439, 352443, 352446, 352448, 352450, 352452-352457, 352460, 352464-352468, 352471-352477, 352479-352480, 352482-352484, 352486, 352488, 352497, 352499-352500, 352502, 352504, 352506-352508, 352510-352511, 352513-352515, 352517-352522, 352524-352525, 352527, 352530-352532, 352534-352537, 352539, 352541, 352543, 352545, 352547, 352549, 352552, 352554-352555, 352557-352558, 352561-352566, 352568, 352570-352573, 352577-352579, 352581-352584, 352589-352592, 352594, 352596, 352598, 352600-352602, 352606, 352608, 352613, 352615, 352617-352622, 352624, 352627-352635, 352641-352643, 352645-352646, 352648, 352650-352651, 352653, 352656-352657, 352659-352662, 352664, 352667-352668, 352670, 352674, 352676-352677, 352680-352682, 352692, 352694, 352696-352699, 352701-352702, 352706, 352708, 352710-352716, 352718, 352725, 352727-352730, 352732, 352734-352735, 352739-352753, 352755, 352759, 352761-352762, 352765-352769, 352774, 352778, 352783-352784, 352787-352789, 352791, 352797-352800, 352803-352807, 352809-352815, 352818, 352820, 352822-352827, 352829-352831, 352833-352834, 352838-352839, 352841, 352845, 352848-352857, 352860, 352862-352863, 352865-352868, 352872-352873, 352875, 352878-352880, 352882, 352886-352888, 352890, 352895, 352897-352904, 352908, 352910-352921, 352925-352928, 352930, 352932-352933, 352936, 352938-352944, 352946-352954, 352956-352970, 352972, 352974, 352976, 352979-352980, 352984-352993, 352996-352997, 352999, 353001-353002, 353009-353012, 353020-353021, 353023-353026, 353028-353030, 353032-353036, 353039, 353041-353047, 353049, 353051-353052, 353054-353057, 353061-353064, 353066, 353069-353072, 353075-353076, 353078, 353082, 353084-353086, 353089, 353093-353095, 353097, 353099-353101, 353103-353105, 353107-353108, 353110, 353113, 353115, 353121-353123, 353125-353126, 353128, 353130-353134, 353137-353138, 353144-353145, 353147, 353150-353152, 353156-353157, 353159-353161, 353163, 353165, 353167-353169, 353171-353173, 353175-353180, 353183-353184, 353186, 353188, 353190, 353192-353204, 353206-353210, 353213-353214, 353216-353218, 353220-353224, 353226, 353229-353234, 353236-353237, 353239-353241, 353243-353245, 353248-353254, 353260-353261, 353265-353267, 353270, 353272-353274, 353276, 353279-353283, 353285-353286, 353289-353293, 353295-353296, 353300, 353302-353308, 353310-353314, 353317-353318, 353323-353326, 353330-353336, 353339-353342, 353344-353348, 353350, 353352, 353354-353356, 353358-353361, 353364-353367, 353372, 353374-353375, 353377-353382, 353386-353390, 353398, 353401-353411, 353413-353416, 353419-353420, 353427-353432, 353434, 353436-353440, 353442, 353444, 353447, 353449, 353452-353457, 353459-353462, 353464, 353468-353469, 353471, 353474, 353477, 353481-353483, 353487-353488, 353490, 353495, 353498-353502, 353504, 353506, 353508-353513, 353515-353522, 353524, 353527-353535, 353537, 353541-353544, 353547, 353549-353552, 353554, 353556, 353558-353566, 353569, 353571-353577, 353580-353581, 353585-353586, 353588-353595, 353598-353599, 353602-353604, 353609-353610, 353615-353618, 353621-353622, 353625, 353627, 353629-353631, 353634-353635, 353637-353642, 353644-353645, 353647, 353649, 353651, 353655-353657, 353659-353663, 353665, 353667, 353669, 353672-353679, 353681-353684, 353686-353695, 353697, 353705, 353707-353710, 353712-353717, 353719, 353722-353723, 353726-353728, 353731, 353734-353736, 353738, 353740, 353744, 353747, 353751-353765, 353767, 353769, 353771-353774, 353776, 353778-353779, 353783-353788, 353796, 353798-353799, 353801, 353803-353809, 353811, 353813-353819, 353821-353822, 353825-353826, 353828, 353830-353831, 353833-353834, 353838-353839, 353841-353842, 353844, 353846-353849, 353851-353853, 353856, 353859-353862, 353864, 353869, 353871-353873, 353875-353876, 353878, 353880-353882, 353884, 353887, 353889, 353895-353904, 353906-353909, 353912-353915, 353917-353920, 353923-353924, 353929, 353931, 353933-353934, 353938, 353941-353948, 353950, 353952, 353954-353955, 353958-353961, 353963-353964, 353966, 353968-353972, 353974-353977, 353979-353980, 353983-353984, 353986-353989, 353993, 353995-353996, 353998-353999, 354001-354002, 354008, 354010-354012, 354015-354018, 354020-354022, 354027-354032, 354034-354035, 354038-354039, 354041-354046, 354048-354050, 354052-354065, 354067, 354069-354079, 354081-354086, 354088, 354092, 354094, 354096-354097, 354099, 354102, 354104, 354113, 354115-354119, 354121, 354124, 354126, 354128-354135, 354137-354138, 354142, 354146, 354148-354152, 354154, 354156-354163, 354165-354166, 354169, 354171, 354174, 354178, 354180-354182, 354185-354186, 354190, 354193-354194, 354196-354199, 354201, 354206-354209, 354216-354219, 354221-354227, 354229-354230, 354233-354237, 354241-354246, 354248-354264, 354267, 354269-354271, 354273-354275, 354277-354278, 354280-354282, 354284-354289, 354291-354292, 354294-354295, 354297-354301, 354303-354304, 354306, 354308-354320, 354322-354323, 354328, 354330-354349, 354351-354352, 354355-354357, 354359-354360, 354363-354365, 354367, 354371-354382, 354386-354389, 354391-354399, 354401-354407, 354410-354418, 354420, 354424-354427, 354430-354433, 354435-354437, 354440, 354442-354445, 354448, 354451, 354453, 354455, 354458-354460, 354463, 354465-354468, 354470, 354472, 354476-354477, 354480-354482, 354489-354491, 354494-354496, 354498-354499, 354503-354506, 354508, 354510, 354513-354514, 354516-354520, 354523, 354526, 354529-354530, 354532, 354534-354537, 354539, 354543, 354546-354551, 354553, 354555-354561, 354563-354564, 354567-354569, 354572-354573, 354579-354581, 354583-354588, 354590, 354592, 354595, 354598-354604, 354609, 354611-354620, 354622-354627, 354630-354633, 354635-354636, 354642-354644, 354646, 354648, 354650-354655, 354657, 354659-354660, 354662-354666, 354668, 354670-354672, 354674-354675, 354678, 354680-354684, 354686-354688, 354690-354692, 354694-354698, 354700, 354702, 354704-354707, 354709-354710, 354715-354718, 354720-354728, 354730-354733, 354735, 354739, 354745, 354749-354750, 354753-354758, 354761, 354763-354765, 354768, 354770, 354772-354774, 354776-354777, 354779-354783, 354785-354789, 354791-354792, 354795, 354797-354799, 354801, 354803-354812, 354814, 354817-354819, 354822-354831, 354835-354840, 354842, 354844-354845, 354848, 354850-354853, 354855-354856, 354858, 354860, 354863, 354865, 354868-354869, 354871, 354873-354876, 354878, 354883, 354885, 354887-354891, 354894-354899, 354901, 354903-354904, 354906-354908, 354911, 354913, 354916-354919, 354921-354930, 354933, 354935, 354937-354940, 354942-354958, 354960, 354962-354966, 354969-354972, 354974, 354976-354979, 354981-354988, 354990, 354993, 354997, 354999-355000, 355002-355007, 355010, 355013, 355015, 355017-355018, 355020-355025, 355027-355031, 355033, 355035-355037, 355040-355045, 355049-355051, 355053, 355056-355057, 355060, 355062-355063, 355068-355071, 355073-355079, 355081-355090, 355092-355094, 355097, 355101, 355103-355104, 355106, 355111, 355116, 355118-355123, 355126-355145, 355148-355149, 355151, 355157-355158, 355161, 355164-355165, 355167, 355171-355175, 355177-355178, 355180-355189, 355191-355196, 355198-355200, 355203, 355205-355210, 355213-355219, 355221, 355224-355228, 355230, 355236-355239, 355242, 355246-355247, 355249, 355253, 355256-355257, 355259-355264, 355267-355268, 355270, 355273-355283, 355285-355292, 355294, 355296, 355298, 355300, 355302, 355305, 355307-355311, 355319-355328, 355330, 355332, 355335, 355337-355340, 355342, 355344-355346, 355348-355349, 355351-355352, 355354-355355, 355357-355360, 355362, 355364, 355366-355374, 355376-355379, 355382-355388, 355391, 355398, 355400-355403, 355405-355407, 355409, 355413-355425, 355428-355430, 355434-355435, 355437, 355439-355445, 355447, 355450-355453, 355457-355459, 355464-355468, 355472-355478, 355480-355481, 355485, 355488-355489, 355491-355495, 355497-355499, 355501, 355507, 355509-355510, 355512-355515, 355520, 355523-355524, 355526, 355530-355535, 355537-355538, 355541, 355543, 355545, 355551-355555, 355559, 355561, 355564, 355571-355574, 355576, 355578-355582, 355587, 355589-355591, 355594-355595, 355597-355598, 355605, 355607-355611, 355615, 355617-355618, 355624, 355626-355629, 355631-355632, 355634, 355637-355640, 355642-355646, 355648-355653, 355655-355656, 355658, 355662, 355664-355671, 355674, 355676-355677, 355681, 355684, 355686-

355687, 355690-355693, 355696-355700, 355703, 355705, 355707, 355709-355711, 355713, 355716-355721, 355724, 355727-355729, 355731-355732, 355734, 355736, 355738-355746, 355748, 355751-355754, 355763-355767, 355771-355773, 355775-355778, 355781-355782, 355785, 355788-355789, 355793-355794, 355797-355798, 355801-355802, 355805-355806, 355808-355814, 355816, 355819-355820, 355823, 355826-355827, 355830, 355839-355845, 355847-355851, 355855, 355860, 355862-355863, 355865-355866, 355871, 355873-355877, 355883-355888, 355893, 355895-355900, 355902, 355904-355908, 355912, 355914, 355916-355922, 355926, 355928-355929, 355932-355933, 355936, 355938-355950, 355952, 355954-355955, 355957, 355961, 355963, 355966, 355968-355971, 355973-355988, 355991-355992, 355997-356004, 356007-356011, 356015-356020, 356022, 356024-356025, 356028, 356030-356031, 356033-356034, 356040-356044, 356046, 356048, 356053, 356055-356057, 356062, 356065-356068, 356071-356074, 356076-356079, 356081-356085, 356087, 356089-356092, 356095, 356097-356099, 356101-356102, 356105-356109, 356111-356116, 356118-356122, 356124, 356127-356130, 356134-356137, 356139-356140, 356142, 356144-356145, 356147, 356149, 356152, 356155, 356157-356158, 356160-356161, 356163, 356165, 356170-356176, 356179-356181, 356184-356189-356193, 356195, 356198, 356200-356205, 356209-356210, 356212, 356214, 356219, 356225-356229, 356231-356232, 356235-356236, 356245-356246, 356248, 356259-356260, 356267-356270, 356272-356274, 356276, 356278-356282, 356288-356291, 356293-356294, 356296, 356300-356302, 356305-356306, 356308-356309, 356316-356318, 356321, 356324, 356327, 356329, 356332-356334, 356338, 356340-356343, 356345-356349, 356353, 356355-356358, 356362-356363, 356366-356368, 356370-356371, 356373-356375, 356378-356379, 356382-356383, 356385-356386, 356389, 356392-356396, 356398, 356402-356405, 356407, 356409, 356412-356416, 356419, 356421-356422, 356424, 356427, 356429-356431, 356435-356436, 356439, 356441-356443, 356450-356452, 356455, 356458-356459, 356461-356463, 356469-356476, 356482, 356491, 356493-356496, 356498-356504, 356507-356508, 356510-356518, 356521-356523, 356527, 356529-356531, 356533, 356536-356540, 356546, 356549, 356551-356555, 356557-356559, 356565-356566, 356568-356573, 356580-356581, 356585, 356591, 356596-356598, 356600-356601, 356603, 356606-356611, 356613, 356615, 356617, 356619-356621, 356623-356626, 356628-356629, 356631-356632, 356635, 356637-356638, 356642-356643, 356645-356646, 356648-356651, 356654-356657, 356660-356661, 356663, 356665-356666, 356668-356669, 356671, 356675-356678, 356681-356682, 356685-356687, 356689-356690, 356692, 356696, 356698, 356701-356704, 356708, 356713-356719, 356721, 356726-356728, 356732-356739, 356742, 356745-356746, 356748, 356752-356753, 356755, 356758-356759, 356761-356765, 356767, 356769, 356771-356778, 356780-356781, 356783, 356789, 356791-356795, 356797-356802, 356805, 356807-356812, 356814, 356821, 356830-356833, 356838-356839, 356845, 356848, 356850, 356852, 356854, 356856, 356859, 356863, 356870, 356872, 356874-356876, 356879, 356886-356889, 356891-356897, 356900-356910, 356912, 356918, 356923-356928, 356930-356934, 356940-356942, 356944-356945, 356949-356950, 356953-356955, 356957-356958, 356960, 356962, 356965, 356967-356971, 356977-356982, 356984-356988, 356992-356993, 356997-356998, 357000-357001, 357003, 357005-357006, 357011-357013, 357015, 357018-357023, 357026-357028, 357030-357031, 357033-357034, 357037, 357040, 357042-357045, 357047-357048, 357052-357055, 357057, 357060, 357062, 357064, 357067-357068, 357071-357073, 357075, 357079-357086, 357088, 357090-357091, 357094-357097, 357099-357103, 357106-357108, 357113-357118, 357121, 357123-357126, 357131, 357135-357136, 357138, 357140, 357142, 357146, 357150, 357154-357164, 357167, 357169-357172, 357175, 357177-357178, 357181-357182, 357184, 357186, 357188-357194, 357197-357206, 357208-357214, 357216, 357218-357219, 357221, 357224, 357226-357227, 357229-357230, 357232-357236, 357238-357240, 357242, 357244-357247, 357251-357255, 357257, 357259-357262, 357265-357266, 357268, 357270-357272, 357278, 357280, 357282, 357285-357287, 357289-357295, 357297-357299, 357309, 357311-357312, 357314-357318, 357321-357327, 357329, 357331, 357333-357337, 357339, 357341-357346, 357348-357349, 357351-357353, 357355-357357, 357367-357371, 357375-357376, 357378, 357382-357386, 357389-357391, 357394, 357396, 357398-357401, 357405-357406, 357408-357411, 357413-357416, 357418, 357420, 357422-357425, 357427, 357430-357442, 357449-357450, 357452, 357457, 357460-357461, 357464-357467, 357470-357471, 357473-357480, 357482-357483, 357487, 357489-357491, 357493, 357496, 357498-357501, 357504-357507, 357509-357514, 357516-357517, 357520-357522, 357524-357526, 357529-357531, 357533-357536, 357538, 357540-357541, 357545-357547, 357552-357554, 357556, 357558, 357568-357569, 357571-357572, 357574, 357576, 357578, 357582-357584, 357588-357592, 357596-357601, 357605-357606, 357610, 357614-357617, 357619, 357623, 357625, 357627-357633, 357635-357636, 357639-357640, 357642-357643, 357645-357647, 357649-357652, 357655-357658, 357661, 357663, 357665-357666, 357668, 357670-357677, 357684, 357688-357690, 357692-357694, 357697, 357699-357702, 357704, 357706-357708, 357710, 357712, 357714-357719, 357721, 357723, 357726-357727, 357729, 357731-357733, 357739, 357742, 357746, 357749-357750, 357753-357755, 357757-357759, 357761-357764, 357766-357767, 357770-357777, 357783-357789, 357794, 357796-357797, 357799-357801, 357803-357804, 357806-357809, 357811-357812, 357814, 357819-357824, 357827-357828, 357830-357835, 357840, 357848-357851, 357854-357855, 357861-357862, 357864, 357868-357870, 357874-357880, 357883-357884, 357886, 357889-357890, 357892-357893, 357896-357898, 357900, 357903-357904, 357907, 357909, 357913, 357915, 357917-357925, 357927, 357930, 357932-357935, 357937-357940, 357942-357943, 357945-357947, 357949-357951, 357953-357955, 357958-357960, 357962-357963, 357966-357975, 357977-357979, 357981, 357983, 357985-357989, 357991, 357993, 357995-357996, 357998-357999, 358002-358003, 358005-358008, 358013, 358015, 358017, 358021-358022, 358024-358032, 358034, 358039, 358043-358045, 358048-358053, 358055, 358057, 358059-358065, 358069, 358071-358072, 358075, 358077-358080, 358082, 358084-358088, 358090-358099, 358101-358104, 358106-358117, 358120-358121, 358124-358129, 358131, 358133-358135, 358139, 358141-358143, 358145, 358147, 358149-358150, 358155-358156, 358158-358159, 358161-358164, 358166-358167, 358169-358174, 358176-358179, 358181, 358183, 358185-358188, 358193, 358196-358198, 358201-358203, 358206, 358209-358211, 358213, 358215-358220, 358225-358239, 358241-358243, 358246-358248, 358250-358253, 358256-358258, 358260, 358263, 358265, 358268-358270, 358273-358274, 358277-358281, 358285-358290, 358293-358294, 358296-358297, 358300-358311, 358313, 358315-358324, 358326-358327, 358329-358340, 358342, 358344, 358346, 358350, 358353, 358355-358360, 358364-358367, 358371-358372, 358374-358382, 358387-358388, 358390-358391, 358393-358394, 358396-358400, 358402-358406, 358408-358411, 358413, 358415-358418, 358420, 358422, 358424-358427, 358430-358431, 358433, 358435-358437, 358439, 358441-358446, 358448-358450, 358452-358453, 358456-358461, 358464-358465, 358467-358468, 358471-358472, 358475-358480, 358482, 358484, 358490-358491, 358493-358494, 358496-358497, 358499, 358501-358502, 358505-358508, 358510, 358515, 358519, 358521-358526, 358528-358532, 358534, 358536-358539, 358543-358546, 358550-358555, 358557-358562, 358565-358572, 358574-358575, 358578-358583, 358586, 358588-358589, 358592, 358594-358604, 358606, 358608, 358610, 358614-358618, 358621, 358623-358624, 358631-358632, 358635-358640, 358642-358644, 358646-358650, 358652-358653, 358655-358656, 358659, 358661, 358663, 358668-358672, 358675-358676, 358678, 358680, 358682-358683, 358685-358689, 358692-358693, 358695-358703, 358705, 358708, 358710, 358715-358726, 358728-358738, 358742-358743, 358745, 358747-358759, 358762-358763, 358765-358768, 358772, 358778-358781, 358784, 358786-358797, 358806-358808, 358812, 358814, 358818-358828, 358832, 358834-358837, 358840-358849, 358852-358855, 358857-358861, 358863-358865, 358868-358876, 358879-358881, 358884, 358886, 358888-358892, 358895, 358897, 358900, 358902, 358905, 358908-358911, 358913, 358915, 358919-358920, 358923, 358925-358926, 358928-358930, 358936, 358940, 358942-358950, 358953-358956, 358958-358963, 358969, 358971, 358973-358974, 358977-358979, 358984, 358986-358989, 358992-358994, 358996-358997, 358999, 359004-359006, 359008-359030, 359032-359033, 359035, 359037, 359039-359041, 359044-359045, 359047, 359050-359054, 359056, 359059-359061, 359063-359073, 359075-359081, 359083-359084, 359086-359087, 359089-359092, 359094, 359099-359100, 359102-359105, 359107-359109, 359112-359115, 359117, 359119-359120, 359122-359124, 359126-359130, 359138-359139, 359143-359145, 359147-359148, 359151-359155, 359158-359164, 359167-359170, 359176, 359178-359181, 359188, 359190-359191, 359195-359200, 359203-359207, 359209, 359211-359217, 359219-359220, 359224-359228, 359230-359231, 359233-359234, 359236, 359239, 359241, 359243-359244, 359246-359248, 359251, 359253, 359255-359257, 359260-359263, 359267-359268, 359270-359272, 359274, 359278-359279, 359281-359283, 359285, 359291-359294, 359297, 359302, 359304-359309, 359311-359312, 359314-359319, 359324-359325, 359328-359333, 359335-359339, 359341-359344, 359347, 359350, 359352-359357, 359359, 359361-359362, 359366, 359368-359369, 359371-359372, 359376-359377, 359379, 359381, 359383-359385, 359388-359390, 359395, 359397-359399, 359402-359405, 359408-359411, 359413-359421, 359423, 359425-359427, 359429, 359432-359435, 359437-359438, 359440-359441, 359443, 359446-359454, 359456, 359458-359459, 359463-359465, 359468, 359473-359481, 359483-359488, 359490-359491, 359493, 359495-359496, 359500-359507, 359509-359529, 359531, 359535-359539, 359542, 359549-359550, 359553, 359556-359563, 359565-359566, 359569-359573, 359575, 359579-359580, 359582, 359584, 359589-359591, 359593, 359596-359599, 359604, 359606-359611, 359614-359617, 359619-359622, 359624-359627, 359629-359630, 359640-359644, 359646-359647, 359650, 359655-359658, 359660, 359662-359671, 359675-359676, 359678-359682, 359685, 359687-359689, 359691-359693, 359696, 359698, 359700-359706, 359708-359710, 359712, 359715-359716, 359718, 359722-359723, 359725-359726, 359730, 359732, 359734, 359738-359741, 359743-359747, 359749, 359751-359753, 359755-359757, 359759-359764, 359766, 359768-359773, 359775, 359777, 359779-359780, 359787, 359789, 359791, 359793-359795, 359798-359806, 359809-359810, 359812-359813, 359815-359817, 359819-359827, 359830, 359832, 359835, 359837, 359840-359841, 359843-359844, 359846-359851, 359853-359856, 359859-359860, 359862-359865, 359868-359872, 359874, 359876-359877, 359881-359882, 359887-359888, 359891-359892, 359896-359901, 359904, 359907-359911, 359914, 359917-359918, 359920-359921, 359923, 359926-359927, 359930, 359933-359937, 359939-359950, 359955-359961, 359963, 359967-359971, 359973, 359976-359980, 359982, 359986-359989, 359991, 359999, 360001-360003, 360005-360007, 360009-360012, 360017-360018, 360020, 360022-360023, 360025-360027, 360031-360034, 360037-360045, 360048-360056, 360058-360062, 360065-360066, 360070-360076, 360078-360082, 360084-360085, 360087-360088, 360090-360091, 360093, 360100, 360103-360104, 360111-360114, 360116, 360118-360122, 360125, 360127, 360130, 360132, 360135-360137, 360141, 360143, 360145, 360147, 360149, 360151-360161, 360164-360169, 360171-360172, 360175-360177, 360179, 360183, 360185-360186, 360188, 360190, 360192, 360195, 360197, 360199, 360201, 360203, 360205, 360207, 360209, 360212-360215, 360217-360219, 360221-360223, 360225, 360228-360237, 360239-360242, 360244, 360250-360252, 360254, 360260-360266, 360270-360277, 360279-360281, 360283-360292, 360294, 360301-360312, 360316-360327, 360329, 360331, 360337, 360347, 360349, 360351-360352, 360355-360357, 360359, 360363, 360368-360369, 360371, 360376, 360379-360380, 360384-360386, 360389-360390, 360392-360396, 360398-360399, 360402, 360405-360406, 360409-360410, 360414-360417, 360419-360424, 360426-360433, 360435, 360438, 360440-360441, 360443-360448, 360450, 360452-360460, 360463-360464, 360467, 360470-360474, 360476-360479, 360482-360484, 360487, 360489-360491, 360493, 360496-360497, 360500-360502, 360505, 360509-360510, 360512, 360514, 360517-360520, 360522, 360524, 360526-360527, 360529-360532, 360535-360545, 360548-360550, 360552-360556, 360558-360570, 360572-360574, 360576-360585, 360587, 360590-360594, 360596, 360598, 360600-360602, 360606-360609, 360612-360613, 360617-360621, 360624-360630, 360632-360637, 360639, 360641-360642, 360644-360646, 360648, 360650-360657, 360659-360665, 360667-360668, 360670-360671, 360673-360676, 360678-360679, 360681-360689, 360691-360693, 360695-360698, 360700-360702, 360704, 360706, 360708-360709, 360711, 360713-360717, 360720-360721, 360723, 360725-360728, 360744, 360747-360750, 360752-360754, 360756-360758, 360760, 360763-360764, 360766, 360768, 360771, 360774-360776, 360779-360782, 360785, 360788-360792, 360794, 360796-360797, 360799-360802, 360804-360814, 360816, 360818-360821, 360823, 360825-360828, 360830-360840, 360843-360845, 360847-360851, 360853-360856, 360858, 360860, 360862-360869, 360873-360877, 360879-360905, 360908, 360910-360913, 360915-360918, 360920-360924, 360927-360929, 360932, 360934-360946, 360948-360953, 360957-360959, 360963, 360965-360966, 360971, 360974, 360976-360978, 360981-360982, 360984, 360987-360989, 360991-360992, 360996, 360998, 361001, 361003, 361007, 361009-361016, 361018, 361020-361025, 361028, 361031-361033, 361036-361039, 361042-361044, 361047-361048, 361050-361055, 361057-361058, 361060-361061, 361063-361064, 361068, 361070-361071, 361073, 361076, 361079-361083, 361085-361087, 361089-361094, 361098, 361103-361112, 361114-361116, 361120-361123, 361125, 361127-361129, 361132-361137, 361139-361145, 361147-361152, 361154, 361156, 361158, 361160-361171, 361173-361175, 361177-361180, 361182-361183, 361186-361187, 361191-361192, 361194-361196, 361200-361204, 361206, 361208-361211, 361215-361225, 361227-361229, 361231-361232, 361235-361237, 361240, 361249-361252, 361257-361261, 361264, 361266-361271, 361278, 361281-361282, 361284-361285, 361287-361291, 361293-361294, 361298-361300, 361302-361304, 361308-361309, 361313, 361315-361317, 361320, 361324, 361327-361329, 361331, 361334-361335, 361342, 361345, 361347, 361349, 361351, 361353-361354, 361357, 361359, 361361, 361363-361364, 361367-361368, 361373-361374, 361376-361383, 361385-361391, 361397-361400, 361402-361403, 361405-361410, 361412-361413, 361415, 361420, 361424, 361431-361435, 361437, 361442-361445, 361448-361449, 361455-361456, 361460-361464, 361467-361470, 361472-361477, 361480-361481, 361483-361484, 361486, 361488-361490, 361492-361498, 361500-361501, 361503-361504, 361506, 361508-361509, 361511, 361514-361518, 361523, 361525, 361527-361529, 361532, 361537, 361539, 361541, 361543-361545, 361549-361554, 361557, 361559-361561, 361564, 361567-361570, 361573, 361575-361576, 361579, 361584-361588, 361590-361592, 361594, 361596, 361598, 361600, 361604-361605, 361607-361608, 361610-361611, 361614, 361616-361617, 361619-361623, 361625-361640, 361642-361645, 361647-361650, 361652, 361654-361657, 361659-361665, 361667, 361669-361674, 361676-361677, 361679, 361681, 361684, 361689, 361691-361694, 361696, 361699-361704, 361707-361708, 361710-361711, 361714, 361716, 361718, 361720-361721, 361725, 361727, 361729-361731, 361734-361735, 361739, 361741, 361743-361745, 361747, 361749-361750, 361753-361754, 361756-361761, 361763-361767, 361769-361771, 361774-361789, 361791, 361794-361803, 361805-361806, 361809-361810, 361812-361819, 361821, 361823, 361826, 361828-361838, 361840, 361842-361845, 361847-361856, 361858-361859, 361861, 361863-361864, 361867, 361872, 361874, 361876-361877, 361880-361881, 361883, 361885-361887, 361889, 361894-361901, 361904-361906, 361908, 361910-361914, 361916-361918, 361920-361922, 361924, 361927-361932, 361937-361941, 361943, 361945, 361948, 361950, 361952, 361957, 361960-361961, 361964, 361966-361969, 361971, 361973, 361975, 361979-361984, 361986-361987, 361989-361990, 361992, 361998-361999, 362001-362002, 362004-362006, 362010-362011, 362013, 362015-362016, 362019, 362024-362025, 362027, 362032, 362034, 362040, 362042, 362044-362046, 362053, 362056, 362059-362062, 362064-362070, 362075-362077, 362079-362083, 362086, 362089-362090, 362092-362094, 362098, 362100, 362105, 362107, 362109, 362112-362121, 362123-362126, 362128-362131, 362133, 362135, 362138-362140, 362143, 362146-362149, 362153-362157, 362161-362171, 362173, 362175-362177, 362179-362189, 362192-362197, 362199-362203, 362206, 362209-362210, 362214-362219, 362221, 362223-362225, 362229-362230, 362232-362233, 362237-362241, 362244-362245, 362247-362248, 362250-362253, 362259, 362261, 362263, 362266-362274, 362278-362283, 362285, 362288-362289, 362292-362293, 362295-362301, 362306-362307, 362311-362312, 362314-362315, 362318-362320, 362324-362328, 362330-362346, 362348-362359, 362361-362365, 362367, 362369-362377, 362379-362382, 362384-362385, 362387-362390, 362395-362398, 362400, 362402-362405, 362408, 362410-362411, 362414-362416, 362418-362419, 362421-362423, 362426-362428, 362432, 362434, 362436, 362439-362440, 362442-362443, 362448-362452, 362454, 362457, 362459-362468, 362471, 362473-362474, 362476-362477, 362479, 362481-362482, 362484-362490, 362493-362497, 362500-362505, 362507-362515, 362517-362518, 362521, 362524-362525, 362527, 362530, 362532, 362534, 362536-362543, 362546, 362548-362549, 362551-362552, 362554, 362560-362562, 362564-362567, 362571, 362586-362591, 362594, 362596-362597, 362600-362608, 362611-362619, 362621, 362623, 362625-362626, 362631-362637, 362639-362641, 362643-362645, 362647-362648, 362651-362653, 362655, 362657-362658, 362660-362664, 362666, 362668, 362670-362674, 362676-362677, 362681, 362684-362689, 362692, 362694-362698, 362700-362702, 362704, 362706-362707, 362709-362714, 362716, 362719-362722, 362725, 362729-362733, 362741, 362743-362764, 362766-362774, 362776, 362778, 362780-362785, 362787-362810, 362812-362819, 362821-362824, 362826, 362828-362832, 362835-362836, 362838-362851, 362853-362854, 362857, 362860-362863, 362867-362868, 362871-362875, 362878-362879, 362882-362886, 362892-362899, 362902-362904, 362908, 362915-362921, 362924-362928, 362931-362935, 362940-362941, 362944, 362946, 362948-362951, 362953-362954, 362956-362960, 362962, 362967-362970, 362972, 362975-362976, 362978-362980, 362982-362987, 362989, 362991-362992, 362995-362999, 363002-363006, 363009-363012, 363016-363019, 363021-363029, 363031-363034, 363036, 363038-363050, 363052-363053, 363055, 363057-363061, 363063-363067, 363069, 363072, 363074-363075, 363078-363080, 363082, 363084-363086, 363088, 363090, 363092-363093, 363096-363100, 363102-363103, 363105, 363107, 363109-363114, 363117, 363120-363121, 363123-363126, 363129, 363131, 363133-363135, 363138, 363142, 363144, 363146, 363148-363149, 363152, 363154, 363156-363166, 363169-363170, 363172, 363174-363182, 363184-363185, 363187, 363190-363194, 363196-363199, 363202-363206, 363208, 363211-363212, 363214-363218, 363220-363224, 363226-363228, 363231-363232, 363234, 363238-363239, 363241-363242, 363244-363245, 363247-363248, 363250, 363253, 363255, 363257, 363259-363266, 363269, 363271-363272, 363274, 363277-363280, 363282, 363285-363286, 363289, 363293-363294, 363298, 363301-363303, 363305-363306, 363312, 363314, 363318-363325, 363328-363329, 363331, 363333-363334, 363341-363345, 363347-363348, 363352-363357, 363359, 363361-363365, 363367-363371, 363374, 363376-363377, 363379-363380, 363382-363384, 363386-363391, 363393, 363395, 363397-363400, 363402-363403, 363405-363407, 363409-363410, 363412-363417, 363419-363427, 363429, 363431, 363433-363435, 363437-363439, 363441-363443, 363445-363452, 363455-363461, 363463, 363465-363466, 363468, 363471, 363473-363475, 363478-363499, 363501-363503, 363505-363510, 363512-363513, 363515, 363517-363520, 363522-363524, 363527-363529, 363531, 363535-363536, 363538-363539, 363541-363547, 363549, 363551, 363553, 363556-363557, 363560-363563, 363565, 363568, 363571-363573, 363576, 363578-363580, 363582, 363584-363585, 363587-363589, 363591, 363593-363600, 363603, 363605, 363608, 363610-363611, 363613, 363616, 363619-363622, 363624-363625, 363627-363628, 363630-363634, 363638-363639, 363641-363644, 363646, 363648-363649, 363651, 363658-363665, 363667-363668, 363670, 363673-363679, 363682, 363684, 363686-363690, 363693-363694, 363696-363698, 363700-363701, 363703-363704, 363706-363708, 363710-363714, 363718, 363722, 363725-363727, 363731, 363733, 363736-363737, 363739-363745, 363748, 363751, 363753, 363760-363765, 363767-363775, 363777-363787, 363789, 363792-363794, 363797-363800, 363803, 363805, 363807, 363811-363812, 363815-363823, 363826-363827, 363834, 363836-363837, 363840, 363843-363847, 363850-363855, 363857-363858, 363860-363861, 363863-363870, 363872-363873, 363875, 363877-363878, 363880-363881, 363883, 363885, 363889-363890, 363893, 363895-363897, 363900, 363902, 363904, 363906-363914, 363916, 363918, 363921-363929, 363932-363937, 363941-363943, 363945-363950, 363952-363954, 363956-363960, 363962-363963, 363965-363968, 363970-363972, 363974-363976, 363980-363983, 363986, 363988-363989, 363991-363992, 363995-363996, 364001-364003, 364005, 364008-364010, 364013-364014, 364017-364018, 364020-364025, 364027-364028, 364030-364034, 364036, 364038-364040, 364043-364048, 364055-364060, 364066, 364068, 364071-364072, 364074-364076, 364078-364080, 364082, 364084, 364086, 364089-364093, 364095, 364097-364099, 364101, 364103-364104, 364106-364107, 364109, 364112-364121, 364123-364124, 364126-364128, 364130, 364139, 364141-364150, 364152, 364154-364157, 364159-364160, 364163-364164, 364167-364168, 364173, 364176-364180, 364182-364183, 364186-364189, 364191-364193, 364197-364198, 364202-364203, 364205-364206, 364209, 364211-364215, 364221-364226, 364229-364231, 364233-364238, 364241, 364244, 364249-364252, 364259-364261, 364263-364264, 364266-364267, 364269, 364272, 364274-364276, 364279-364281, 364286-364287, 364290, 364298, 364300-364301, 364305, 364307, 364309, 364311-364313, 364317-364318, 364320-364337, 364339, 364341-364343, 364345-364346, 364348-364349, 364352, 364354, 364356, 364358-364360, 364364-364367, 364369, 364371, 364373-364374, 364376-364389, 364392-364393, 364395-364404, 364408-364410, 364412-364419, 364421, 364424-364428, 364431-364435, 364437, 364439-364441, 364443, 364445-364451, 364453-364458, 364463-364465, 364468-364474, 364476-364477, 364479, 364482-364484, 364486-364494, 364497-364498, 364500, 364502, 364504-364515, 364517-364518, 364520-364521, 364525-364526, 364529-364531, 364533-364538, 364540, 364544-364549, 364551, 364553, 364556-364562, 364564-364566, 364568-364570, 364572, 364574-364576, 364578-364580, 364582, 364584, 364586-364597, 364599-364603, 364606-364607, 364609, 364611-364613, 364616-364620, 364622, 364624, 364627-364629, 364631, 364633-364639, 364641, 364643-364644, 364648-364651, 364655-364664, 364668-364674, 364678-364681, 364685-364694, 364696-364697, 364699, 364702-364707, 364710-364712, 364717-364729, 364731, 364733-364741, 364745-364747, 364750-364752, 364755-364771, 364773, 364775-364777, 364781, 364783-364789, 364792-364794, 364798-364802, 364804-364805, 364808, 364810-364818, 364820, 364824-364827, 364829-364830, 364832-364841, 364845-364846, 364848-364849, 364851-364852, 364854-364860, 364862, 364864-364868, 364870-364873, 364875-364879, 364881-364883, 364885-364890, 364892-364898, 364901, 364903-364907, 364910-364919, 364921-364922, 364925-364927, 364929-364930, 364933-364939, 364943-364945, 364948-364951, 364953-364955, 364957, 364963-364964, 364966-364969, 364972-364978, 364980-364981, 364983-364987, 364989, 364991-364992, 364994-364996, 364998-365005, 365008, 365011, 365013-365014, 365016-365017, 365019-365025, 365027, 365032, 365034, 365036-365037, 365039-365042, 365047-365049, 365052, 365054, 365056, 365058-365059, 365061-365066, 365071, 365074-365077, 365079-365080, 365082, 365084, 365092-365099, 365101-365103, 365105-365110, 365112-365120, 365122-365127, 365129, 365131-365134, 365139-365140, 365142, 365144, 365147, 365152-365153, 365156-365157, 365161-365162, 365164, 365166-365171, 365173-365175, 365177-365189, 365192, 365194, 365197-365198, 365200-365203, 365205-365206, 365209, 365213, 365215, 365217-365224, 365226, 365228, 365230-365233, 365235, 365237-365242, 365245-365247, 365249, 365253-365255, 365259, 365261-365275, 365277-365281, 365285-365286, 365288-365291, 365293, 365295, 365298, 365301-365302, 365304, 365308-365309, 365315-365317, 365319-365338, 365341-365342, 365345-365346, 365348-365350, 365352, 365354, 365356-365358, 365360-365363, 365366-365368, 365370-365377, 365381-365385, 365388-365391, 365396-365401, 365405-365414, 365416, 365419, 365421-365424, 365426-365427, 365431-365432, 365435-365438, 365440-365454, 365456, 365459-365460, 365462-365467, 365469, 365472-365476, 365478-365482, 365484-365485, 365487, 365489-365495, 365497, 365499-365500, 365503-365504, 365506, 365508-365510, 365512, 365514-365516, 365518-365520, 365523, 365525-365526, 365529-365533, 365535, 365537, 365539, 365542-365547, 365549-365552, 365554-365560, 365564-365566, 365568, 365571-365573, 365576-365577, 365580, 365585-365593, 365596-365601, 365603-365604, 365607-365609, 365611, 365613, 365615-365629, 365631-365636, 365638-365640, 365649, 365652, 365654-365663, 365665-365667, 365670-365671, 365673-365675, 365677, 365679-365682, 365684, 365686-365687, 365690-365693, 365696, 365700-365701, 365703, 365706-365707, 365710, 365712, 365714-365715, 365717-365723, 365725-365726, 365728, 365730-365734, 365737-365738, 365740-365742, 365744-365747, 365749-365752, 365754-365757, 365760, 365762, 365765-365767, 365769-365771, 365774-365778, 365780-365781, 365784-365792, 365794, 365797-365810, 365814, 365817, 365820, 365822-365824, 365826, 365829-365833, 365835, 365838-365839, 365841-365845, 365848, 365850, 365852-365856, 365858-365861, 365863-365870, 365872, 365877, 365879-365894, 365896, 365899-365900, 365902-365906, 365910-365915, 365918-365920, 365924-365925, 365927, 365929, 365931-365936, 365938, 365940-365946, 365948-365949, 365951-365953, 365955, 365957-365958, 365960, 365962, 365964-365969, 365971, 365973-365975, 365978-365979, 365981-365983, 365985-365995, 365997-365998, 366001, 366004, 366007, 366009-366010, 366012, 366014, 366016-366019, 366021-366027, 366029-366038, 366040, 366042-366045, 366048-366060, 366062-366063, 366067-366070, 366072-366073, 366075, 366079-366080, 366082-366087, 366089-366090, 366093-366094, 366096-366099, 366102-366106, 366111-366112, 366114-366115, 366117-366125, 366127, 366129-366137, 366139-366145, 366147, 366151, 366153, 366156-366174, 366176, 366180, 366183-366184, 366186, 366189-366191, 366193-366194, 366196-366198, 366202, 366207-366211, 366213-366218, 366221-366225, 366229, 366231-366236, 366238-366239, 366241-366243, 366245, 366249-366253, 366256-366259, 366261, 366263-366267, 366269-366270, 366273, 366275-366277, 366279, 366281, 366285-366288, 366290, 366293-366301, 366303, 366305-366306, 366311, 366313-366315, 366317-366326, 366328-366335, 366338-366339, 366341-366342, 366346-366348, 366350-366355, 366357-366358, 366360, 366362-366364, 366366-366367, 366374, 366380-366381, 366383-366393, 366395-366397, 366402-366404, 366406, 366410, 366414, 366416-366420, 366427-366428, 366430, 366433, 366435, 366438, 366441-366442, 366444-366448, 366451-366452, 366454-366455, 366457-366459, 366461, 366465-366466, 366468-366470, 366475-366486, 366490, 366492-366493, 366495, 366498-366501, 366503-366505, 366507-366516, 366520-366522, 366524, 366526-366527, 366530-366535, 366538, 366544, 366546-366548, 366550, 366552-366556, 366559, 366561, 366563-366565, 366568-366584, 366587-366589, 366591, 366593, 366595-366609, 366611, 366614, 366617, 366621-366628, 366630-366634, 366637, 366642, 366644-366645, 366647, 366650-366655, 366658, 366660, 366663-366677, 366679, 366681-366685, 366692-366696, 366699, 366702-366703, 366709-366711, 366713, 366715-366716, 366718-366720, 366725-366726, 366728, 366730-366734, 366737-366739, 366743, 366747-366752, 366755-366757, 366759-366762, 366764, 366766, 366768, 366770-366773, 366775-366776, 366778-366782, 366784, 366786, 366789-

366791, 366793-366794, 366798, 366800-366801, 366808-366812, 366816, 366822-366823, 366825-366826, 366828-366832, 366834-366839, 366841, 366843-366844, 366846-366849, 366853-366854, 366856, 366858, 366860, 366862-366863, 366865-366867, 366869-366878, 366881, 366883-366885, 366887, 366891, 366894-366897, 366899-366901, 366903, 366906, 366908-366914, 366916-366917, 366920-366921, 366923-366924, 366926-366933, 366935-366936, 366938-366943, 366946-366947, 366949-366950, 366952, 366954-366957, 366959-366963, 366965-366969, 366971-366977, 366979, 366982-366984, 366987, 366989, 366992-367007, 367009-367010, 367012, 367014-367015, 367018-367027, 367029, 367031-367037, 367039-367042, 367044-367045, 367049, 367052, 367058-367061, 367063-367064, 367066, 367069-367070, 367072, 367076-367081, 367083-367090, 367094, 367097, 367099-367105, 367108, 367111-367113, 367117-367119, 367121-367122, 367124, 367130-367133, 367137, 367142, 367144, 367146-367147, 367151-367156, 367158, 367160-367165, 367172-367175, 367177, 367179, 367184-367189, 367193-367195, 367197-367199, 367203, 367206-367207, 367210-367213, 367215-367217, 367220-367222, 367224, 367226-367231, 367234, 367243-367246, 367249-367253, 367257, 367259, 367263, 367265, 367267, 367269, 367272, 367274, 367277-367279, 367281, 367283, 367286-367291, 367293-367294, 367296, 367298, 367302, 367304, 367306, 367309-367323, 367326-367330, 367332, 367334-367342, 367344-367353, 367355-367357, 367360-367364, 367366-367367, 367369, 367371-367372, 367374-367375, 367377-367378, 367380, 367387, 367389, 367391-367392, 367396-367400, 367404-367407, 367409, 367411, 367413-367416, 367418, 367420-367422, 367424-367434, 367439, 367443-367447, 367449, 367451-367454, 367456, 367458, 367461, 367463-367465, 367467-367468, 367471, 367473-367474, 367477-367478, 367487-367488, 367491-367493, 367495-367497, 367502-367504, 367508-367511, 367513, 367517, 367519, 367521, 367525-367526, 367529-367536, 367541, 367543-367546, 367548, 367551, 367555-367558, 367563, 367565-367566, 367569, 367572-367575, 367577-367578, 367581, 367586-367590, 367592, 367594, 367596-367601, 367603-367611, 367613, 367615-367621, 367624-367643, 367645, 367648, 367654-367655, 367657-367658, 367660-367672, 367677-367678, 367680-367685, 367692, 367694-367695, 367698, 367700-367703, 367709, 367711-367715, 367718-367720, 367722-367736, 367738-367740, 367742, 367745, 367747-367750, 367752, 367754-367756, 367759, 367763-367764, 367766-367767, 367769-367778, 367780-367782, 367784, 367787, 367789, 367791-367794, 367796-367797, 367799, 367801, 367803-367806, 367808-367809, 367812, 367814-367821, 367823-367826, 367828-367832, 367834, 367837-367839, 367841-367843, 367845-367852, 367854-367856, 367859-367860, 367866-367867, 367869-367870, 367873, 367877-367878, 367881-367882, 367884, 367886-367889, 367891-367893, 367895-367897, 367899-367900, 367904-367905, 367907-367910, 367913-367921, 367923-367931, 367933-367937, 367939-367940, 367947, 367950, 367953-367955, 367957-367958, 367960, 367967-367971, 367973, 367975-367976, 367979-367983, 367985-367986, 367988-367993, 367997-367999, 368006-368008, 368010-368014, 368020-368025, 368029, 368035-368039, 368043-368048, 368051, 368053-368055, 368059, 368061-368062, 368066-368067, 368070, 368072-368073, 368075-368076, 368079-368080, 368083, 368088-368091, 368095, 368097, 368099, 368103-368104, 368107, 368110-368114, 368116, 368118, 368120-368122, 368124, 368126, 368128-368131, 368133-368136, 368139, 368141, 368143-368146, 368148-368149, 368152-368156, 368158, 368161, 368163, 368166-368168, 368171, 368173-368178, 368181-368190, 368192-368199, 368202, 368204-368206, 368208-368216, 368221-368222, 368224-368226, 368229-368230, 368235, 368238, 368240-368242, 368245-368248, 368250-368252, 368254-368255, 368257-368261, 368265, 368268, 368270-368272, 368277-368283, 368285-368286, 368289-368295, 368297-368303, 368309, 368311, 368313, 368316-368317, 368319-368321, 368323-368328, 368330-368336, 368340, 368343-368344, 368348-368349, 368351-368352, 368356, 368358, 368360-368362, 368364-368368, 368372-368374, 368377-368383, 368385, 368390-368391, 368393, 368396-368398, 368400, 368403, 368407-368408, 368413, 368415-368416, 368419-368421, 368425, 368427, 368430-368433, 368435-368441, 368443-368444, 368447, 368449-368451, 368453, 368455-368457, 368459-368460, 368463-368466, 368468-368477, 368479-368481, 368485, 368488-368497, 368499, 368501-368502, 368504-368505, 368508, 368510, 368512, 368514, 368516, 368521-368523, 368526, 368529-368530, 368533, 368539-368544, 368546, 368549, 368551-368552, 368554-368556, 368560, 368562, 368564, 368569-368573, 368577-368581, 368583, 368585-368589, 368592, 368595-368598, 368600, 368602-368605, 368609-368610, 368612-368615, 368617-368618, 368620-368622, 368624-368627, 368629-368632, 368634, 368639, 368641-368642, 368645-368646, 368649, 368652-368654, 368657-368663, 368665, 368667-368671, 368673-368674, 368676-368677, 368679, 368683, 368687, 368691-368695, 368698, 368700-368704, 368709-368720, 368723, 368725-368729, 368731, 368733-368735, 368738, 368740-368746, 368748-368751, 368753-368759, 368763-368766, 368768, 368770-368771, 368774-368780, 368782, 368784, 368786-368789, 368792, 368794-368795, 368797-368798, 368800, 368802-368803, 368805-368806, 368809-368810, 368813, 368815, 368818-368820, 368824-368825, 368831-368832, 368834, 368836-368837, 368839, 368842-368843, 368848-368849, 368851-368855, 368859, 368861-368862, 368864-368866, 368868-368873, 368882, 368886-368890, 368894, 368898, 368901-368902, 368904-368905, 368907-368908, 368910-368911, 368914-368916, 368918, 368920, 368922-368923, 368925-368926, 368928, 368930-368931, 368933-368936, 368938, 368940-368942, 368945, 368947, 368950-368953, 368955, 368958-368959, 368961, 368963-368966, 368968-368971, 368973-368976, 368978-368980, 368982-368990, 368992-368997, 368999-369003, 369005, 369007-369009, 369011, 369014-369021, 369024-369025, 369029-369030, 369032-369036, 369039-369041, 369043, 369047-369048, 369050-369057, 369060-369062, 369068-369070, 369073, 369076-369077, 369079, 369083-369090, 369093-369094, 369096, 369099, 369101, 369105-369108, 369110-369111, 369113-369114, 369116, 369118, 369123-369126, 369128-369130, 369133, 369135-369141, 369144, 369147-369148, 369151-369154, 369157, 369159, 369161-369162, 369166-369169, 369171, 369173-369179, 369181-369184, 369189, 369191-369192, 369195-369196, 369198-369203, 369206-369208, 369210, 369213-369222, 369225-369228, 369230-369236, 369241-369245, 369247-369252, 369255-369258, 369260-369261, 369263-369273, 369275-369276, 369279-369286, 369289-369295, 369298-369300, 369303-369304, 369306, 369308, 369310, 369313-369315, 369319-369320, 369323-369328, 369330-369332, 369334-369337, 369339-369342, 369344, 369347, 369349-369354, 369357-369361, 369363, 369366, 369368, 369370-369371, 369374-369377, 369380-369381, 369383, 369385-369388, 369391, 369393-369399, 369402-369404, 369406, 369409-369416, 369418-369419, 369422-369426, 369428-369429, 369434-369435, 369440, 369443, 369447-369452, 369454-369456, 369458-369462, 369465, 369467, 369469-369470, 369472-369474, 369476-369484, 369486-369488, 369491-369496, 369498-369499, 369501, 369503-369506, 369509, 369512-369515, 369517-369520, 369523-369526, 369531-369532, 369534-369538, 369540-369543, 369546, 369548-369554, 369556-369559, 369563-369565, 369567-369571, 369573-369575, 369577-369579, 369583-369585, 369587, 369591, 369595-369597, 369599-369601, 369603, 369605, 369607, 369610, 369613, 369615-369616, 369618, 369620, 369624-369627, 369629-369630, 369632, 369634, 369636, 369638, 369640-369641, 369643, 369645, 369648, 369650, 369652-369656, 369658-369663, 369665-369673, 369677-369678, 369681-369685, 369691-369692, 369694-369696, 369699-369702, 369704-369712, 369714, 369718-369722, 369724, 369733-369737, 369739, 369741-369742, 369744, 369747-369748, 369750-369751, 369754-369755, 369757, 369759, 369764, 369769, 369773, 369776, 369778-369782, 369785-369788, 369790-369792, 369794-369796, 369798, 369802-369805, 369807-369812, 369814, 369817, 369819-369820, 369824, 369826, 369828, 369830-369833, 369835-369837, 369841-369842, 369844-369849, 369855, 369857, 369859-369861, 369863-369868, 369871-369872, 369874, 369876, 369878-369879, 369881-369882, 369884, 369888-369892, 369897-369898, 369900-369908, 369910-369917, 369921-369924, 369929-369930, 369935, 369939-369940, 369942-369944, 369947, 369949, 369952, 369954, 369957-369958, 369960, 369963, 369965-369966, 369969, 369971-369973, 369976, 369980-369983, 369985, 369987-369988, 369990, 369995-370002, 370004, 370008, 370011-370015, 370021-370024, 370026, 370031, 370033, 370038, 370041-370042, 370045-370046, 370048, 370050, 370052-370053, 370055-370059, 370062, 370067-370068, 370075-370077, 370079-370080, 370084-370093, 370095-370096, 370100, 370104, 370106-370116, 370118-370122, 370125-370126, 370128, 370131, 370133, 370138-370146, 370149-370152, 370154-370156, 370162-370163, 370166-370169, 370171-370172, 370174-370176, 370178-370181, 370183-370189, 370191-370192, 370194-370195, 370197-370198, 370200, 370203-370210, 370213, 370215, 370217-370221, 370224, 370226-370237, 370239-370242, 370244-370250, 370252-370253, 370255-370256, 370258-370269, 370271-370273, 370275, 370277-370278, 370286-370287, 370290-370299, 370306, 370311-370312, 370314-370316, 370318, 370321-370328, 370330-370331, 370333, 370336-370338, 370349, 370353, 370355-370356, 370358, 370360-370363, 370366, 370368-370375, 370378, 370381, 370384-370385, 370388-370394, 370396, 370402-370406, 370408-370409, 370412, 370414, 370419-370420, 370426, 370428-370429, 370431-370432, 370435-370439, 370442, 370444, 370447-370448, 370450-370451, 370453-370460, 370463, 370469, 370473, 370476-370480, 370482-370487, 370492-370494, 370496, 370503-370505, 370507, 370511-370515, 370518, 370521, 370525-370526, 370528, 370530-370531, 370534, 370537-370538, 370540-370542, 370545-370546, 370552-370555, 370557-370560, 370564, 370568-370580, 370585, 370589, 370594, 370601, 370605-370609, 370611, 370613-370621, 370623-370626, 370629, 370631, 370633-370634, 370636-370637, 370640-370641, 370643, 370645-370647, 370649-370651, 370653-370658, 370661-370665, 370670, 370674, 370682, 370685-370692, 370694, 370696-370698, 370705-370706, 370713-370715, 370717-370720, 370722-370725, 370727, 370729-370732, 370736, 370741-370743, 370747-370748, 370750, 370753, 370756, 370759-370761, 370764-370770, 370772, 370774, 370777, 370779-370784, 370786, 370788, 370791, 370793-370794, 370796-370802, 370804-370806, 370808-370811, 370813-370814, 370816, 370821-370823, 370825-370829, 370832, 370834, 370836-370841, 370845-370847, 370849, 370853-370855, 370857-370858, 370860, 370862-370866, 370871, 370874-370875, 370877, 370880, 370882, 370884, 370890-370893, 370896, 370898-370901, 370903, 370905-370906, 370908-370909, 370911, 370914-370918, 370921-370924, 370926, 370928-370929, 370931-370937, 370939, 370941, 370943, 370946-370955, 370963, 370967-370969, 370973-370974, 370977, 370979, 370981-370982, 370984, 370986-370987, 370989, 370991-370992, 370994-370996, 370998-371004, 371007-371008, 371010-371018, 371021, 371024-371042, 371044-371046, 371048-371054, 371056-371057, 371059-371060, 371064-371067, 371069, 371071-371072, 371074-371077, 371079-371082, 371084, 371087-371089, 371091-371092, 371095, 371097-371099, 371105, 371108-371110, 371112, 371114-371117, 371121-371123, 371125-371130, 371132-371135, 371140-371145, 371152-371153, 371160, 371162-371164, 371168, 371170, 371172, 371174-371176, 371178-371182, 371184-371186, 371188, 371196-371197, 371199-371201, 371203, 371205-371209, 371218, 371224, 371226-371232, 371234-371237, 371239, 371245-371246, 371248, 371251-371252, 371256, 371260, 371262-371273, 371275, 371278, 371281-371283, 371285, 371288-371289, 371291-371293, 371298-371299, 371303-371307, 371309, 371313-371316, 371319-371320, 371323, 371328, 371330-371332, 371334-371338, 371340-371341, 371343-371345, 371349, 371352-371353, 371357, 371370-371378, 371380-371382, 371386-371387, 371389-371392, 371394, 371397-371400, 371402, 371404, 371406, 371409, 371416, 371419, 371423-371424, 371426, 371430-371431, 371434-371438, 371441-371443, 371445-371449, 371453-371454, 371457-371461, 371466-371468, 371470-371476, 371478-371479, 371482, 371485, 371487-371489, 371505-371508, 371511-371520, 371522, 371524-371526, 371528-371529, 371531-371533, 371536, 371540, 371542-371543, 371545-371548, 371551-371552, 371555-371557, 371562, 371568-371572, 371574-371575, 371577-371583, 371586-371594, 371596-371597, 371600, 371602, 371606, 371608, 371610, 371613-371614, 371622, 371624-371633, 371635-371637, 371639, 371641-371646, 371649-371653, 371655, 371662, 371666-371667, 371672, 371675, 371678, 371680-371683, 371685-371686, 371690-371697, 371699-371701, 371703-371709, 371711, 371714, 371717, 371719-371722, 371725-371728, 371730-371734, 371736, 371739-371743, 371745, 371748-371752, 371754-371755, 371759-371760, 371765-371774, 371777-371782, 371784, 371786-371804, 371810-371811, 371815, 371818, 371820-371826, 371828-371830, 371832-371838, 371841, 371843-371845, 371847-371849, 371851-371852, 371857-371861, 371863-371864, 371866-371873, 371875-371876, 371878-371884, 371886-371887, 371892, 371894-371895, 371897-371900, 371903-371911, 371913-371916, 371919-371924, 371929-371931, 371933-371935, 371937, 371939, 371942, 371944-371945, 371950, 371952-371958, 371960-371964, 371967-371972, 371974, 371976, 371979, 371982, 371984, 371986-371989, 371991-371992, 371995-371997, 371999-372000, 372002-372006, 372008-372013, 372015, 372017-372021, 372025, 372027-372031, 372034-372039, 372042, 372047-372048, 372051-372058, 372061-372066, 372069, 372071-372079, 372081-372085, 372087, 372089-372090, 372092-372097, 372099, 372101-372107, 372110-372114, 372125, 372128-372131, 372133-372136, 372139-372145, 372147-372149, 372152-372154, 372156-372161, 372165, 372168-372169, 372172-372177, 372179, 372181-372182, 372184-372185, 372190, 372192, 372194-372195, 372197-372201, 372203-372204, 372206-372207, 372211-372216, 372222, 372224, 372228-372229, 372234, 372236, 372238, 372240-372246, 372248-372252, 372254, 372256, 372258-372261, 372263, 372266, 372268-372272, 372276-372282, 372285-372286, 372288, 372290-372291, 372294-372299, 372303-372315, 372317, 372319, 372321-372326, 372328-372334, 372336-372344, 372346-372349, 372352-372353, 372355-372357, 372362-372365, 372367-372369, 372372, 372374, 372376-372380, 372382-372384, 372386-372388, 372390-372401, 372403-372408, 372410-372412, 372414, 372418-372421, 372423-372425, 372427, 372429, 372431-372432, 372434-372440, 372442-372443, 372445, 372447-372449, 372451-372457, 372460, 372463, 372465-372468, 372470-372472, 372480, 372482-372491, 372493, 372496-372497, 372500-372504, 372507, 372510, 372512-372514, 372517-372518, 372520, 372522, 372528-372529, 372532, 372535-372536, 372538, 372543-372544, 372546-372552, 372556-372558, 372560-372562, 372564, 372566-372571, 372574-372575, 372577-372578, 372580, 372582-372583, 372585-372586, 372590, 372593-372595, 372597-372598, 372601-372607, 372609-372614, 372616, 372620, 372622, 372624, 372626-372631, 372633, 372635, 372637, 372642, 372644-372650, 372652-372662, 372666, 372668-372669, 372671-372674, 372676-372681, 372683, 372688, 372691-372694, 372697-372698, 372700-372704, 372706-372709, 372711-372713, 372718-372719, 372721-372722, 372724, 372726, 372728-372729, 372731-372732, 372736, 372738-372745, 372748-372760, 372762, 372765, 372767-372768, 372771-372787, 372790-372792, 372795-372797, 372800-372810, 372813-372819, 372821, 372824, 372826, 372828, 372831-372832, 372835-372836, 372838-372841, 372843-372845, 372849-372852, 372854-372856, 372860, 372863-372864, 372866, 372868-372869, 372871-372874, 372876, 372879-372882, 372884-372885, 372887-372889, 372892-372893, 372902-372909, 372912-372914, 372917-372919, 372923-372932, 372934-372935, 372937, 372939, 372942-372945, 372947, 372950-372952, 372955-372960, 372962-372966, 372968-372971, 372974, 372977, 372979-372983, 372986-372989, 372991-372992, 372994, 372996, 372998, 373002-373003, 373006-373010, 373013-373015, 373019-373024, 373026-373028, 373030-373033, 373035-373036, 373039, 373043-373062, 373066-373068, 373070-373072, 373075-373089, 373091-373092, 373094-373100, 373102-373103, 373105-373110, 373114, 373116-373122, 373125-373128, 373130, 373133-373137, 373139, 373141, 373149-373153, 373155, 373157, 373159-373166, 373171, 373174-373177, 373179, 373182-373184, 373188-373191, 373193-373196, 373198-373202, 373205-373208, 373210-373213, 373217-373219, 373221, 373223-373232, 373234-373237, 373239, 373241-373242, 373244-373247, 373249-373250, 373252-373255, 373257-373260, 373262-373268, 373270, 373272, 373274-373281, 373283-373284, 373286-373288, 373291, 373293, 373295, 373301-373303, 373305-373307, 373309-373310, 373312-373313, 373315-373319, 373321-373325, 373327, 373331-373351, 373353, 373356-373366, 373368-373370, 373373, 373375-373382, 373385-373388, 373390-373392, 373394-373400, 373402-373410, 373414-373416, 373418-373423, 373425, 373428, 373431, 373433-373437, 373440-373443, 373446, 373451, 373455, 373457-373459, 373461, 373463-373469, 373471-373473, 373475, 373477-373478, 373482, 373484-373485, 373487, 373489, 373491, 373494-373497, 373501-373508, 373510-373513, 373516-373523, 373527-373532, 373535-373536, 373538-373545, 373548-373552, 373554-373558, 373560, 373564-373567, 373570, 373572-373573, 373577, 373580, 373582, 373584-373586, 373589, 373591, 373593, 373595, 373599, 373603-373605, 373607-373608, 373610-373612, 373614-373617, 373619-373620, 373622, 373624-373628, 373631-373641, 373646-373647, 373649, 373652-373653, 373655-373656, 373659-373663, 373666-373669, 373671, 373674-373677, 373679-373686, 373689-373691, 373693, 373696-373701, 373707, 373710-373711, 373714-373715, 373718, 373720-373727, 373729-373730, 373732-373739, 373741, 373743-373752, 373755-373762, 373764-373767, 373769, 373772, 373774, 373779, 373783-373785, 373787-373788, 373793-373794, 373799, 373802, 373804-373806, 373808, 373811-373817, 373826, 373828-373833, 373835, 373838-373839, 373846-373847, 373849-373850, 373853-373860, 373862-373864, 373867-373868, 373870, 373872, 373877, 373879-373880, 373882-373889, 373892-373898, 373900-373905, 373909, 373912-373917, 373920-373923, 373925, 373929-373930, 373932, 373935-373937, 373940-373943, 373946-373949, 373951-373952, 373956-373963, 373965-373976, 373978, 373980-373989, 373992, 373994-373996, 373999-374003, 374005-374007, 374011-374012, 374017, 374019, 374025-374026, 374028-374033, 374036, 374042-374044, 374046, 374049-374054, 374058-374059, 374063, 374068-374070, 374074-374075, 374077-374081, 374083, 374085-374086, 374088, 374091-374093, 374096, 374098-374100, 374102-374103, 374105, 374108, 374110-374111, 374113-374115, 374117-374118, 374122, 374125-374130, 374132-374133, 374136-374138, 374140-374146, 374149, 374151-374152, 374157-374158, 374160-374162, 374164-374165, 374167, 374172-374175, 374177, 374180-374182, 374184, 374188-374192, 374197, 374199-374201, 374203, 374205-374210, 374212-374214, 374216, 374218, 374220, 374223-374229, 374231, 374233-374236, 374239, 374242-374243, 374248, 374251-374253, 374256, 374258-374259, 374261, 374263-374266, 374268-374269, 374272-374273, 374278-374281, 374283-374285, 374287-374291, 374293-374299, 374301-374302, 374307-374309, 374311, 374313-374316, 374319, 374322-374324, 374326-374328, 374330-374337, 374339, 374341, 374343, 374346, 374348-374349, 374351, 374355-374357, 374360-374362, 374364-374379, 374381, 374384-374386, 374388, 374390-374393, 374395, 374397-374401, 374405-374407, 374409-374413, 374415, 374417-374422, 374424-374425, 374428-374438, 374440-374442, 374444-374445, 374447-374452, 374456-374457, 374462-374464, 374466-374468, 374470, 374474, 374477-374483, 374486-374488, 374490-374491, 374493-374495, 374499-374500, 374502-374504, 374506, 374511-374512, 374514-374515, 374517-374519, 374521-374527, 374529, 374532-374536, 374538-374548, 374551-374556, 374558, 374560, 374563, 374566-374567, 374571, 374573-374576, 374578-374588, 374590-374594, 374596, 374598, 374601-374602, 374605, 374607, 374609, 374612-374616, 374618-374620, 374623-374624, 374626-374627, 374632-374638, 374640-374648, 374651, 374653-374655, 374657-374659, 374661, 374664, 374667-374668, 374671, 374673-374677, 374679-374682, 374684, 374686, 374688-374689, 374692, 374694-374697, 374699-374702, 374705-374707, 374709-374712, 374714-374719, 374722, 374725-374728, 374731-374732, 374734, 374736, 374738-374739, 374741, 374745, 374747-374748, 374751, 374759-374769, 374771-374774, 374777-374782, 374786, 374788, 374793, 374795, 374797-374810, 374815, 374821, 374823-374824, 374826-374847, 374850-374851, 374853-374855, 374863, 374866-374869, 374871-374875, 374879-374882, 374885, 374888-374894, 374896, 374898-374900, 374902, 374904-374909, 374911-374915, 374917-374919, 374921-374923, 374925-374927, 374930-374941, 374944-374951, 374954-374955, 374957-374960, 374962-374981, 374983-374985, 374988-374993, 374995-374997, 375001-375005, 375008-375013, 375015-375016, 375018, 375021-375027, 375029-375041, 375044, 375046-375047, 375049, 375051, 375053-375056, 375059, 375061, 375063-375066, 375068-375069, 375072-375073, 375075-375076, 375078-375081, 375083-375088, 375090-375092, 375094-375098, 375100, 375102, 375105-375109, 375111, 375115-375119, 375121-375122, 375124, 375126, 375128-375129, 375131-

375136, 375138-375139, 375142-375148, 375155, 375157, 375159-375167, 375170-375171, 375174-375175, 375177-375183, 375185, 375187-375189, 375195, 375204-375206, 375208-375211, 375213-375218, 375221-375226, 375228-375235, 375237, 375240-375245, 375247-375250, 375252-375256, 375260, 375262-375265, 375270-375271, 375274-375276, 375278-375279, 375282-375283, 375285, 375289, 375292-375293, 375295-375307, 375310-375322, 375324-375330, 375332-375333, 375335-375340, 375344-375348, 375357-375364, 375366-375371, 375373-375374, 375376, 375381-375384, 375386, 375389, 375392-375395, 375397-375398, 375400, 375402-375404, 375406-375408, 375410, 375412-375416, 375420-375421, 375423, 375425, 375427-375430, 375432-375434, 375437-375440, 375443-375445, 375447-375449, 375451, 375453, 375456-375457, 375459, 375463, 375465-375472, 375474-375476, 375478-375479, 375482-375492, 375495-375497, 375501, 375503, 375505-375510, 375512-375514, 375517-375519, 375521, 375523-375528, 375530, 375532-375533, 375535-375538, 375542, 375544-375545, 375548-375551, 375555-375561, 375563, 375565-375566, 375569, 375574-375575, 375577, 375579-375580, 375582-375585, 375587-375589, 375591-375597, 375599, 375601-375604, 375606-375608, 375610, 375612-375618, 375621-375622, 375625-375629, 375631, 375633-375646, 375650, 375652-375657, 375659-375663, 375665, 375667, 375669, 375671-375677, 375682-375687, 375690, 375692, 375694-375696, 375698, 375700, 375702, 375704, 375706-375708, 375711-375712, 375718, 375720-375721, 375727-375729, 375731, 375733-375737, 375740-375743, 375745-375747, 375749-375753, 375757-375758, 375760-375763, 375765, 375769, 375771, 375773-375777, 375779, 375781, 375783-375784, 375786-375798, 375800-375802, 375805-375808, 375810-375812, 375817-375820, 375822, 375824, 375826-375827, 375831, 375834-375838, 375840-375845, 375847-375848, 375850-375858, 375860-375861, 375863, 375865-375867, 375869-375871, 375873-375874, 375876-375877, 375879, 375881, 375884-375890, 375892-375894, 375897-375905, 375908-375910, 375912, 375914, 375916-375917, 375919-375926, 375928-375929, 375931-375932, 375935, 375938, 375941-375944, 375949, 375951-375956, 375958-375959, 375961-375968, 375972-375973, 375979, 375983, 375986-375991, 375993-375999, 376001, 376003, 376006, 376008-376010, 376014, 376016, 376019-376020, 376022, 376030, 376034, 376037-376038, 376045, 376048-376049, 376051-376053, 376062-376063, 376067-376068, 376070, 376072-376073, 376075, 376077, 376083, 376085-376088, 376091-376093, 376098-376101, 376104, 376106-376108, 376111, 376113-376114, 376117, 376119-376122, 376127-376129, 376134, 376137-376138, 376140, 376143-376145, 376148, 376151-376152, 376160-376161, 376163-376166, 376168, 376172-376173, 376178-376180, 376182-376184, 376186-376187, 376190, 376192-376193, 376196, 376198-376201, 376203, 376206, 376208-376209, 376211-376212, 376222-376223, 376225, 376228-376230, 376233, 376235, 376239, 376241, 376245, 376254, 376257, 376261, 376263, 376266, 376268-376269, 376272, 376275, 376277, 376279-376284, 376286-376287, 376290-376293, 376295-376301, 376303-376307, 376309-376312, 376314-376333, 376335-376337, 376339-376346, 376349-376351, 376353-376354, 376356-376358, 376360, 376362-376363, 376366, 376368-376374, 376376-376377, 376379, 376381-376385, 376390-376391, 376393-376394, 376398, 376401-376402, 376404-376405, 376408-376411, 376413-376414, 376418, 376420-376421, 376423-376424, 376428-376431, 376433, 376436, 376438-376444, 376446, 376449-376450, 376452-376453, 376457, 376459, 376461-376462, 376465, 376467, 376469, 376471-376480, 376483, 376485-376487, 376489, 376493, 376496-376499, 376501, 376505-376507, 376511-376519, 376522-376526, 376528-376534, 376539, 376541-376546, 376549, 376551-376552, 376554-376557, 376560, 376562, 376564, 376566-376567, 376572, 376574, 376576-376582, 376587, 376594, 376596-376598, 376600, 376602-376605, 376607, 376610-376611, 376613-376616, 376618-376623, 376625-376629, 376631-376633, 376635-376639, 376641-376648, 376650-376656, 376660-376664, 376667, 376671-376675, 376678-376685, 376687, 376693, 376696-376697, 376699, 376702-376703, 376707, 376710-376712, 376716-376718, 376720-376727, 376729-376735, 376737-376739, 376741-376744, 376747, 376750-376754, 376756-376759, 376761-376765, 376767, 376770-376773, 376775-376777, 376780-376787, 376790, 376792-376793, 376795-376801, 376803-376806, 376810-376812, 376814-376820, 376823-376826, 376828-376830, 376832-376834, 376837, 376839-376842, 376844, 376851, 376853-376859, 376862-376867, 376872-376875, 376878-376883, 376885-376888, 376890, 376892-376894, 376897-376899, 376901-376903, 376905-376906, 376909-376912, 376915-376918, 376920, 376922-376924, 376927, 376929-376934, 376937, 376939-376942, 376944-376947, 376949, 376951-376953, 376956-376957, 376959-376960, 376962-376967, 376969-376970, 376972-376973, 376981-376988, 376990-376992, 376995-376996, 376999, 377005-377008, 377011-377014, 377016-377019, 377023-377024, 377026-377041, 377044-377045, 377047, 377050, 377058-377060, 377062-377063, 377065, 377067-377068, 377072-377078, 377081-377088, 377090, 377094-377095, 377097-377098, 377100, 377103-377107, 377110-377112, 377114-377116, 377120, 377122, 377125, 377129, 377131-377132, 377134-377135, 377138, 377140, 377142, 377144-377146, 377148, 377154-377157, 377159, 377161-377167, 377169, 377172, 377174-377175, 377178-377183, 377185-377187, 377189, 377191-377192, 377195-377198, 377200-377203, 377208-377214, 377216, 377218-377220, 377222, 377224-377228, 377230, 377232-377234, 377245-377252, 377254-377261, 377263-377265, 377268-377269, 377271-377273, 377275-377276, 377278-377284, 377287-377289, 377291, 377293-377295, 377297-377299, 377301-377305, 377307-377311, 377313-377323, 377326-377330, 377332-377334, 377336-377337, 377340-377341, 377343, 377345-377346, 377348, 377350-377351, 377353-377354, 377356-377357, 377360-377368, 377370-377374, 377376, 377379-377384, 377386-377388, 377390-377395, 377397-377410, 377412, 377414, 377419, 377421, 377424, 377427, 377430-377431, 377433-377434, 377439-377440, 377444, 377446, 377448-377453, 377456-377457, 377459-377470, 377473, 377475-377476, 377478-377480, 377482, 377484, 377486-377487, 377490-377492, 377497-377498, 377501, 377504-377507, 377509, 377512, 377515-377518, 377520-377523, 377527-377532, 377534-377535, 377537-377539, 377543-377545, 377547-377549, 377551-377553, 377555-377559, 377561-377571, 377573-377580, 377582-377585, 377587-377589, 377591-377592, 377594, 377601-377610, 377612, 377614, 377618-377620, 377622, 377624-377629, 377631-377641, 377643-377651, 377654, 377656, 377659, 377661-377665, 377668-377682, 377684, 377687-377691, 377694-377697, 377699, 377703-377708, 377710-377713, 377716-377722, 377727-377730, 377732-377736, 377738, 377740-377745, 377747, 377749, 377754-377755, 377757-377758, 377760, 377762, 377767-377770, 377772-377776, 377778-377788, 377791, 377793-377794, 377798-377802, 377804, 377806, 377809, 377813-377818, 377820, 377822-377824, 377826, 377828, 377834-377835, 377837-377840, 377842-377849, 377851-377854, 377856, 377858-377863, 377867-377871, 377873, 377876, 377881-377884, 377886, 377888, 377892-377899, 377901-377902, 377904-377905, 377907, 377909-377910, 377913, 377915-377917, 377919, 377923, 377925, 377927, 377929-377932, 377934-377935, 377938, 377940-377942, 377944-377946, 377949-377951, 377953-377955, 377957-377958, 377962-377963, 377965, 377972, 377974, 377976-377983, 377986-377998, 378000-378002, 378005, 378007, 378009-378010, 378013-378015, 378018, 378020, 378023-378032, 378034-378036, 378039-378045, 378047-378048, 378050-378051, 378054-378055, 378057-378058, 378060, 378063, 378065-378071, 378073-378075, 378077-378080, 378082-378085, 378089-378090, 378094, 378096-378098, 378101-378106, 378109-378113, 378118-378120, 378124-378126, 378128, 378133-378134, 378136, 378138, 378140-378150, 378152-378159, 378161, 378164-378168, 378171, 378174-378176, 378178-378181, 378183-378189, 378191, 378193, 378196-378204, 378207-378217, 378219-378221, 378223, 378225-378226, 378229-378230, 378232-378238, 378244-378247, 378249-378257, 378259, 378261, 378264, 378268-378271, 378275, 378278-378279, 378282, 378284-378285, 378287, 378289, 378292, 378294-378295, 378297-378298, 378300, 378303, 378305-378307, 378309, 378311-378318, 378320-378321, 378323, 378325-378332, 378336-378337, 378339-378341, 378343-378349, 378351-378357, 378359, 378361-378364, 378366, 378368-378369, 378371-378377, 378379-378382, 378385-378386, 378388-378391, 378393, 378395, 378400-378403, 378405, 378407-378411, 378420, 378423-378425, 378427, 378429, 378431, 378436, 378438-378439, 378442-378448, 378450-378464, 378467, 378469-378471, 378473-378474, 378478-378479, 378488-378492, 378495-378498, 378500-378507, 378509, 378515-378517, 378520-378522, 378524-378529, 378536-378539, 378542-378543, 378545, 378547, 378549-378553, 378557, 378559, 378561-378567, 378569-378571, 378573-378574, 378576-378578, 378580-378583, 378585-378588, 378590, 378592-378596, 378598-378604, 378607-378609, 378611-378616, 378618-378622, 378624, 378627-378638, 378640-378649, 378651, 378654-378659, 378662-378666, 378670-378678, 378680, 378686-378687, 378689-378690, 378693-378696, 378698-378700, 378702-378706, 378708-378709, 378714-378715, 378717, 378721-378722, 378725-378727, 378730, 378732-378733, 378735-378738, 378743, 378745-378748, 378754, 378759-378771, 378773-378783, 378786, 378788-378792, 378794-378797, 378799-378801, 378804-378805, 378807-378810, 378812-378822, 378825, 378828-378834, 378836-378840, 378842, 378844, 378847-378848, 378850-378851, 378853-378856, 378859-378861, 378863-378865, 378867-378868, 378870, 378872-378880, 378882-378886, 378888-378892, 378894, 378896, 378900-378901, 378903-378908, 378910-378911, 378914-378915, 378918-378928, 378930, 378933-378934, 378937-378938, 378940-378943, 378945-378946, 378948-378951, 378953, 378956-378963, 378965-378966, 378968, 378970-378973, 378976, 378978, 378980, 378982-378988, 378990-378993, 378995, 378997-378999, 379001-379002, 379004, 379006-379011, 379014, 379016-379017, 379019-379021, 379024, 379030-379034, 379036-379037, 379039-379042, 379044-379047, 379049-379050, 379052-379059, 379064, 379066-379067, 379069, 379073-379078, 379081, 379083-379086, 379088-379090, 379092-379094, 379096-379104, 379106-379109, 379111, 379114, 379116, 379118-379119, 379121-379124, 379126-379127, 379129-379133, 379137-379138, 379140, 379143-379146, 379148-379155, 379158, 379160-379163, 379167-379168, 379170-379177, 379179-379182, 379184-379185, 379188-379194, 379196-379201, 379204-379207, 379209-379215, 379218-379220, 379222, 379226, 379230-379236, 379238-379239, 379241-379243, 379247, 379250-379263, 379265-379268, 379270-379271, 379273-379274, 379276-379286, 379288-379290, 379294-379301, 379303-379304, 379307, 379309-379316, 379318-379320, 379322-379329, 379332-379334, 379336-379337, 379340-379342, 379344-379355, 379357, 379360-379361, 379364-379368, 379371-379373, 379375-379379, 379381, 379383-379384, 379386-379387, 379396-379398, 379400-379404, 379407-379408, 379410-379412, 379420-379421, 379425-379426, 379428, 379431-379434, 379436, 379438-379440, 379442-379443, 379445-379450, 379452, 379456-379457, 379459-379460, 379467-379468, 379470-379471, 379474-379482, 379484, 379486-379490, 379492-379493, 379495-379497, 379499-379506, 379508, 379511-379513, 379515-379518, 379520-379525, 379528-379529, 379535-379536, 379539-379541, 379543-379544, 379546, 379548-379549, 379551, 379556, 379558-379564, 379567, 379569-379575, 379578, 379580-379581, 379583, 379586, 379588, 379591-379598, 379600-379601, 379603, 379605-379611, 379613-379615, 379617-379620, 379622-379626, 379629-379635, 379637, 379641-379645, 379648-379651, 379656-379663, 379665-379668, 379670, 379678-379679, 379683-379685, 379687-379688, 379692-379693, 379695-379698, 379700-379701, 379703-379712, 379714, 379716-379717, 379719, 379722, 379724-379732, 379734, 379737, 379742-379743, 379746, 379748-379754, 379756-379757, 379762-379769, 379772-379778, 379780-379782, 379784-379786, 379788-379792, 379795, 379799, 379801, 379803-379808, 379810, 379817-379820, 379822, 379828-379829, 379831-379832, 379834-379836, 379838, 379840-379842, 379845-379846, 379850-379853, 379855-379857, 379859-379862, 379865-379868, 379872-379873, 379876, 379878, 379881-379882, 379885-379886, 379890, 379892, 379894-379897, 379904, 379907, 379910-379911, 379913, 379915-379919, 379921-379922, 379925-379927, 379931, 379933-379934, 379938, 379941, 379943, 379945-379953, 379956-379963, 379965-379969, 379972-379974, 379976-379978, 379980-379981, 379983-379984, 379986-379988, 379990-379992, 379994, 379996, 379998, 380001, 380003, 380005, 380009-380012, 380015-380016, 380020-380021, 380025, 380028, 380030-380034, 380036-380040, 380046-380047, 380050-380054, 380057-380058, 380061-380063, 380065-380070, 380072-380073, 380075-380076, 380078-380079, 380081, 380087, 380089-380091, 380093-380095, 380097, 380100-380102, 380105-380106, 380108-380110, 380113, 380115-380117, 380119-380121, 380124, 380126, 380128, 380130-380134, 380136, 380140, 380142-380143, 380146, 380150-380151, 380153-380155, 380157-380159, 380161, 380163-380166, 380169, 380172, 380174-380176, 380178-380179, 380182, 380186, 380189-380196, 380198-380199, 380201-380206, 380208, 380210, 380217-380221, 380223, 380225, 380227, 380231-380234, 380239-380241, 380243, 380245, 380247, 380250-380252, 380254-380256, 380258-380259, 380262-380263, 380266-380269, 380273-380282, 380286, 380289-380290, 380292-380293, 380296-380297, 380299, 380301-380302, 380305-380306, 380308-380311, 380313-380314, 380316-380317, 380321, 380323-380324, 380328, 380330-380333, 380335-380336, 380339, 380341, 380344, 380346-380349, 380351, 380353-380354, 380356, 380358-380362, 380366, 380368-380370, 380373-380374, 380376-380379, 380381-380384, 380387-380391, 380394, 380397-380401, 380403-380404, 380407, 380411-380419, 380421-380428, 380430, 380432, 380434-380435, 380438, 380440-380443, 380447-380449, 380452-380453, 380455-380459, 380461-380462, 380465, 380468-380474, 380476, 380479-380481, 380484-380486, 380488-380493, 380495, 380497-380510, 380514-380515, 380517-380522, 380525-380526, 380528-380529, 380532, 380534-380539, 380542-380545, 380548, 380550-380552, 380556, 380558-380559, 380562-380564, 380567-380570, 380574, 380577-

380584, 380588-380589, 380592, 380594, 380599, 380602-380609, 380611-380617, 380620, 380622-380632, 380634-380638, 380640-380650, 380658, 380660, 380662-380663, 380665-380666, 380668, 380672, 380674-380686, 380688, 380690, 380693-380698, 380705, 380707-380708, 380710-380714, 380716-380719, 380722, 380727, 380729, 380731-380732, 380734, 380737-380739, 380741-380747, 380749-380751, 380763, 380765-380766, 380771-380777, 380779-380781, 380783, 380785, 380787-380791, 380794, 380799-380801, 380803-380805, 380812, 380818, 380822-380825, 380827-380828, 380832-380835, 380837-380840, 380842-380846, 380850-380853, 380855-380856, 380858-380860, 380864-380866, 380868-380872, 380874, 380876-380877, 380880-380881, 380885-380889, 380891-380892, 380894-380896, 380898-380899, 380901-380905, 380908-380910, 380913-380918, 380921-380922, 380924-380927, 380929-380930, 380932, 380934, 380936-380937, 380939-380941, 380943-380947, 380951-380955, 380957-380962, 380964-380965, 380967, 380969-380971, 380975-380976, 380978-380981, 380983-380984, 380986-380988, 380990, 380994, 380998, 381000, 381002-381007, 381009-381012, 381016-381018, 381020, 381023, 381025-381031, 381033, 381036-381037, 381039-381042, 381046-381053, 381060-381072, 381076-381079, 381081, 381085-381092, 381094-381096, 381099-381100, 381102-381103, 381106-381107, 381109-381115, 381117-381126, 381129, 381132-381133, 381135, 381137, 381139-381141, 381143-381146, 381148-381149, 381152, 381154-381156, 381165-381168, 381171-381173, 381175, 381179, 381181-381184, 381187-381190, 381192, 381194, 381198-381199, 381201-381202, 381205-381211, 381214, 381219-381221, 381225, 381227-381229, 381233, 381237-381238, 381240-381244, 381246-381247, 381249-381251, 381253-381256, 381263, 381265-381268, 381271-381275, 381278-381279, 381281, 381283, 381286-381296, 381301, 381305, 381307-381309, 381315-381317, 381321, 381324-381325, 381327-381329, 381331-381332, 381334-381335, 381341-381344, 381351-381353, 381355-381356, 381359-381360, 381367, 381369-381371, 381373, 381377-381378, 381380, 381384-381386, 381389-381394, 381404, 381407, 381410-381419, 381424, 381427, 381433-381435, 381437-381450, 381454-381456, 381458-381461, 381464, 381467-381468, 381470-381472, 381475, 381477-381478, 381483-381489, 381491-381498, 381501-381503, 381505-381506, 381509-381510, 381512, 381514-381515, 381517, 381520-381521, 381525-381530, 381532-381533, 381535-381538, 381540, 381544-381546, 381549-381552, 381558, 381560-381561, 381565-381566, 381568, 381571-381574, 381576, 381578-381583, 381587, 381589-381591, 381593-381595, 381598-381599, 381602-381604, 381607-381609, 381613-381615, 381617, 381620, 381623-381626, 381630-381631, 381633-381635, 381638-381642, 381647, 381649-381651, 381653-381654, 381656-381657, 381659-381660, 381664, 381666-381667, 381669, 381671-381672, 381675, 381677-381679, 381681, 381683-381684, 381686-381691, 381694-381695, 381698, 381700, 381703-381704, 381707-381708, 381711-381716, 381720, 381724-381727, 381729-381733, 381735, 381738, 381740-381742, 381744-381745, 381749, 381754-381755, 381757, 381760-381766, 381768, 381771-381774, 381780-381781, 381785, 381788-381791, 381794-381796, 381800-381803, 381805-381810, 381814, 381817, 381819-381827, 381829-381844, 381846-381851, 381853-381855, 381861-381864, 381866-381868, 381870-381873, 381875, 381881, 381883-381901, 381903-381909, 381911-381920, 381922, 381924-381927, 381929-381939, 381941-381942, 381944, 381947, 381949-381954, 381956-381962, 381964, 381967-381969, 381972-381974, 381976-381977, 381979-381981, 381983, 381986-381998, 382001, 382003-382010, 382016-382019, 382021-382025, 382028, 382032, 382035, 382037, 382039-382040, 382043-382046, 382048-382049, 382053, 382056-382058, 382063-382070, 382072, 382074, 382077-382091, 382094, 382096-382102, 382105, 382107-382109, 382111, 382113-382119, 382121, 382125, 382131-382135, 382139, 382143-382144, 382146-382147, 382150-382152, 382154-382158, 382161-382164, 382166-382175, 382177-382178, 382183, 382185-382186, 382188, 382190-382197, 382200-382202, 382204, 382206, 382208, 382212-382218, 382220, 382222, 382224-382225, 382227, 382229-382235, 382237, 382239, 382241, 382245-382247, 382250, 382252-382254, 382257-382261, 382264-382266, 382269, 382272, 382274-382278, 382281, 382283-382287, 382290, 382293, 382295-382298, 382300-382304, 382307-382311, 382313-382314, 382317-382319, 382321-382322, 382324-382325, 382328, 382336, 382339-382343, 382346, 382350-382353, 382355-382356, 382358-382361, 382364, 382366-382367, 382369-382370, 382375-382377, 382379-382380, 382383, 382385, 382390-382392, 382395, 382400-382408, 382417-382427, 382429, 382432, 382434-382442, 382444-382445, 382447-382452, 382454-382455, 382457-382463, 382465-382466, 382471, 382473-382474, 382476, 382478, 382480, 382482, 382485-382487, 382489, 382491-382492, 382494-382500, 382504-382505, 382508-382509, 382511-382516, 382518-382519, 382522, 382525-382527, 382529, 382532, 382534, 382536, 382538-382540, 382542, 382544, 382547-382548, 382550-382551, 382554-382563, 382566-382571, 382573, 382575, 382581-382584, 382588, 382591, 382594, 382597-382598, 382601-382602, 382604, 382606-382609, 382611-382615, 382617-382618, 382620-382626, 382628, 382630, 382632, 382634-382646, 382648-382651, 382660-382663, 382665, 382669-382671, 382673-382674, 382678-382680, 382682-382684, 382688-382689, 382692-382694, 382697-382699, 382701, 382704, 382706, 382709-382712, 382715-382716, 382722-382726, 382730-382733, 382735-382740, 382742-382743, 382746-382748, 382750-382753, 382755-382758, 382760, 382764-382768, 382770-382771, 382775-382777, 382779-382782, 382784, 382786, 382788-382795, 382797, 382801, 382803-382805, 382807, 382810, 382820, 382824-382825, 382828-382832, 382834-382840, 382842-382848, 382850-382856, 382858-382860, 382863, 382865-382868, 382871-382875, 382877, 382879-382883, 382885-382886, 382889-382892, 382894, 382896-382897, 382902-382903, 382905-382906, 382908-382910, 382912, 382915-382917, 382919, 382921-382922, 382924-382925, 382928, 382930, 382932, 382934-382935, 382937-382946, 382949-382956, 382958-382959, 382961-382963, 382965-382966, 382968-382972, 382974-382975, 382977-382985, 382987-382990, 382993-382996, 382998-382999, 383003, 383005-383007, 383010, 383013, 383015-383016, 383018, 383020-383032, 383035-383038, 383041-383043, 383046-383049, 383054-383055, 383057, 383061, 383063-383065, 383067, 383069-383070, 383073-383075, 383077, 383079, 383082-383083, 383085, 383092-383094, 383097-383098, 383104, 383110-383112, 383114, 383117-383121, 383123, 383125-383130, 383134, 383137, 383140, 383146-383147, 383154, 383158-383162, 383165, 383167-383169, 383172, 383174-383176, 383178-383187, 383192-383194, 383196, 383198, 383202-383204, 383208, 383213-383215, 383217, 383222-383224, 383226-383227, 383230-383231, 383233-383237, 383240, 383244-383254, 383256-383257, 383259, 383262, 383265-383267, 383269, 383271-383272, 383276-383282, 383285-383286, 383288-383293, 383295-383302, 383304-383307, 383309-383311, 383313-383315, 383318-383319, 383322-383324, 383327-383334, 383339-383340, 383344-383345, 383347-383352, 383354, 383359-383369, 383371, 383373-383374, 383376-

383380, 383382, 383384, 383386, 383391-383394, 383397-383398, 383401-383402, 383404-383406, 383411-383412, 383415-383423, 383427, 383429-383430, 383432-383434, 383436, 383438, 383441, 383443-383452, 383454-383457, 383459, 383461-383477, 383483-383485, 383487, 383489, 383493, 383497, 383499, 383501-383504, 383506-383507, 383512-383514, 383516-383518, 383520-383522, 383526-383527, 383529, 383531-383532, 383535-383536, 383540-383553, 383555, 383559-383563, 383566-383568, 383570, 383572-383575, 383577-383579, 383582, 383584-383590, 383592, 383594-383599, 383601, 383604, 383606, 383609-383613, 383615, 383617-383622, 383624-383625, 383627-383628, 383631-383635, 383638, 383641, 383648, 383650-383656, 383658, 383660, 383663-383664, 383666-383681, 383683-383685, 383687-383688, 383690-383698, 383701-383705, 383711-383713, 383717, 383726, 383728-383729, 383731-383733, 383735-383736, 383739-383744, 383746-383749, 383751-383753, 383755-383756, 383760, 383762, 383764-383767, 383770-383772, 383774-383775, 383777-383782, 383786-383792, 383795, 383798-383799, 383801-383809, 383811-383818, 383820-383825, 383827-383828, 383830, 383832-383837, 383839-383843, 383846, 383849-383860, 383862, 383866-383867, 383869, 383874, 383879-383882, 383884-383892, 383894-383898, 383900, 383903, 383905, 383907-383915, 383917-383918, 383921, 383923-383925, 383927-383934, 383936-383937, 383939-383942, 383944-383947, 383950-383955, 383957-383958, 383960-383963, 383965-383967, 383971, 383974, 383976-383979, 383983-383987, 383989-383990, 383992-384002, 384005-384008, 384010, 384012, 384014-384016, 384018, 384026-384030, 384032-384035, 384037, 384039-384046, 384048, 384051-384054, 384056-384067, 384070-384071, 384073-384074, 384079, 384082, 384084-384085, 384088-384092, 384094-384096, 384098-384100, 384103-384112, 384115-384116, 384118, 384120-384123, 384128-384130, 384132, 384134, 384136-384139, 384141, 384143-384145, 384147-384150, 384152-384154, 384156-384157, 384159-384163, 384166-384168, 384170-384177, 384179, 384181-384184, 384186, 384188, 384192, 384196, 384198-384204, 384207-384212, 384214, 384218-384227, 384229, 384231-384234, 384238-384239, 384241-384246, 384248, 384250-384255, 384257, 384259-384261, 384263-384264, 384266, 384268-384272, 384274-384275, 384277-384280, 384282, 384284-384285, 384289, 384291-384292, 384294, 384296, 384298-384300, 384303-384306, 384308-384309, 384313-384316, 384318-384322, 384325-384327, 384329-384330, 384332, 384338-384342, 384344, 384346, 384348-384352, 384354-384355, 384358-384361, 384364-384373, 384375-384379, 384382-384383, 384386-384389, 384393-384394, 384397, 384399, 384401, 384403, 384405, 384407, 384410, 384412-384413, 384416-384420, 384422, 384424, 384429-384432, 384438, 384440-384443, 384446-384448, 384450-384452, 384454-384457, 384459, 384461-384462, 384464-384467, 384470-384473, 384475-384478, 384480, 384482, 384485-384488, 384493, 384495-384497, 384499-384507, 384509-384511, 384513-384516, 384518-384521, 384523-384525, 384527-384528, 384531-384532, 384535, 384541-384542, 384544-384545, 384547-384548, 384552-384553, 384556-384558, 384560, 384563, 384565-384567, 384572, 384574-384578, 384580-384582, 384585, 384587-384588, 384590-384591, 384593, 384595-384598, 384600-384601, 384603-384604, 384608-384613, 384617, 384620-384624, 384626-384632, 384634, 384637, 384639-384640, 384642-384646, 384650-384654, 384657, 384659-384662, 384664, 384668-384669, 384671, 384674, 384676, 384679, 384683-384686, 384689-384691, 384693-384695, 384697-384709, 384711-384720, 384722-384726, 384732-384734, 384736-384737, 384739-384743, 384745, 384747-384754, 384756, 384759-384763, 384766, 384771, 384777-384781, 384786-384789, 384792-384795, 384798-384802, 384807, 384812-384814, 384817-384821, 384823-384828, 384832, 384836, 384838-384842, 384844-384845, 384848-384849, 384852, 384856-384859, 384861-384862, 384864-384865, 384867, 384869, 384871-384874, 384877-384880, 384884, 384886, 384888, 384890, 384892-384894, 384897, 384899, 384901-384904, 384906-384909, 384911-384912, 384919-384920, 384922, 384926, 384931-384937, 384939, 384941, 384946-384948, 384950, 384954-384956, 384958, 384961-384964, 384967-384968, 384971, 384973-384974, 384977-384979, 384984-384986, 384988-384993, 384995-384996, 384998-384999, 385002-385007, 385009-385011, 385013-385014, 385017-385030, 385033-385039, 385041-385043, 385045, 385047-385048, 385051-385053, 385055-385056, 385058-385067, 385069-385074, 385076-385083, 385085-385093, 385096-385098, 385100-385103, 385105-385107, 385110-385120, 385122-385123, 385125-385133, 385135-385136, 385138, 385140-385146, 385149-385152, 385156, 385158-385160, 385163-385174, 385177, 385180-385184, 385188, 385190-385192, 385194-385196, 385198-385206, 385209-385222, 385225, 385227-385234, 385236-385238, 385240-385242, 385244, 385247, 385249, 385252, 385255-385256, 385258, 385261, 385263-385265, 385267-385268, 385270-385271, 385274-385275, 385277, 385279, 385281-385284, 385286-385287, 385289, 385291-385299, 385303-385304, 385307, 385311, 385314-385317, 385320-385322, 385324-385326, 385328-385335, 385337-385340, 385342, 385344-385345, 385347, 385349, 385351, 385353-385356, 385358-385362, 385364, 385366-385367, 385369-385376, 385378, 385380-385382, 385385-385388, 385390, 385393, 385395-385397, 385399, 385401-385402, 385405-385409, 385415-385425, 385428-385429, 385431-385432, 385434-385435, 385437-385448, 385450-385451, 385453, 385455, 385464-385465, 385468-385469, 385471-385472, 385474-385476, 385479, 385481-385482, 385484-385485, 385487-385488, 385490-385496, 385500-385501, 385503-385508, 385510-385512, 385516, 385520, 385525, 385527-385528, 385533, 385536, 385538, 385540-385541, 385543, 385546, 385548, 385550, 385552-385557, 385559, 385563, 385565, 385567-385570, 385572-385573, 385575, 385578-385580, 385582-385584, 385586-385590, 385593, 385595, 385597-385600, 385602, 385604-385610, 385612-385613, 385615, 385617, 385619-385620, 385623, 385625, 385627, 385629, 385631-385634, 385636, 385638-385639, 385642-385648, 385650-385652, 385654-385655, 385658-385659, 385662-385664, 385666-385668, 385670, 385673, 385675, 385678, 385680-385681, 385683, 385685-385687, 385689-385698, 385700-385702, 385704, 385707, 385709, 385711-385713, 385715-385723, 385725, 385728-385730, 385732-385738, 385741, 385743, 385751-385756, 385758, 385760, 385762-385765, 385767-385768, 385770-385780, 385782, 385786-385788, 385790-385794, 385796-385805, 385808, 385810, 385814-385825, 385827-385828, 385832, 385834-385839, 385841, 385843, 385847-385854, 385857-385859, 385861, 385866, 385870-385875, 385877-385881, 385886-385889, 385892-385895, 385900-385903, 385908, 385910-385918, 385920-385922, 385924-385926, 385929-385930, 385932-385933, 385935, 385940, 385943, 385945-385954, 385956, 385958, 385960-385962, 385965-385968, 385971-385972, 385974-385975, 385977-385978, 385980, 385982-385986, 385988-385993, 385997, 385999, 386001, 386006-386009, 386011-386014, 386017-386018, 386024-386027, 386029, 386031, 386033, 386036-386039, 386042, 386044-386052, 386059-386064, 386067-386076, 386078, 386081-386086, 386088-386092, 386094, 386098, 386100-386103, 386106-386109, 386111, 386113-386116, 386118, 386121-386123, 386126-386129, 386131-386132, 386134-386139, 386141-386153, 386156, 386159-386160, 386163, 386165-386170, 386175-386182, 386185, 386187, 386190-386191, 386193-386194, 386197, 386199, 386201, 386205-386212, 386214-386221, 386224-386226, 386228-386229, 386232-386237, 386239-386240, 386242-386250, 386252, 386254-386256, 386258, 386260, 386262-386266, 386270-386271, 386273-386275, 386283-386284, 386286-386291, 386294-386295, 386298-386299, 386303-386306, 386308, 386310-386311, 386314-386316, 386318, 386320-386324, 386326-386328, 386331, 386333-386334, 386336-386339, 386342, 386346, 386348, 386351-386353, 386355, 386357-386358, 386361-386365, 386367, 386370, 386373-386374, 386378-386379, 386381, 386383-386384, 386386-386387, 386389-386393, 386398-386399, 386402, 386405, 386408-386414, 386416, 386418, 386422, 386426-386430, 386432-386434, 386436, 386438-386439, 386441-386446, 386449, 386452-386453, 386457-386465, 386467-386484, 386486, 386488-386492, 386494, 386497, 386503-386507, 386510, 386513-386516, 386519, 386521-386522, 386524-386529, 386531-386533, 386538-386542, 386544-386556, 386558, 386560, 386562-386564, 386566-386569, 386571-386577, 386580-386581, 386583, 386585, 386587-386600, 386602-386606, 386608-386609, 386611, 386616-386623, 386625-386630, 386632-386636, 386639-386643, 386651-386652, 386655-386659, 386661-386669, 386673-386674, 386677-386678, 386681-386687, 386690, 386694-386706, 386709-386710, 386712-386715, 386717-386718, 386720-386725, 386727, 386729-386731, 386733-386736, 386738-386744, 386749, 386753, 386755-386757, 386759-386762, 386765-386771, 386773-386774, 386776-386777, 386781-386782, 386785-386792, 386795-386800, 386803-386808, 386810-386813, 386815-386817, 386819-386823, 386825-386828, 386830-386838, 386841, 386843, 386847-386852, 386854-386859, 386863-386864, 386867-386868, 386870, 386872, 386874-386883, 386885, 386887, 386890, 386892-386900, 386905-386907, 386909-386910, 386914-386917, 386919-386921, 386923, 386928-386929, 386931-386932, 386934-386935, 386937-386938, 386940-386941, 386944, 386946-386951, 386953, 386955-386958, 386960-386962, 386964-386966, 386968-386969, 386974, 386978-386982, 386987-386988, 386990-386992, 386994-387003, 387006-387007, 387009-387011, 387013, 387016-387018, 387024-387025, 387027-387028, 387030, 387032, 387034-387038, 387040, 387043, 387045-387047, 387049-387061, 387063-387067, 387071-387074, 387076, 387078-387081, 387083-387088, 387093-387096, 387098-387099, 387101-387103, 387106-387107, 387114, 387118, 387120, 387122-387127, 387129-387132, 387136, 387138-387140, 387142, 387144-387145, 387147-387151, 387153, 387155-387156, 387159, 387161-387164, 387166-387168, 387170, 387172-387175, 387177, 387182-387183, 387193, 387195-387200, 387202-387204, 387207-387208, 387210-387212, 387214, 387216-387221, 387223-387225, 387227-387235, 387237, 387247, 387249-387251, 387253, 387255, 387257-387260, 387262-387269, 387271-387275, 387277-387278, 387281, 387284-387285, 387287, 387290, 387293-387295, 387298, 387301-387305, 387309-387310, 387313, 387315-387316, 387318, 387320-387324, 387326, 387330, 387333-387345, 387347-387349, 387354-387355, 387360, 387362-387363, 387365-387368, 387370, 387372, 387374-387376, 387379-387384, 387387, 387389, 387393-387396, 387398, 387401-387402, 387405, 387407, 387409-387411, 387413, 387415-387420, 387422-387427, 387429-387437, 387444-387449, 387451-387452, 387455-387456, 387458-387461, 387463-387464, 387466, 387468-387470, 387473-387475, 387479-387482, 387484-387485, 387487, 387489, 387491-387492, 387494-387507, 387509-387514, 387516-387517, 387519-387523, 387526, 387529-387530, 387532-387534, 387536, 387538, 387542-387545, 387547, 387550, 387552-387555, 387557-387561, 387564, 387566-387568, 387571-387580, 387582-387583, 387585-387588, 387590, 387593-387594, 387599-387614, 387616, 387618, 387621-387624, 387627, 387630-387632, 387634-387636, 387639-387649, 387651-387658, 387660-387661, 387663-387664, 387668, 387676, 387679, 387684-387685, 387687-387689, 387695, 387697-387698, 387701-387702, 387704-387705, 387707-387710, 387714-387715, 387717, 387719-387720, 387723-387725, 387728-387730, 387732-387737, 387743, 387745-387746, 387748-387755, 387758-387759, 387762-387765, 387774, 387776, 387778-387779, 387781, 387783-387784, 387786-387790, 387792-387800, 387802-387803, 387805, 387807-387808, 387810-387811, 387813-387816, 387818-387819, 387823-387825, 387827, 387833-387834, 387837, 387841, 387843-387854, 387862-387868, 387870, 387874, 387876-387880, 387882-387884, 387886-387887, 387890-387893, 387895-387897, 387900-387901, 387903-387911, 387913-387916, 387918-387920, 387923-387925, 387927-387930, 387932, 387936-387940, 387942-387947, 387950-387959, 387961, 387967, 387969, 387971-387981, 387983-387984, 387986-387989, 387991, 387995-387996, 387999-388004, 388006-388019, 388021, 388023-388028, 388032, 388035-388045, 388047, 388051-388057, 388059-388065, 388067-388070, 388074, 388076-388084, 388086, 388089-388091, 388095, 388099-388100, 388102, 388106-388114, 388116, 388121-388122, 388124-388132, 388135-388136, 388142, 388144-388146, 388148-388149, 388151-388156, 388160-388167, 388169, 388171-388172, 388174, 388177-388180, 388182-388187, 388189, 388191-388193, 388195-388199, 388201-388207, 388209, 388211-388212, 388214-388220, 388222-388223, 388225-388226, 388228-388235, 388239-388250, 388252, 388254-388259, 388262-388266, 388270, 388274-388277, 388281, 388284-388289, 388292-388293, 388296-388301, 388305, 388307-388308, 388310-388311, 388314-388315, 388317-388318, 388320-388323, 388328, 388330-388332, 388334, 388338, 388343-388346, 388349-388350, 388353-388355, 388357-388360, 388362-388365, 388367-388387, 388389-388390, 388393-388395, 388398-388399, 388401-388402, 388404-388407, 388410, 388412, 388414, 388418, 388420, 388422, 388425-388428, 388431, 388433-388437, 388440, 388442-388450, 388453, 388455, 388457-388463, 388465-388471, 388474-388476, 388478, 388480-388482, 388484-388485, 388487-388491, 388494, 388496-388498, 388500-388505, 388507-388508, 388510-388513, 388515-388519, 388522, 388524, 388527-388532, 388534, 388537-388540, 388542-388547, 388550-388553, 388555-388560, 388563, 388565-388570, 388572, 388574-388577, 388581-388588, 388590-388592, 388594-388598, 388600-388602, 388605-388609, 388612-388614, 388618-388626, 388628-388631, 388633, 388635-388637, 388639, 388641-388643, 388648, 388650-388651, 388653-388657, 388659-388662, 388664-388665, 388667-388668, 388670, 388672-388674, 388677-388678, 388680-388688, 388692-388693, 388695, 388706-388707, 388710-388714, 388718-388721, 388725-388726, 388734-388738, 388740-388742, 388747, 388749-388758, 388761, 388763-388766, 388768-388769, 388771-388777, 388779, 388782, 388784-388787, 388790-388793, 388795-388796, 388798, 388800-388804, 388806, 388809-388814, 388816-388818, 388820-388823, 388825-388830, 388834-388835, 388838, 388841, 388845-388847, 388850-388852, 388854-388861, 388863-388864, 388867-388870, 388873, 388876-388878, 388880-388881, 388885, 388887, 388890-388891, 388894-388898, 388905, 388907-388908, 388910-388912, 388914-388916, 388918-388922, 388924-388925, 388929-388939, 388942, 388944, 388947, 388949, 388952, 388955-388958, 388960, 388963, 388965-388967, 388969-388970, 388973, 388978-388982, 388984, 388987, 388989-388993, 388995-388999, 389005, 389007-389010, 389012-389015, 389017-389024, 389027, 389031, 389033, 389035-389039, 389043, 389046, 389048, 389050-389055, 389057-389058, 389060, 389064-389068, 389070-389071, 389073, 389075, 389077-389083, 389085-389086, 389088-389091, 389095-389100, 389102-389117, 389119-389121, 389123, 389125-389127, 389129-389135, 389139, 389141-389142, 389146, 389148-389150, 389152-389153, 389155-389156, 389158, 389163, 389165, 389167-389168, 389170, 389173, 389175-389176, 389178-389182, 389184, 389187, 389189-389190, 389192-389195, 389198, 389200-389204, 389206-389211, 389214-389215, 389217-389221, 389223, 389225, 389228-389231, 389234, 389236, 389238-389240, 389242, 389244-389259, 389261, 389263-389266, 389268-389271, 389273-389274, 389276, 389279-389280, 389284-389285, 389287, 389290-389292, 389294, 389296, 389300-389302, 389306-389310, 389312-389313, 389316, 389318-389321, 389325-389329, 389331, 389333-389335, 389337-389338, 389340-389343, 389346-389356, 389358-389375, 389379-389386, 389388-389389, 389391-389395, 389397-389400, 389402, 389406-389408, 389410-389412, 389417, 389420-389421, 389423-389424, 389427-389430, 389434, 389437-389442, 389444, 389446-389447, 389449-389451, 389453-389454, 389456, 389460-389465, 389467, 389469-389472, 389475-389476, 389478-389479, 389481-389486, 389488-389491, 389493-389502, 389504-389512, 389514-389520, 389522-389531, 389534, 389537-389542, 389545, 389549, 389551-389560, 389563-389571, 389573, 389575, 389579, 389581-389587, 389589, 389593-389595, 389597-389598, 389600-389604, 389610, 389612, 389614, 389616-389630, 389633-389634, 389637-389638, 389640-389645, 389647, 389649-389650, 389652, 389657-389660, 389662-389666, 389669, 389672, 389674-389679, 389682, 389685-389688, 389691-389693, 389695-389696, 389699-389701, 389703-389705, 389707-389710, 389712-389715, 389718-389719, 389724-389725, 389727-389730, 389732-389736, 389738, 389742, 389746, 389751-389752, 389755-389757, 389759-389761, 389763-389765, 389767, 389773, 389775-389776, 389779-389783, 389787, 389789, 389791-389792, 389795-389796, 389801-389803, 389805, 389808-389809, 389811-389813, 389815, 389819-389821, 389823-389825, 389828-389829, 389831-389836, 389838-389842, 389845, 389847-389855, 389858-389859, 389861, 389863-389865, 389867, 389869-389879, 389881-389888, 389891, 389893-389897, 389899-389905, 389907-389908, 389910-389914, 389918-389925, 389927, 389929-389931, 389933, 389937-389940, 389945-389951, 389955, 389965-389966, 389969-389971, 389973-389976, 389978-389980, 389982-389996, 389998, 390001, 390004-390006, 390009-390015, 390017-390020, 390022-390028, 390031, 390034-390041, 390043, 390048-390053, 390058-390061, 390064, 390071-390080, 390084, 390088-390090, 390093-390095, 390098, 390100, 390102, 390104, 390109-390112, 390114-390115, 390121, 390123-390131, 390133, 390135-390137, 390140-390142, 390144, 390147, 390149-390150, 390157, 390159-390160, 390162-390163, 390167-390169, 390174, 390176-390177, 390179-390182, 390184-390185, 390188, 390190-390191, 390195-390199, 390201, 390204-390208, 390211-390212, 390216-390218, 390221-390224, 390227, 390229-390231, 390234-390238, 390240-390241, 390243, 390245-390247, 390251, 390253, 390255, 390257-390259, 390261, 390265-390268, 390270-390272, 390275-390278, 390280, 390282, 390285-390287, 390289-390294, 390299-390306, 390308-390310, 390313, 390315-390319, 390321, 390324, 390327, 390329, 390332-390335, 390338-390343, 390345, 390347, 390350, 390352-390353, 390356, 390358-390364, 390366-390369, 390372-390374, 390376-390377, 390379-390380, 390382-390386, 390391-390399, 390401-390404, 390406, 390408, 390411, 390413, 390416-390418, 390420-390422, 390424-390425, 390431, 390433-390437, 390439-390451, 390454-390456, 390458-390462, 390464, 390466-390480, 390482-390490, 390492, 390494-390497, 390499, 390502-390507, 390509, 390511-390512, 390517, 390519-390521, 390525, 390528-390529, 390531-390532, 390535-390538, 390542-390545, 390547-390548, 390550-390552, 390557, 390559-390564, 390566, 390568-390571, 390575, 390577-390582, 390584, 390586, 390589, 390592-390596, 390598-390600, 390602-390604, 390606-390608, 390610-390611, 390613, 390615, 390619-390620, 390622, 390624-390628, 390630-390632, 390635-390637, 390640-390650, 390652-390654, 390657-390660, 390664, 390667-390670, 390674, 390678, 390680, 390682, 390684, 390686-390689, 390694-390698, 390700, 390702-390712, 390715, 390717-390718, 390720-390725, 390728-390732, 390735-390736, 390739, 390741-390745, 390749, 390752-390754, 390756-390772, 390776-390786, 390789-390790, 390792, 390794, 390796-390797, 390800, 390802, 390804-390813, 390817-390820, 390823, 390825-390827, 390829, 390831-390836, 390838-390839, 390841-390844, 390846, 390849-390850, 390852-390856, 390859-390861, 390863-390868, 390872-390875, 390877-390878, 390880, 390884-390886, 390889-390890, 390892-390906, 390908, 390910, 390914-390922, 390924, 390927-390929, 390931-390940, 390942-390946, 390948, 390950-390956, 390959-390960, 390967-390970, 390972-390974, 390976-390977, 390979, 390981-390986, 390988, 390990, 390992, 390994-391003, 391005-391008, 391011-391015, 391017-391020, 391022-391024, 391026-391027, 391030, 391035, 391037, 391040, 391042-391043, 391046-391050, 391052-391054, 391058, 391060, 391062-391070, 391072-391073, 391075, 391077-391078, 391080, 391082-391083, 391085-391094, 391099-391102, 391106-391107, 391111-391121, 391128-391132, 391134, 391136, 391138, 391140-391142, 391144-391145, 391148, 391150-391153, 391157-391163, 391165-391167, 391169, 391171-391172, 391176, 391179, 391181-391185, 391188-391191, 391195-391196, 391198-391199, 391201, 391203-391205, 391207-391209, 391211-391212, 391214-391215, 391218, 391224-391226, 391228-391238, 391240-391244, 391246-391254, 391257-391261, 391267-391268, 391270, 391273-391275, 391277, 391279-391281, 391285-391292, 391295-391296, 391299-391302, 391305, 391307, 391309, 391314, 391316, 391318-391322, 391325-391331, 391333-391334, 391336, 391340-391342, 391346-391347, 391351-391352, 391354, 391356, 391358-391359, 391361-391365, 391367, 391369-391372, 391374-391380, 391383, 391385-391387, 391389, 391392, 391394-391397, 391399, 391401, 391403, 391405-391411, 391413-391415, 391419, 391421, 391424-391427, 391429-391433, 391435, 391437-391441, 391443, 391445, 391448, 391450-391453, 391455-391456, 391458, 391460-391461, 391466-391467, 391469, 391471-391473, 391476-391477, 391479-391480, 391483, 391485, 391487-391492, 391496-391508, 391510-391520, 391522-391523, 391525-391527, 391533-391534, 391536-391540, 391542, 391549-391552, 391556, 391558, 391560, 391562, 391564, 391566-391567, 391569-391570, 391573-391575, 391577, 391579-391580, 391582-391583, 391585, 391587-391592, 391594, 391597-391599, 391601, 391603-391611, 391614, 391616, 391618-391622, 391624-391627, 391629-391637, 391641-391642, 391645, 391647-391648, 391650-391652, 391654-391657, 391659-391660, 391662-391663, 391665, 391669-391673, 391675, 391677, 391679, 391681-391689, 391692-391694, 391696-391704, 391708, 391710-391714, 391717-391718, 391723-391730, 391734-391735, 391740-391741, 391745-391746, 391749, 391753, 391756-391760, 391764-391765, 391767-391769, 391772-391774, 391776-391783, 391785, 391787-391788, 391790, 391792, 391796, 391798-391799, 391803, 391806-391808, 391810-391819, 391821, 391824-391825, 391834, 391836-391844, 391852-391857, 391859-391860, 391866-391867, 391869-391870, 391872-391876, 391879-391882, 391886-391891, 391894, 391899-391900, 391903, 391905-391908, 391912-391915, 391919-391920, 391922-391925, 391927-391932, 391934-391938, 391941, 391943-391948, 391951-391957, 391959-391964, 391970, 391972-391974, 391976, 391978-391979, 391981-391982, 391985-391994, 391996-391998, 392000-392001, 392003-392004, 392007-392011, 392014, 392016, 392019, 392021-392023, 392026-392028, 392030, 392032, 392034, 392036, 392041-392045, 392048-392049, 392051, 392053, 392055-392056, 392058-392059, 392061, 392064-392067, 392069, 392071-392074, 392076, 392079, 392081-392084, 392086-392087, 392089-392101, 392105-392106, 392111-392113, 392121, 392123-392124, 392126-392129, 392131, 392133-392141, 392152-392153, 392155, 392157-392158, 392160-392162, 392165-392167, 392169-392178, 392180, 392182, 392186-392187, 392189-392191, 392193-392199, 392203, 392205, 392207-392209, 392211, 392213-392217, 392220-392222, 392224, 392226, 392228-392230, 392233-392234, 392236-392239, 392242-392243, 392245, 392247, 392249, 392253-392258, 392260-392264, 392266-392267, 392269-392274, 392276-392281, 392283-392285, 392287-392289, 392291-392293, 392295-392299, 392301-392306, 392314-392318, 392320-392323, 392325, 392327, 392333-392336, 392339, 392342-392343, 392347-392348, 392350-392359, 392361-392363, 392365-392366, 392368-392371, 392376-392377, 392380-392381, 392383-392386, 392388-392389, 392394, 392397-392400, 392406-392408, 392410-392420, 392422-392423, 392427-392429, 392431, 392433, 392435, 392437, 392439-392441, 392443-392445, 392449, 392452-392453, 392455-392457, 392459-392463, 392467-392468, 392470-392471, 392475-392478, 392480, 392483-392488, 392494, 392497-392499, 392502, 392504, 392506-392509, 392513, 392516, 392518, 392521-392525, 392527-392530, 392532, 392535-392536, 392538, 392540-392545, 392548, 392551-392552, 392554-392564, 392567-392572, 392574, 392578-392582, 392584-392592, 392595-392600, 392602-392609, 392612-392616, 392618-392624, 392626-392633, 392637-392638, 392640-392641, 392643, 392645, 392647-392648, 392650-392660, 392662-392664, 392666, 392668, 392672, 392674-392676, 392678, 392682, 392685, 392689-392693, 392696-392699, 392701, 392706-392707, 392709, 392711-392714, 392717-392718, 392722-392725, 392727-392730, 392732-392740, 392742, 392745-392747, 392749-392750, 392752-392754, 392756-392758, 392760, 392762-392765, 392767, 392769-392772, 392774-392775, 392777, 392779-392783, 392786-392787, 392790, 392792, 392794-392800, 392802, 392804-392827, 392833-392840, 392842-392844, 392847-392855, 392858, 392860-392865, 392868-392870, 392873-392894, 392896, 392899, 392901-392904, 392906, 392912, 392916, 392918-392922, 392924-392928, 392931-392933, 392935, 392938-392940, 392944, 392946, 392949-392952, 392954-392957, 392961-392964, 392966-392970, 392972-392974, 392977-392983, 392985-392986, 392988-392994, 392996-392999, 393001-393003, 393005-393011, 393013-393018, 393020-393027, 393030, 393032-393036, 393038-393042, 393044-393049, 393051-393053, 393055-393062, 393067-393068, 393071, 393073-393085, 393087, 393089-393091, 393094, 393096, 393098-393100, 393104-393105, 393107-393110, 393112, 393115, 393117-393120, 393123-393124, 393126-393127, 393129-393130, 393133-393141, 393143-393145, 393147-393157, 393161-393165, 393167-393172, 393175, 393177-393180, 393184-393193, 393197-393198, 393201-393202, 393204-393208, 393210-393212, 393214, 393216-393224, 393226-393229, 393231, 393238-393240, 393242-393244, 393246-393247, 393249-393251, 393253-393255, 393257-393260, 393263-393264, 393267-393268, 393273-393278, 393282-393283, 393286-393287, 393289, 393295, 393297-393300, 393303-393304, 393308, 393311-393315, 393318-393322, 393326-393327, 393330-393331, 393333, 393335, 393339-393340, 393343-393356, 393359, 393367, 393369-393371, 393373-393374, 393377, 393379-393380, 393382-393387, 393391, 393396-393399, 393401-393404, 393407-393408, 393410-393413, 393415, 393419-393421, 393424-393430, 393432-393436, 393439, 393442, 393444-393445, 393448, 393451-393452, 393454-393459, 393465-393471, 393473-393487, 393489, 393491, 393495, 393498-393499, 393501-393502, 393508, 393510-393517, 393520-393523, 393525-393532, 393534-393535, 393538, 393540-393544, 393546, 393549, 393552-393553, 393555-393557, 393559, 393562-393564, 393567-393569, 393572-393575, 393577-393578, 393580-393583, 393585, 393587-393590, 393593-393596, 393598-393600, 393602, 393604-393606, 393609-393613, 393616-393619, 393624, 393626, 393631, 393634-393638, 393643-393644, 393648, 393650-393654, 393658, 393660-393661, 393663, 393665-393674, 393677-393678, 393680-393684, 393686-393689, 393691-393695, 393699, 393701-393704, 393706-393709, 393711-393714, 393716-393723, 393726, 393730-393731, 393733-393737, 393739, 393741-393743, 393745, 393747, 393749, 393751-393756, 393758, 393760, 393765, 393767-393770, 393774-393779, 393781, 393784, 393786, 393788-393790, 393793-393795, 393798, 393802-393805, 393807-393814, 393818, 393820, 393823-393825, 393829-393832, 393834-393835, 393837-393840, 393842, 393844-393849, 393853, 393855, 393857, 393859-393861, 393863-393869, 393872-393874, 393876-393879, 393884, 393886-393887, 393889-393896, 393898-393899, 393901, 393903, 393906, 393910, 393912, 393917, 393919, 393922, 393926-393927, 393930, 393935-393936, 393938-393939, 393944-393954, 393957-393966, 393968, 393970, 393972, 393975-393981, 393983-393991, 393993-393995, 394000-394001, 394005-394007, 394009, 394011, 394013-394015, 394019-394022, 394024, 394026-394027, 394031, 394034-394035, 394037-394038, 394041-394044, 394047, 394049, 394051, 394053, 394055, 394058, 394063, 394065-394068, 394070-394074, 394077-394081, 394083-394088, 394090, 394092, 394095, 394101, 394103, 394105, 394108-394116, 394118, 394121-394124, 394126-394128, 394132, 394134, 394137-394145, 394151, 394153, 394155, 394157, 394159, 394161, 394163-394168, 394170-394172, 394174, 394176-394182, 394187-394190, 394193, 394195-394196, 394200-394203, 394206, 394208-394213, 394219-394224, 394227-394231, 394235-394240, 394247-394253, 394255-394261, 394263, 394266-394270, 394272, 394274-394275, 394278, 394280-394281, 394284-394288, 394290-394294, 394296-394299, 394301-394304, 394306-394311, 394313, 394315-394316, 394318-394321, 394324, 394328-394335, 394339-394342, 394347-394351, 394357-394359, 394361, 394363, 394365-394371, 394373, 394375, 394377, 394379-394381, 394385, 394387-394393, 394395-394407, 394409-394417, 394422-394424, 394426, 394429, 394432-394434, 394438-394440, 394447-394450, 394452, 394454-394456, 394458-394459, 394462-394465, 394467, 394469, 394471-394473, 394475-394476, 394479-394486, 394488-394491, 394493-394496, 394498-394499, 394502, 394505-

394506, 394508-394515, 394519-394522, 394524-394526, 394528, 394530-394549, 394551-394552, 394554, 394560-394561, 394567-394570, 394573-394578, 394581, 394583-394584, 394586-394590, 394592-394594, 394596-394597, 394602-394603, 394605-394606, 394610-394616, 394618, 394620, 394622-394624, 394626-394628, 394631-394633, 394635, 394638-394639, 394641, 394644-394645, 394648-394650, 394653-394654, 394656-394659, 394661, 394663-394664, 394666, 394670, 394673-394676, 394680-394688, 394690-394691, 394693-394697, 394699-394702, 394704-394705, 394707, 394709-394713, 394715, 394717, 394720-394724, 394727-394737, 394741, 394744-394746, 394748, 394750-394757, 394759-394768, 394770-394772, 394774-394775, 394779, 394783-394786, 394788-394789, 394791-394792, 394795, 394797-394798, 394800, 394805, 394812-394822, 394824, 394826-394827, 394831-394833, 394835-394836, 394839-394853, 394855-394858, 394860-394862, 394864-394867, 394869, 394872-394874, 394876-394883, 394886-394891, 394894-394900, 394904-394905, 394908-394909, 394911-394912, 394916, 394918-394945, 394949, 394951, 394953-394954, 394956, 394958-394965, 394967, 394970-394971, 394974-394976, 394978-394980, 394984, 394986-394987, 394989-394993, 394995-394997, 394999-395002, 395005, 395010, 395012-395014, 395018-395023, 395025-395027, 395029, 395031-395033, 395036, 395038-395041, 395043-395044, 395046, 395048-395052, 395056-395058, 395060, 395063-395065, 395067-395071, 395075, 395077-395078, 395080-395083, 395085, 395087, 395089, 395091-395093, 395096-395100, 395102, 395104, 395107, 395109, 395112-395114, 395117, 395119-395121, 395123-395125, 395128-395131, 395133-395135, 395137, 395139-395141, 395145-395146, 395149, 395151-395152, 395158-395159, 395161-395165, 395169-395174, 395176, 395178-395179, 395182-395184, 395186, 395190-395201, 395203-395207, 395209-395212, 395215-395218, 395222-395224, 395229-395230, 395234-395235, 395237, 395239, 395241, 395244-395245, 395247, 395249, 395252-395254, 395258-395261, 395263-395268, 395270-395271, 395273, 395275-395286, 395288-395301, 395303-395310, 395316, 395318-395322, 395324-395328, 395330, 395332, 395335-395337, 395339, 395342-395347, 395350-395352, 395354-395355, 395357-395358, 395362-395369, 395371-395374, 395376-395378, 395380-395381, 395383-395391, 395394-395398, 395400-395403, 395405-395407, 395409-395410, 395412-395413, 395416, 395419-395420, 395423, 395426-395427, 395429-395430, 395432, 395435, 395438-395439, 395441-395443, 395445, 395447-395452, 395454-395457, 395459-395469, 395471-395473, 395477, 395479-395480, 395482-395483, 395486-395487, 395490, 395492, 395496, 395498, 395500-395501, 395503, 395505, 395507-395509, 395511-395514, 395517, 395520, 395522, 395524, 395526-395529, 395533-395535, 395537-395538, 395540-395542, 395545-395553, 395556-395563, 395565, 395567-395568, 395573-395574, 395576-395578, 395581-395586, 395588-395593, 395595-395597, 395601, 395603, 395605, 395607, 395609-395610, 395612-395614, 395618-395626, 395629-395631, 395633-395635, 395638-395641, 395643-395644, 395646, 395648-395650, 395654-395655, 395657-395661, 395663-395667, 395669-395670, 395673-395675, 395677-395694, 395698-395701, 395704-395706, 395709, 395712-395718, 395720-395723, 395725-395726, 395728, 395730, 395732-395733, 395735, 395737, 395741-395744, 395747-395748, 395750, 395753-395754, 395756-395760, 395762, 395764, 395766, 395771-395772, 395776-395777, 395779, 395781-395782, 395784-395792, 395794-395800, 395802, 395805-395806, 395808, 395811, 395813-395814, 395816, 395820, 395822-395826, 395828, 395830-395831, 395833, 395839-395845, 395850-395851, 395853, 395855-395856, 395858-395859, 395862, 395864-395867, 395869-395870, 395873, 395877, 395880-395882, 395885, 395888-395891, 395893-395904, 395906, 395909-395910, 395914, 395917, 395922, 395924-395927, 395929-395932, 395934-395936, 395939, 395942-395944, 395946, 395955-395957, 395959, 395961, 395970, 395972, 395977-395981, 395983-395985, 395989-395990, 395993-396000, 396002, 396004-396010, 396012-396015, 396018-396023, 396029, 396031-396035, 396038-396042, 396045-396048, 396051-396052, 396054-396061, 396063-396064, 396066-396068, 396070, 396073, 396077-396080, 396082, 396085, 396088, 396093-396098, 396102, 396104-396105, 396108-396111, 396113-396121, 396124, 396126-396127, 396129-396133, 396137, 396140, 396142-396143, 396145-396146, 396148, 396150-396151, 396155-396156, 396158-396160, 396162-396165, 396170-396181, 396184, 396187, 396190-396193, 396195, 396199-396206, 396208-396214, 396217, 396222-396226, 396228, 396230, 396232-396236, 396238, 396242-396243, 396245, 396247, 396250-396254, 396256-396259, 396261-396265, 396267, 396270-396273, 396278-396280, 396282, 396289-396290, 396292-396295, 396297-396300, 396303-396305, 396308-396311, 396313-396314, 396316, 396318, 396321-396322, 396324-396328, 396331-396332, 396334-396338, 396341-396344, 396346-396347, 396350, 396352-396355, 396360-396367, 396369-396372, 396374, 396376-396384, 396387-396389, 396392, 396394-396395, 396398, 396400-396402, 396405-396411, 396414-396419, 396422-396426, 396428-396429, 396434-396435, 396437-396442, 396444, 396447-396448, 396450-396452, 396456, 396459-396460, 396463, 396466, 396468, 396470, 396473, 396475, 396477-396478, 396480-396481, 396486, 396488, 396490, 396492-396498, 396500-396509, 396512-396524, 396527, 396529-396530, 396532-396537, 396540-396541, 396543-396545, 396547-396550, 396553, 396555, 396560-396565, 396568, 396570-396573, 396576-396581, 396586-396588, 396591-396592, 396595-396601, 396607-396608, 396611-396612, 396615, 396619, 396621-396625, 396627-396628, 396630-396631, 396635-396637, 396641-396654, 396656-396659, 396661-396662, 396664-396665, 396667-396670, 396678-396679, 396681-396682, 396685-396691, 396693, 396695, 396697, 396701-396704, 396706, 396708, 396710-396711, 396715, 396717-396727, 396729-396731, 396733-396735, 396737, 396743-396745, 396747, 396749-396754, 396756, 396758, 396761, 396763-396767, 396771-396772, 396776-396777, 396779, 396783-396787, 396792-396794, 396796-396797, 396799, 396801-396806, 396808-396816, 396822-396832, 396834-396835, 396837-396839, 396841-396842, 396844-396845, 396849, 396851, 396853-396854, 396856-396859, 396861-396863, 396866-396872, 396876, 396878-396886, 396892-396897, 396899-396901, 396903-396905, 396907, 396910, 396912, 396916-396920, 396925-396926, 396930-396932, 396934-396935, 396937, 396939-396941, 396943-396944, 396946-396950, 396952-396955, 396957-396960, 396962, 396966, 396970-396974, 396978-396988, 396990-396996, 397000-397002, 397004, 397006, 397008-397011, 397013, 397015-397016, 397019-397020, 397023-397025, 397027-397028, 397030-397032, 397034-397035, 397038-397039, 397042-397044, 397046, 397048-397050, 397054-397057, 397059, 397063-397069, 397071-397074, 397076-397079, 397081, 397085-397086, 397092-397094, 397096, 397098, 397100-397110, 397112, 397114, 397116-397117, 397121-397125, 397127-397128, 397130-397131, 397134-397136, 397138, 397140, 397142-397143, 397145-397148, 397150-397151, 397155, 397157-397159, 397162-397170, 397176-397177, 397180-397186, 397191-397195, 397197, 397199-397200, 397202-397203, 397206-397209, 397211, 397213-397216, 397218-397223, 397225-397226, 397228, 397230-397231, 397233-397237, 397239-397240, 397242-397247, 397251-397255, 397257-397259, 397271-397272, 397275-397276, 397282, 397285-397286, 397288, 397290, 397294-397295, 397297, 397299-397300, 397303-397304, 397306, 397309-397321, 397323-397324, 397327-397330, 397334, 397343-397350, 397353, 397355-397357, 397360-397362, 397373-397376, 397378-397380, 397382-397383, 397386-397390, 397392-397393, 397395, 397397-397400, 397406, 397410-397417, 397423-397433, 397437-397443, 397445, 397447-397450, 397452, 397455, 397457, 397461-397462, 397464-397466, 397468, 397470, 397473-397479, 397483-397486, 397488-397492, 397495, 397497-397498, 397500-397501, 397503-397505, 397511, 397513-397523, 397525, 397528-397529, 397531-397533, 397536, 397538-397539, 397541, 397543-397545, 397547, 397550, 397553-397555, 397557-397558, 397560-397561, 397563, 397567, 397570-397571, 397573-397574, 397576-397577, 397579, 397582, 397584-397585, 397587-397595, 397597, 397600-397601, 397603, 397605-397608, 397610-397613, 397615-397617, 397619, 397622, 397624-397625, 397627-397628, 397630-397633, 397636, 397639-397641, 397644-397651, 397653, 397656, 397658-397659, 397661-397662, 397667-397668, 397674-397675, 397677-397678, 397680, 397682-397683, 397686-397688, 397692-397694, 397696-397697, 397699, 397701, 397703, 397706-397707, 397709, 397713-397717, 397719-397720, 397722-397727, 397729-397733, 397735-397736, 397738-397742, 397744-397745, 397749, 397751, 397753, 397755-397757, 397759, 397761-397762, 397766-397767, 397770, 397775-397776, 397779, 397781, 397783, 397786, 397789-397799, 397801, 397803, 397806-397810, 397816-397818, 397820, 397822-397823, 397826-397829, 397831, 397833-397834, 397837-397839, 397841, 397843-397845, 397848, 397851, 397853-397862, 397870, 397873-397874, 397876-397881, 397884, 397888, 397891, 397894, 397896, 397898-397901, 397903-397905, 397907, 397909-397912, 397914-397921, 397925-397931, 397933, 397938, 397941, 397947-397948, 397951-397955, 397957-397959, 397964, 397966, 397968-397970, 397972-397973, 397976, 397978, 397983-397985, 397987, 397992, 397994-397995, 397999, 398002, 398004-398007, 398009, 398011-398014, 398016-398025, 398027-398029, 398031-398032, 398038-398039, 398042, 398045-398048, 398052-398053, 398056, 398058-398061, 398063-398064, 398067-398069, 398071, 398073-398076, 398080, 398083-398086, 398088, 398090-398091, 398093-398094, 398096, 398099, 398102, 398105-398108, 398110, 398112, 398114, 398116-398119, 398122, 398124-398126, 398128-398130, 398132-398148, 398150-398154, 398156, 398158-398159, 398161, 398163, 398167-398174, 398176-398178, 398181, 398183-398193, 398195-398196, 398200-398202, 398205-398207, 398210-398211, 398213-398215, 398217-398221, 398223-398224, 398226-398227, 398229-398230, 398233, 398236-398248, 398250-398251, 398254-398260, 398263-398269, 398273-398274, 398278-398280, 398282, 398284-398290, 398292, 398295, 398297, 398300-398303, 398305, 398307, 398309, 398314, 398318, 398320-398321, 398323, 398325, 398327-398340, 398342, 398344-398345, 398347, 398353-398360, 398362-398363, 398365, 398367, 398370-398371, 398373-398380, 398382, 398385, 398388-398390, 398392, 398396-398399, 398401-398404, 398407-398411, 398414, 398416-398417, 398423, 398426-398427, 398430-398431, 398434, 398436-398440, 398442, 398445, 398448, 398450-398451, 398453-398454, 398456-398459, 398464, 398466-398469, 398471-398481, 398484, 398487, 398490, 398492, 398494, 398496, 398498, 398500, 398503-398504, 398507-398509, 398511, 398513-398514, 398516, 398520-398522, 398524-398525, 398531-398533, 398535-398536, 398538, 398543-398545, 398547, 398549, 398551, 398553, 398556-398560, 398562-398563, 398565, 398567, 398569-398572, 398575, 398578, 398582, 398584-398586, 398588-398592, 398600, 398602-398609, 398611, 398613-398614, 398616, 398618, 398620-398621, 398623-398624, 398628-398631, 398634-398644, 398647-398648, 398650-398653, 398658, 398661, 398663, 398665, 398667-398678, 398680, 398682, 398684, 398686, 398688-398695, 398697-398704, 398708-398712, 398715-398720, 398722-398723, 398725-398729, 398731-398732, 398734, 398737, 398741-398742, 398746-398752, 398755, 398758-398759, 398766-398769, 398776-398778, 398781-398784, 398786-398787, 398789-398790, 398793-398794, 398796-398798, 398800, 398803-398805, 398808-398809, 398811, 398813-398824, 398829-398830, 398832-398835, 398838, 398840-398844, 398846-398847, 398849-398850, 398852-398861, 398863-398866, 398868-398871, 398873-398874, 398876, 398878-398885, 398887-398889, 398892-398895, 398897-398899, 398901-398905, 398910-398914, 398917-398918, 398920, 398925-398935, 398937-398938, 398942-398945, 398947, 398949, 398951, 398954, 398960, 398962, 398964-398968, 398974, 398978, 398982-398984, 398987-398993, 398996-399001, 399004, 399006-399010, 399012-399018, 399020-399021, 399023-399029, 399031, 399035, 399038-399044, 399046, 399050, 399052-399056, 399059, 399063-399065, 399067-399084, 399086-399087, 399089-399094, 399096-399097, 399100, 399103-399107, 399112-399113, 399115-399117, 399121-399122, 399124, 399126-399128, 399131, 399133-399135, 399137-399138, 399141-399142, 399144, 399148, 399153, 399155-399156, 399161-399164, 399166-399167, 399169, 399171-399175, 399177, 399179-399180, 399182-399187, 399190-399199, 399201-399204, 399207, 399210, 399214-399222, 399224, 399226-399233, 399235-399236, 399238, 399240, 399242-399243, 399245, 399247-399248, 399250-399254, 399256-399257, 399264-399265, 399267-399269, 399271-399275, 399277, 399280, 399283, 399285-399288, 399291-399292, 399295, 399301, 399306-399310, 399313-399315, 399318-399323, 399326, 399328, 399336-399341, 399345, 399348-399350, 399352-399356, 399364-399365, 399367-399368, 399370-399374, 399377, 399381-399382, 399384, 399387-399390, 399394-399397, 399401-399403, 399408-399412, 399414-399417, 399419, 399426, 399429, 399431-399433, 399436, 399438-399443, 399445, 399449-399450, 399452-399454, 399457-399459, 399461-399466, 399469-399472, 399475-399483, 399486, 399488-399489, 399491, 399494, 399498-399499, 399508-399512, 399514, 399516, 399518-399519, 399521-399526, 399528, 399534-399538, 399542, 399544-399548, 399552, 399555, 399558-399559, 399561-399563, 399565, 399567-399573, 399575-399576, 399578, 399580-399582, 399585-399586, 399588-399597, 399599-399600, 399602-399605, 399609-399614, 399616-399621, 399624, 399626-399630, 399633-399639, 399643-399644, 399646, 399649-399650, 399652-399653, 399655-399659, 399661, 399664, 399666-399668, 399670-399672, 399674, 399677, 399680, 399682-399683, 399685-399688, 399690, 399692-399694, 399701-399705, 399708-399714, 399716-399718, 399720-399723, 399726, 399728-399729, 399732-399735, 399737, 399739, 399741-399745, 399748, 399753-399757, 399759, 399765, 399767-399768, 399773, 399779-399781, 399785-399787, 399789-399790, 399795-399796, 399798-399800, 399802-399804, 399807-399811, 399815-399816, 399820, 399822, 399824-399829, 399831-399834, 399836-399838, 399840-399842, 399845, 399848-399849, 399852, 399854-399855, 399857-399858, 399860-399869, 399871, 399873-399879, 399884-399885, 399888, 399892-399893, 399895-399896, 399898-399899, 399903, 399905-

399907, 399909, 399911, 399914-399915, 399918-399926, 399929-399937, 399939-399944, 399946-399949, 399952, 399954, 399958, 399961, 399965, 399967-399970, 399972-399982, 399984, 399988-399989, 399991, 399993, 399997, 399999-400000, 400005-400006, 400008-400015, 400019-400022, 400024-400025, 400028-400031, 400033-400039, 400042-400043, 400045-400049, 400051-400052, 400054-400055, 400061, 400063-400064, 400066-400068, 400070-400080, 400083, 400086, 400088, 400090-400094, 400096-400097, 400099, 400102-400106, 400109-400112, 400114-400122, 400124-400125, 400127-400129, 400131-400133, 400135, 400137-400139, 400141, 400146, 400148-400150, 400152-400154, 400156-400160, 400164, 400166, 400168, 400174-400175, 400178, 400181, 400183-400184, 400188, 400190-400192, 400194, 400196-400197, 400199-400200, 400202, 400205-400208, 400211-400213, 400221, 400223, 400227, 400231-400232, 400234-400235, 400237, 400239-400243, 400247, 400249-400250, 400252, 400254-400256, 400264-400268, 400270, 400272-400273, 400275-400282, 400284-400285, 400287, 400289-400301, 400303-400304, 400307-400309, 400311, 400314-400317, 400320-400329, 400332, 400338-400341, 400343-400349, 400351, 400354-400358, 400360, 400362, 400364-400365, 400367, 400369, 400371, 400373-400378, 400381-400382, 400384-400389, 400393-400395, 400397-400401, 400403-400409, 400411-400425, 400427, 400429-400435, 400439-400441, 400443, 400445-400446, 400449-400450, 400452, 400455, 400457, 400460, 400464-400474, 400481, 400485-400487, 400492-400495, 400497-400498, 400501, 400503, 400505-400506, 400508-400512, 400519, 400521-400522, 400524-400536, 400538-400542, 400544-400558, 400560, 400562-400568, 400570-400579, 400582-400589, 400591, 400593-400594, 400596, 400600-400605, 400607-400610, 400612-400616, 400618-400622, 400624, 400627, 400633-400638, 400640-400642, 400645, 400647-400656, 400658-400659, 400661-400663, 400672-400678, 400680, 400682-400684, 400686-400688, 400690-400691, 400693, 400697-400698, 400700-400702, 400705-400707, 400709, 400713-400717, 400719, 400721-400729, 400733-400739, 400742-400743, 400745-400746, 400748-400759, 400762-400763, 400765, 400767-400774, 400776-400777, 400779, 400781-400784, 400786, 400790, 400793, 400795-400797, 400799-400801, 400803, 400805-400806, 400808, 400810-400815, 400817-400822, 400826-400827, 400829-400835, 400837-400845, 400847-400848, 400850-400853, 400855-400856, 400858-400866, 400868, 400871-400874, 400876-400880, 400882-400884, 400887-400894, 400897, 400900-400905, 400907-400910, 400912, 400920, 400923-400926, 400928-400930, 400932-400935, 400937, 400939, 400942-400946, 400948, 400950-400967, 400969-400970, 400972, 400974, 400976-400979, 400981-400982, 400984-400987, 400991-400995, 400997-401008, 401010-401013, 401016-401018, 401020, 401022-401023, 401025, 401028, 401030-401031, 401033-401036, 401039-401041, 401043, 401045, 401047-401048, 401050, 401052-401057, 401059-401060, 401063-401064, 401066, 401068-401070, 401072, 401075-401076, 401078, 401080-401081, 401083-401084, 401087-401090, 401092-401096, 401100-401106, 401108-401110, 401112, 401115, 401117-401118, 401124, 401131, 401133-401135, 401137-401147, 401149-401150, 401152-401157, 401159-401163, 401165-401166, 401168-401169, 401171, 401173-401177, 401179-401180, 401182-401190, 401192-401199, 401201-401205, 401207, 401209-401212, 401214, 401216-401221, 401223, 401228, 401231-401237, 401239, 401241, 401243-401246, 401248, 401250-401254, 401256, 401260, 401262-401263, 401266, 401269-401270, 401272-401277, 401279-401283, 401286, 401289-401290, 401292-401293, 401295-401296, 401298-401301, 401303-401310, 401312-401316, 401318, 401320, 401323-401329, 401332-401334, 401336-401337, 401340-401344, 401346-401347, 401349, 401351-401352, 401355, 401358-401361, 401365-401368, 401370-401372, 401376-401379, 401383-401385, 401388-401389, 401391-401392, 401395, 401398, 401402, 401404-401406, 401408-401411, 401416-401423, 401430, 401432, 401434, 401436-401438, 401444-401446, 401448, 401451, 401453-401455, 401457-401458, 401460-401465, 401467, 401469-401470, 401474-401476, 401479-401485, 401487-401488, 401490, 401492-401494, 401498-401500, 401503-401504, 401507-401510, 401512, 401514-401517, 401519-401520, 401523, 401525-401531, 401533-401538, 401540, 401543, 401546-401547, 401550-401552, 401558, 401560-401564, 401568-401575, 401577, 401581, 401586, 401588, 401590-401594, 401596-401597, 401600-401610, 401613, 401616-401619, 401621-401626, 401628, 401631, 401634, 401636-401637, 401639, 401641, 401643-401644, 401648-401649, 401651-401653, 401655, 401661, 401663-401664, 401666-401671, 401674, 401677, 401679, 401681-401683, 401686, 401689, 401691, 401693-401696, 401701-401702, 401705, 401707-401709, 401715-401717, 401720, 401722, 401724, 401726-401729, 401732, 401734-401740, 401742-401744, 401749-401751, 401755-401757, 401760-401761, 401763-401764, 401766-401770, 401773, 401775-401777, 401779-401780, 401782, 401784-401786, 401790-401791, 401793, 401795, 401800-401801, 401805-401806, 401808-401809, 401812-401818, 401820-401821, 401823-401830, 401832, 401836, 401838-401839, 401841, 401844-401849, 401851-401855, 401860-401866, 401868-401869, 401871, 401875-401878, 401880-401892, 401894-401895, 401898-401901, 401903-401905, 401908-401909, 401912, 401914, 401916, 401918, 401920-401926, 401928, 401931-401940, 401943-401949, 401951-401954, 401956-401957, 401959-401961, 401963, 401965, 401969-401971, 401973-401974, 401978-401986, 401988, 401991-401992, 401994-401995, 401997-401999, 402001, 402003-402008, 402010-402014, 402016-402017, 402019, 402021, 402025, 402027, 402029-402030, 402034-402045, 402048, 402053, 402056-402059, 402061, 402064-402069, 402071, 402075, 402077-402078, 402080-402086, 402088, 402091-402094, 402096, 402098-402099, 402101, 402103-402106, 402110-402119, 402121-402131, 402133-402141, 402143-402144, 402146, 402148, 402150-402153, 402155, 402158-402159, 402161-402162, 402166-402168, 402172, 402175-402177, 402179-402180, 402182-402183, 402187-402190, 402192-402198, 402202-402204, 402206-402207, 402209-402210, 402212-402217, 402219, 402221, 402226, 402228, 402230-402231, 402234-402238, 402241-402244, 402248-402250, 402253-402255, 402259-402261, 402263, 402266-402267, 402270, 402273-402282, 402285, 402288-402296, 402301-402302, 402307, 402309, 402311-402313, 402316, 402318, 402322-402324, 402326-402327, 402329, 402331-402334, 402337, 402339, 402342-402344, 402346, 402348, 402359, 402361, 402364, 402367, 402369, 402371, 402373-402375, 402378, 402382-402384, 402386-402394, 402396, 402398-402399, 402401, 402403-402406, 402408-402409, 402411-402412, 402416, 402419-402425, 402428-402429, 402431-402432, 402435, 402438-402441, 402444, 402446-402449, 402451-402453, 402455-402460, 402462, 402464, 402467-402470, 402472, 402474, 402479-402482, 402484-402486, 402489, 402491-402496, 402498, 402500-402506, 402508, 402510, 402514-402516, 402519-402521, 402523-402525, 402527-402533, 402535-402537, 402539-402543, 402548-402550, 402552-402553, 402555, 402559-402561, 402563-402567, 402573, 402575-402576, 402578-402579, 402581-402587, 402589, 402591, 402594-402597, 402600, 402602-402609, 402611-402613, 402616-

402618, 402620, 402624-402626, 402628-402629, 402631, 402633-402637, 402639-402649, 402651, 402659-402661, 402664-402668, 402671-402681, 402684-402687, 402689-402693, 402695, 402698-402702, 402704-402719, 402721-402725, 402727, 402729-402730, 402732-402733, 402736-402738, 402742, 402746-402749, 402751-402752, 402754-402759, 402763-402764, 402766-402767, 402769, 402773, 402775, 402779-402784, 402786, 402788, 402790-402792, 402795-402801, 402803-402808, 402810-402819, 402821, 402823-402824, 402826, 402829, 402831-402832, 402835-402839, 402842-402843, 402845, 402848-402865, 402867-402869, 402872-402877, 402879, 402882, 402884-402885, 402887-402890, 402892, 402897-402899, 402902-402906, 402908-402915, 402917-402919, 402922-402929, 402931-402934, 402936-402938, 402940, 402942, 402950-402952, 402954-402956, 402959-402961, 402964-402966, 402976, 402980, 402986-402988, 402990, 402992-402993, 402998, 403000-403001, 403004-403005, 403007, 403009-403010, 403012-403014, 403016-403024, 403027, 403029-403031, 403034, 403036-403037, 403040, 403048, 403054, 403056-403057, 403059, 403061-403067, 403069-403086, 403088, 403090-403095, 403099-403100, 403102-403107, 403109, 403121-403126, 403128-403130, 403134, 403136, 403138-403141, 403146-403155, 403157, 403159, 403161-403163, 403170-403179, 403181, 403188-403194, 403196, 403198-403202, 403205-403207, 403209-403211, 403213, 403215, 403218-403219, 403221, 403224-403227, 403229-403230, 403233-403235, 403237-403238, 403241-403242, 403244, 403246, 403248, 403250-403258, 403263-403266, 403268-403269, 403271, 403274-403280, 403283-403285, 403287-403290, 403292-403294, 403296-403300, 403302, 403304-403305, 403309-403315, 403319, 403321, 403323, 403325-403326, 403328-403329, 403331-403334, 403336-403337, 403340-403343, 403345-403355, 403358, 403360-403364, 403367, 403376, 403378-403379, 403381-403382, 403384-403388, 403390-403391, 403393, 403395-403396, 403398-403406, 403411-403418, 403420-403424, 403427, 403430-403433, 403437-403447, 403450-403455, 403457, 403460, 403462-403464, 403466-403483, 403485, 403487, 403489-403491, 403493-403498, 403501-403505, 403509-403513, 403515-403516, 403518, 403520-403526, 403528-403532, 403535-403536, 403538-403541, 403543-403549, 403551-403556, 403559-403562, 403564, 403567-403569, 403571, 403574-403576, 403579-403580, 403582-403584, 403586-403590, 403592-403593, 403595, 403597, 403599, 403609-403610, 403612, 403615, 403617-403618, 403622-403625, 403627-403630, 403643, 403645-403647, 403650-403651, 403653-403654, 403656, 403658, 403660-403665, 403667-403671, 403673-403677, 403679, 403681-403686, 403688, 403692, 403694-403699, 403701, 403704, 403706-403712, 403715-403725, 403728-403733, 403735-403737, 403739-403740, 403743-403752, 403755-403769, 403772, 403775-403777, 403784, 403786-403787, 403789-403791, 403793-403795, 403797, 403799-403800, 403802-403804, 403806-403808, 403810-403811, 403814-403823, 403825, 403827, 403829, 403831, 403833-403835, 403837-403843, 403847-403851, 403854-403858, 403861-403863, 403865-403868, 403872-403881, 403885-403887, 403890-403893, 403895-403903, 403905, 403908, 403911-403934, 403936, 403938, 403941-403947, 403949, 403952, 403954-403955, 403957-403959, 403961, 403963-403967, 403969-403979, 403982, 403984-403994, 403996-403997, 404000, 404003-404011, 404015, 404017-404037, 404039-404044, 404046-404049, 404051-404054, 404057-404059, 404061-404063, 404066-404067, 404069-404073, 404075-404078, 404080, 404083, 404085-404087, 404089-404094, 404096, 404102-404104, 404106-404108, 404110-404122, 404126-404128, 404130-404132, 404134-404135, 404137, 404139, 404141-404142, 404144-404156, 404158-404167, 404169-404173, 404175, 404177-404179, 404182-404184, 404186-404188, 404190-404193, 404196-404200, 404203, 404209, 404213-404214, 404216-404219, 404221-404226, 404228-404231, 404233-404236, 404239-404242, 404244, 404246-404247, 404254-404260, 404264-404265, 404269, 404274-404276, 404279-404282, 404284-404286, 404288, 404291-404292, 404294-404296, 404298, 404300, 404302-404307, 404309, 404311-404317, 404319, 404321-404326, 404328, 404330, 404332-404333, 404335, 404337-404339, 404341, 404343-404346, 404351-404354, 404356-404360, 404362-404364, 404366, 404368, 404371-404376, 404386-404391, 404393-404394, 404396-404397, 404401-404402, 404404, 404406-404419, 404425, 404428-404429, 404432-404433, 404435-404439, 404441-404452, 404455, 404457-404458, 404460-404461, 404463, 404465-404467, 404469-404474, 404477-404478, 404480-404486, 404489-404496, 404498-404499, 404502, 404508, 404510-404514, 404519, 404521-404526, 404528-404531, 404534-404537, 404539, 404542, 404544-404547, 404549-404560, 404562-404573, 404575, 404579-404580, 404582-404583, 404585-404591, 404593, 404595, 404598-404603, 404605, 404607, 404609-404610, 404612-404617, 404619-404620, 404623-404629, 404633-404636, 404642-404645, 404647, 404649, 404654-404656, 404658-404660, 404662, 404665, 404671-404672, 404675, 404679, 404681, 404683-404687, 404689-404695, 404697-404703, 404707-404709, 404711, 404713, 404716-404722, 404725-404732, 404734, 404739, 404742-404747, 404750, 404753-404754, 404756, 404763-404768, 404773, 404775, 404778, 404782-404783, 404785-404795, 404799, 404804-404808, 404810, 404812-404820, 404824-404830, 404833-404835, 404837, 404839-404840, 404842, 404844-404845, 404847, 404850, 404852-404853, 404855-404860, 404865-404869, 404871-404873, 404875, 404877, 404879, 404884, 404886, 404890, 404893-404897, 404900, 404902, 404906-404907, 404909-404918, 404920-404922, 404924-404931, 404933, 404935, 404937, 404939-404940, 404943-404945, 404947-404952, 404955-404959, 404961-404962, 404964, 404966-404967, 404969-404971, 404973-404974, 404976-404979, 404982-404983, 404985, 404987-404990, 404992-404993, 405000, 405004-405005, 405007, 405009, 405011, 405013-405021, 405023-405032, 405035-405038, 405040-405041, 405044-405047, 405049-405050, 405053-405059, 405062-405064, 405066-405074, 405076-405081, 405083-405085, 405087-405091, 405093-405101, 405103, 405107-405109, 405114-405117, 405119-405120, 405122-405124, 405126-405128, 405133-405136, 405138-405139, 405142, 405144, 405149-405154, 405156-405159, 405163-405164, 405166-405168, 405172-405173, 405179, 405181-405187, 405189-405199, 405202-405204, 405206-405210, 405213-405214, 405220-405221, 405223, 405225, 405227-405229, 405232, 405234, 405236-405240, 405242-405244, 405247, 405250, 405254-405257, 405259-405261, 405263-405270, 405272, 405275-405278, 405280-405282, 405284-405286, 405288-405289, 405294-405300, 405304-405311, 405313, 405318-405324, 405327-405333, 405337, 405339-405341, 405343-405347, 405349-405351, 405353, 405356-405357, 405361-405363, 405366-405367, 405371, 405373-405377, 405379-405383, 405387-405391, 405393, 405395-405396, 405398-405406, 405408-405409, 405411-405414, 405416, 405418, 405420, 405422-405424, 405426-405427, 405431-405432, 405434, 405436-405439, 405441-405443, 405445-405447, 405459-405464, 405467, 405470-405475, 405477-405480, 405482, 405485-405486, 405488, 405490, 405494, 405496-405500, 405502-405503, 405507-405518, 405520, 405522, 405532-405533, 405538, 405540, 405543-405547, 405551, 405553-

405556, 405558-405562, 405566-405568, 405574-405576, 405578, 405580, 405584-405588, 405590-405591, 405593, 405595-405596, 405599-405600, 405603-405605, 405607, 405609, 405615-405621, 405623, 405626-405627, 405629-405631, 405635-405636, 405640-405645, 405647-405657, 405659-405663, 405668-405672, 405674, 405676, 405678, 405681, 405683, 405690, 405692-405695, 405701-405703, 405705, 405707-405708, 405713, 405716-405719, 405724-405725, 405731-405732, 405734, 405736, 405739-405741, 405745, 405748, 405751-405752, 405754-405763, 405768, 405771-405772, 405775-405778, 405780, 405785-405787, 405789-405790, 405793, 405795-405798, 405800-405801, 405803-405806, 405809, 405812-405818, 405821-405822, 405824-405827, 405829, 405831-405832, 405835-405840, 405842-405848, 405850, 405852, 405862-405874, 405876-405882, 405886, 405888, 405890, 405892-405893, 405895-405896, 405898, 405903-405907, 405910-405911, 405913-405916, 405918, 405923-405927, 405929-405933, 405935-405943, 405945, 405947-405950, 405953, 405955-405960, 405964-405970, 405972, 405975-405977, 405981, 405986-405987, 405996, 405999-406000, 406003-406004, 406007-406010, 406012, 406016-406020, 406022-406023, 406025-406030, 406032-406033, 406036-406039, 406042-406047, 406051, 406053-406055, 406057, 406060, 406062-406066, 406068-406070, 406074-406076, 406078-406080, 406083-406090, 406093-406094, 406097, 406101, 406103-406113, 406115-406118, 406122, 406124, 406127-406133, 406137-406143, 406145-406149, 406151-406153, 406156-406160, 406162, 406164, 406166-406167, 406169-406171, 406174-406175, 406177-406178, 406180-406187, 406189, 406191-406192, 406194-406197, 406199-406200, 406202-406205, 406207, 406209-406211, 406213-406214, 406216, 406218-406222, 406225-406231, 406234, 406237-406238, 406240, 406242-406243, 406245-406252, 406254, 406258-406259, 406261, 406264-406270, 406273-406276, 406279-406289, 406292-406293, 406295-406296, 406298-406299, 406301-406303, 406305-406312, 406314-406315, 406318-406323, 406333-406335, 406338-406339, 406341-406342, 406344-406345, 406347-406348, 406350, 406352-406356, 406358-406366, 406369, 406373, 406376-406378, 406381-406382, 406384-406387, 406389, 406391-406396, 406399-406403, 406405-406411, 406413-406417, 406419-406422, 406425-406427, 406430, 406434-406435, 406438-406440, 406442, 406445, 406450-406453, 406455, 406457, 406460, 406463-406467, 406469, 406472-406473, 406475-406479, 406481, 406484, 406486-406491, 406494-406498, 406502, 406504-406507, 406510-406511, 406513-406515, 406517-406518, 406520-406523, 406525-406532, 406534-406537, 406539-406543, 406547-406551, 406554, 406556-406557, 406559, 406561-406564, 406566, 406568-406576, 406579, 406585, 406587-406592, 406594-406596, 406600, 406602-406605, 406607-406610, 406612, 406615-406619, 406622, 406628-406629, 406631-406632, 406635-406643, 406649-406660, 406662, 406664, 406666-406668, 406670, 406672, 406674-406689, 406691-406693, 406705, 406708-406713, 406715-406718, 406720-406721, 406723, 406726-406727, 406729-406730, 406732, 406734, 406736, 406738-406740, 406742-406743, 406745, 406748, 406751-406753, 406755-406757, 406759-406770, 406772, 406774-406776, 406781, 406783-406784, 406786-406789, 406791-406795, 406803, 406807, 406809-406810, 406812-406814, 406817-406821, 406824-406832, 406837, 406839-406841, 406843, 406846-406847, 406850-406855, 406857, 406861-406864, 406871-406877, 406879-406881, 406885, 406887, 406892-406898, 406902-406903, 406905-406907, 406911, 406914-406917, 406920-406922, 406924-406926, 406928-406935, 406937-406938, 406940-406943, 406945-406950, 406953-406958, 406965-406966, 406971-406972, 406974-406976, 406979, 406983, 406986, 406988, 406991-406994, 406999-407003, 407005-407006, 407012-407018, 407022-407024, 407026, 407028-407030, 407032-407037, 407039, 407041-407042, 407044, 407047-407048, 407051-407052, 407054-407057, 407059-407064, 407067-407069, 407072, 407074, 407076, 407078-407080, 407082-407085, 407087, 407089, 407091, 407094, 407096, 407098-407100, 407102, 407104-407112, 407115, 407123-407126, 407128, 407132-407133, 407135-407136, 407138, 407140-407141, 407145-407146, 407149-407150, 407152-407153, 407157, 407159-407162, 407164, 407168, 407170-407172, 407174-407175, 407178-407183, 407185-407189, 407192, 407194, 407196, 407198, 407200, 407202, 407205-407206, 407208-407212, 407214, 407216-407217, 407220-407223, 407225-407227, 407230-407231, 407233-407242, 407246, 407249-407253, 407256-407258, 407260-407262, 407269-407271, 407273, 407278-407279, 407283, 407285, 407289, 407291, 407293-407298, 407303-407304, 407306-407307, 407317-407318, 407320, 407322-407334, 407338-407345, 407348, 407351-407353, 407357, 407359-407361, 407363-407364, 407367-407368, 407372-407373, 407375, 407377-407380, 407382-407385, 407387-407388, 407390, 407394-407396, 407398-407404, 407406, 407409-407411, 407415-407421, 407424-407425, 407428, 407430, 407432-407434, 407436-407447, 407450-407462, 407464, 407468-407471, 407473-407475, 407477, 407479, 407481, 407483-407487, 407489, 407491-407492, 407495-407496, 407498-407499, 407501-407502, 407504-407506, 407508-407515, 407518-407519, 407521, 407524-407527, 407529-407530, 407534-407537, 407539-407543, 407547-407548, 407550, 407552, 407554-407560, 407562-407564, 407566, 407569-407570, 407573-407574, 407576-407578, 407580-407583, 407585-407586, 407592-407596, 407598, 407600, 407602-407603, 407606-407609, 407611-407613, 407617-407621, 407623-407625, 407627, 407629-407631, 407633-407636, 407639, 407641-407642, 407644-407654, 407656-407661, 407663-407666, 407668-407671, 407674, 407678-407680, 407682, 407684-407690, 407692-407698, 407702-407711, 407713-407715, 407717-407719, 407721-407723, 407729-407731, 407735-407738, 407740, 407747-407750, 407752-407754, 407756-407762, 407764, 407767, 407769-407770, 407772-407784, 407786, 407789-407797, 407805-407807, 407809-407814, 407816-407817, 407819-407824, 407827, 407831-407832, 407834-407839, 407841-407842, 407845-407847, 407852-407857, 407859-407861, 407863-407865, 407869-407874, 407876-407877, 407880-407882, 407884-407886, 407888-407891, 407895-407899, 407902, 407905-407906, 407908-407910, 407912-407913, 407922-407924, 407926-407927, 407930, 407935, 407937-407940, 407943, 407946, 407948, 407952-407959, 407962, 407964-407966, 407968, 407970-407974, 407978, 407982-407986, 407990-407991, 407993-408000, 408003, 408005, 408007-408011, 408013-408015, 408017-408019, 408021-408024, 408028-408039, 408041-408042, 408044-408047, 408049-408050, 408052-408055, 408057, 408059-408060, 408062-408064, 408066-408075, 408077-408079, 408081, 408083-408087, 408089, 408092-408095, 408097, 408099-408112, 408114-408115, 408119-408123, 408125-408127, 408129-408130, 408132, 408135, 408138-408140, 408142-408149, 408153-408154, 408156-408157, 408159-408161, 408164, 408166-408167, 408169, 408171, 408176, 408178, 408181, 408183, 408186-408187, 408189-408190, 408193, 408195-408197, 408199-408201, 408203-408205, 408208, 408213-408215, 408217-408220, 408225-408228, 408230-408235, 408239, 408241-408242, 408246-408247, 408250-408255, 408257-408260, 408262, 408264, 408266-408270, 408273, 408275-408283, 408285, 408287-408298, 408301-408302, 408305, 408308-408309, 408311-408314, 408316-408331, 408333-408336, 408338-408341, 408343, 408347, 408351-408359, 408365-408367, 408369, 408371, 408373, 408375-408376, 408378, 408380, 408382, 408384, 408386-408387, 408389, 408391-408393, 408395-408400, 408407, 408410-408417, 408421-408422, 408425-408426, 408429-408432, 408434-408447, 408449-408453, 408455-408458, 408460-408462, 408464-408465, 408467-408468, 408474-408487, 408491-408497, 408499-408506, 408512, 408518-408520, 408522-408526, 408531, 408534-408537, 408539, 408543-408545, 408549, 408556, 408560, 408562-408563, 408565-408567, 408569-408575, 408578, 408583, 408586-408590, 408592-408594, 408596, 408598-408600, 408604-408606, 408609-408610, 408612-408613, 408615-408618, 408620-408621, 408627-408639, 408641-408650, 408653, 408658-408661, 408665-408669, 408671, 408673, 408677-408680, 408682, 408684-408687, 408689-408699, 408701, 408703-408706, 408708-408713, 408716-408721, 408725, 408730-408731, 408734, 408736-408764, 408766-408773, 408775-408784, 408786-408790, 408794-408795, 408797, 408799, 408802, 408810-408817, 408819-408820, 408823, 408825-408826, 408829-408830, 408835, 408839-408847, 408849-408850, 408853-408858, 408861-408864, 408868-408875, 408877, 408880-408882, 408885-408888, 408891, 408893, 408899-408900, 408903-408905, 408907, 408912-408914, 408916-408918, 408923-408925, 408927, 408930-408935, 408937, 408940-408941, 408944, 408946, 408949-408951, 408955, 408959-408963, 408970-408972, 408974-408976, 408979-408981, 408983, 408985-408988, 408991-408994, 408996-408997, 409000-409001, 409004, 409006-409007, 409010, 409013, 409017-409018, 409020-409030, 409032, 409034, 409038, 409041-409045, 409047-409050, 409053-409061, 409063-409064, 409067-409073, 409077-409094, 409097-409100, 409102-409115, 409117, 409120-409124, 409126-409131, 409135-409138, 409142-409148, 409150-409151, 409153-409154, 409158-409176, 409178-409181, 409183-409186, 409188-409190, 409192-409194, 409198-409199, 409202, 409206-409210, 409212, 409214-409217, 409220-409222, 409226, 409228-409230, 409233, 409236-409237, 409241-409244, 409251, 409253-409254, 409261-409265, 409267, 409269-409272, 409275, 409277-409278, 409280, 409282, 409288-409293, 409295, 409297-409301, 409304-409306, 409311-409312, 409318-409320, 409322, 409325-409326, 409328, 409330-409331, 409333-409336, 409340-409343, 409346, 409349-409352, 409356, 409358, 409360-409363, 409370, 409373-409377, 409381, 409384, 409388-409390, 409392-409393, 409395-409396, 409398-409400, 409403-409404, 409406-409409, 409411-409424, 409426, 409428-409437, 409439-409444, 409446-409448, 409451, 409453-409455, 409457-409460, 409462-409464, 409466, 409468-409477, 409479-409481, 409483, 409485-409486, 409488-409489, 409492-409494, 409496-409499, 409502, 409504-409505, 409510-409513, 409516, 409521-409528, 409531, 409534-409537, 409539, 409541-409544, 409546-409551, 409554-409564, 409568-409569, 409571-409573, 409575-409577, 409579-409580, 409582, 409584, 409587, 409594-409595, 409598-409601, 409603-409608, 409610, 409613-409617, 409619-409623, 409625-409626, 409628-409629, 409631-409632, 409634, 409637-409642, 409644, 409648, 409651, 409654-409655, 409657, 409662, 409664, 409666-409667, 409671, 409674-409677, 409680-409689, 409691, 409693-409696, 409698-409699, 409701-409706, 409708-409710, 409712-409718, 409722-409723, 409725-409728, 409731-409737, 409739-409741, 409744, 409746-409757, 409761, 409763-409764, 409766-409775, 409778, 409781, 409783, 409788, 409790-409793, 409795-409796, 409804-409805, 409807-409811, 409813, 409815-409818, 409821-409824, 409826-409828, 409831, 409833, 409835-409837, 409841-409842, 409845-409849, 409851-409854, 409856-409858, 409860-409868, 409870-409871, 409873-409875, 409878-409879, 409881, 409886-409888, 409891-409892, 409894-409896, 409898-409899, 409901-409906, 409909-409910, 409914-409918, 409921-409934, 409938-409944, 409947-409948, 409950-409955, 409957-409967, 409969-409970, 409972, 409974-409975, 409977, 409980-409990, 409992-409993, 409995-409996, 409998, 410000, 410003, 410005, 410007, 410009-410010, 410012-410015, 410019-410023, 410027, 410030-410031, 410035, 410039, 410041-410043, 410045-410047, 410049, 410051, 410053-410056, 410058-410060, 410065, 410067-410072, 410075-410076, 410078, 410080, 410082-410084, 410086-410092, 410094, 410096-410101, 410103, 410105-410111, 410116, 410118, 410120-410123, 410125-410132, 410139, 410144-410159, 410161-410162, 410164, 410167-410171, 410173-410176, 410178, 410180-410183, 410185-410186, 410189-410193, 410195, 410200, 410205-410209, 410213, 410215-410222, 410225, 410230-410234, 410236, 410239-410242, 410244-410245, 410249-410257, 410259, 410263, 410265, 410268-410270, 410272-410273, 410275-410282, 410284-410285, 410288, 410290-410291, 410294, 410298-410306, 410309, 410312-410317, 410320-410323, 410326-410336, 410339-410340, 410343, 410345-410346, 410348, 410351-410352, 410355-410356, 410362, 410364-410366, 410370-410378, 410380, 410382-410385, 410391, 410395, 410397-410401, 410404, 410407-410413, 410415, 410417, 410419, 410421, 410423, 410426, 410428, 410430-410431, 410433, 410435, 410437-410444, 410447, 410449, 410451-410452, 410457-410461, 410463-410465, 410467-410471, 410473, 410476, 410479-410480, 410482-410485, 410487-410490, 410496-410499, 410501, 410504-410508, 410510-410512, 410515-410517, 410519-410520, 410522-410529, 410531-410533, 410535, 410537-410538, 410541-410542, 410545-410549, 410551, 410553-410556, 410558-410564, 410567, 410569, 410571-410573, 410576-410580, 410583-410593, 410601-410606, 410609, 410611-410621, 410623-410640, 410644-410646, 410648-410650, 410653-410655, 410658-410665, 410667-410670, 410673-410678, 410681-410682, 410684-410685, 410687-410692, 410694-410698, 410700-410705, 410707-410711, 410714-410715, 410717-410718, 410720, 410722-410726, 410728-410730, 410734-410738, 410740, 410742, 410745-410748, 410750, 410752, 410754, 410757-410762, 410764, 410766, 410769-410771, 410775, 410780-410784, 410786-410800, 410803-410808, 410810, 410813-410814, 410818-410823, 410825, 410827-410835, 410837-410839, 410842, 410844-410849, 410851-410855, 410857-410860, 410862-410864, 410866-410874, 410877-410880, 410883, 410886-410887, 410890, 410892, 410895, 410897-410901, 410904, 410907, 410910-410914, 410918-410920, 410922, 410924, 410927-410928, 410930, 410934, 410936-410938, 410942-410944, 410947-410948, 410950-410953, 410955-410958, 410960, 410963, 410966-410968, 410972-410976, 410978-410979, 410981-410982, 410984-410985, 410987-410988, 410990-410991, 410993, 410997-411005, 411008-411016, 411018-411021, 411023, 411026, 411028-411029, 411031, 411033-411035, 411038-411039, 411042, 411044-411047, 411049-411050, 411056-411057, 411059-411064, 411066-411085, 411090-411094, 411096, 411100, 411103, 411106-411107, 411109, 411116, 411118-411122, 411124, 411128, 411131-411134, 411136-411141, 411144, 411146, 411148, 411150, 411153-411154, 411157-411158, 411160-411162, 411164, 411166, 411168, 411170-411171, 411173-411174, 411177-411186, 411188-411189, 411192-411196, 411198, 411200-411202, 411204-411205, 411207-411210, 411219-411222, 411224-411227, 411238, 411242-411245, 411248-411249, 411252, 411254-411256, 411260, 411264, 411266, 411269, 411271, 411273-411276, 411278, 411280, 411282-411283, 411285-411287, 411291-411298, 411300-411301, 411307-411310, 411312-411333, 411335-411337, 411339-411342, 411344, 411347, 411349-411352, 411354-411355, 411357-411358, 411360, 411362-411364, 411366-411373, 411375-411379, 411381, 411383-411386, 411388-411391, 411393-411395, 411397, 411399-411401, 411403-411405, 411407-411409, 411411-411414, 411416-411420, 411422-411424, 411430, 411432-411434, 411436-411440, 411442-411446, 411448, 411450, 411452, 411454-411460, 411462, 411464-411476, 411479-411484, 411486-411487, 411489-411491, 411493-411495, 411497-411498, 411500-411503, 411505, 411508-411515, 411517-411521, 411523, 411525-411529, 411531-411534, 411538-411541, 411545-411547, 411549, 411552-411553, 411555-411559, 411562-411566, 411568, 411571-411575, 411577-411581, 411583-411584, 411586, 411589-411591, 411594-411595, 411597-411599, 411605, 411609, 411613-411614, 411616, 411620, 411622-411623, 411626, 411630-411631, 411633, 411635, 411637-411640, 411644, 411647-411648, 411650, 411655, 411659-411660, 411664, 411666, 411673-411674, 411677, 411679-411684, 411686, 411688-411697, 411699, 411703-411704, 411706, 411709, 411712-411719, 411721-411725, 411727, 411729-411731, 411733, 411742-411743, 411749, 411752-411753, 411755, 411757-411758, 411761-411762, 411764, 411768, 411771-411772, 411774-411775, 411777, 411781-411782, 411784, 411786-411792, 411794, 411798, 411801, 411803, 411805-411811, 411814-411817, 411819, 411821-411823, 411830-411832, 411835-411836, 411839, 411841-411860, 411862, 411864, 411868, 411870-411872, 411874, 411878, 411880, 411883-411886, 411889, 411894-411895, 411898-411901, 411906, 411908-411909, 411915, 411917, 411920, 411923-411926, 411929, 411931-411935, 411937, 411939-411941, 411949, 411951, 411954-411955, 411958, 411962, 411968, 411971-411977, 411979, 411983-411984, 411988-411989, 411991-411994, 411996-411999, 412001-412004, 412006-412009, 412011-412016, 412018-412021, 412023-412024, 412027-412033, 412037-412044, 412046-412050, 412052, 412054-412058, 412065, 412067, 412069-412072, 412077, 412080-412093, 412095, 412098-412099, 412101-412103, 412105-412106, 412108, 412110, 412116, 412120-412124, 412127-412128, 412130-412132, 412134-412141, 412143, 412146-412159, 412161, 412163-412164, 412166-412169, 412171, 412174-412178, 412180-412183, 412191-412193, 412195, 412199-412203, 412206-412209, 412212, 412216, 412222, 412225, 412229, 412231-412235, 412238-412239, 412241, 412245-412247, 412249-412251, 412256, 412258, 412260-412261, 412263, 412265, 412271-412272, 412274, 412279, 412281-412286, 412290-412291, 412293, 412296, 412301-412304, 412307-412312, 412314, 412316-412322, 412324-412327, 412333-412342, 412345-412346, 412349, 412351-412353, 412356-412360, 412362-412365, 412367-412371, 412373-412378, 412383-412384, 412386-412389, 412391, 412393, 412398-412404, 412406-412409, 412411-412412, 412414-412419, 412422-412428, 412430-412431, 412434, 412436, 412438, 412442-412443, 412445-412449, 412451-412452, 412454, 412458-412461, 412463-412467, 412471-412472, 412474-412475, 412477-412479, 412483-412488, 412490-412493, 412497-412503, 412505-412510, 412512-412518, 412520-412529, 412531-412533, 412535-412537, 412540, 412542, 412544-412555, 412561-412565, 412569-412570, 412573-412576, 412580-412586, 412588, 412590, 412592-412593, 412596-412598, 412600-412607, 412609, 412611-412614, 412617, 412619-412621, 412625-412631, 412635-412638, 412641-412643, 412645, 412647-412653, 412655-412663, 412665-412678, 412680-412681, 412683-412690, 412693-412695, 412699-412701, 412703-412704, 412706-412713, 412716-412722, 412724, 412726, 412728-412730, 412735-412740, 412742, 412745-412755, 412757, 412759-412761, 412763-412767, 412770-412771, 412773-412775, 412777-412780, 412783, 412785-412787, 412793-412798, 412801-412802, 412804-412806, 412810, 412812-412814, 412816-412819, 412822, 412825-412827, 412830, 412834, 412837-412839, 412841, 412843-412844, 412849-412850, 412852-412853, 412855-412863, 412865-412867, 412869, 412871-412872, 412875-412876, 412878, 412880, 412882-412888, 412890, 412892, 412894-412896, 412898, 412901-412903, 412906-412910, 412913, 412915-412917, 412919-412920, 412922-412923, 412926-412933, 412935-412940, 412942-412943, 412945, 412947, 412951, 412959, 412961-412962, 412964-412967, 412971-412976, 412979-412980, 412984-412985, 412988, 412990-412995, 412997, 412999-413001, 413005, 413007, 413014-413018, 413020-413022, 413024-413025, 413028-413035, 413038, 413043-413045, 413049-413051, 413054, 413056-413058, 413064, 413066-413068, 413072-413074, 413076, 413084-413085, 413087-413088, 413090-413092, 413094, 413097, 413099-413100, 413102-413107, 413109-413110, 413112, 413115, 413117, 413119, 413121, 413125-413126, 413128-413130, 413135-413137, 413139, 413141, 413144-413149, 413152, 413154-413156, 413160-413170, 413181-413182, 413184-413185, 413188, 413193, 413195, 413197-413198, 413200-413201, 413203-413204, 413206, 413209-413211, 413213, 413215-413219, 413222-413231, 413233-413238, 413240-413244, 413248-413250, 413256-413263, 413265-413267, 413273-413277, 413283-413286, 413288-413291, 413293-413294, 413296-413298, 413300-413315, 413318, 413320-413324, 413326-413331, 413334-413335, 413337-413339, 413342, 413347, 413350-413354, 413356, 413359, 413362-413364, 413366-413369, 413371-413376, 413378, 413381-413389, 413392, 413394-413396, 413398-413402, 413404-413405, 413410, 413412-413413, 413415, 413417, 413419-413421, 413423-413425, 413428, 413430-413432, 413434, 413437-413440, 413444-413446, 413448-413450, 413454, 413456-413457, 413459-413467, 413470-413471, 413474, 413481-413482, 413485, 413487-413492, 413494-413495, 413497-413498, 413500-413502, 413505-413507, 413509, 413512-413514, 413516-413518, 413520-413522, 413524, 413528-413533, 413535-413536, 413539, 413542-413544, 413546, 413549, 413551-413556, 413559-413563, 413565, 413570-413575, 413577, 413579, 413582, 413584-413587, 413589, 413592-413593, 413595, 413600-413602, 413604-413610, 413612, 413614-413616, 413618-413620, 413622, 413624-413625, 413628-413632, 413635, 413637, 413639-413644, 413646-413650, 413653-413655, 413657, 413660-413662, 413665, 413667-413674, 413676-413680, 413682-413688, 413690-413691, 413697-413701, 413704, 413707-413709, 413715-413716, 413718-413723, 413725-413730, 413732, 413741-413747, 413754-413757, 413760-413763, 413765-413766, 413769, 413771-413775, 413780-413782, 413784-413786, 413789-413796, 413798-413799, 413801-413805, 413808, 413810-413812, 413814-413820, 413823-413824, 413827, 413829-413830, 413833-413834, 413836, 413838-413840, 413842-413847, 413849-413850, 413852-413853, 413858, 413860-413865, 413867, 413869-413870, 413877-413882, 413885-413886, 413888-413889, 413891, 413893-413894, 413896-413898, 413904, 413913, 413916-413923, 413925-413932, 413934, 413938, 413941-413942, 413944-413945, 413951-413952, 413954-413966, 413968-413970, 413972, 413974-413977, 413979-413984, 413987-413990, 413992-413993, 413996-413998, 414000-414004, 414006-414011, 414013-414017, 414019-414021, 414025-

414027, 414029, 414031-414040, 414042-414044, 414046-
414049, 414052-414057, 414059-414060, 414062-414063,
414065, 414070-414072, 414076, 414078-414083, 414086-
414094, 414098-414099, 414101-414103, 414105-414106,
414108-414109, 414111-414112, 414114-414124, 414126,
414128, 414130-414131, 414135-414142, 414144-414148,
414151-414152, 414155, 414158-414161, 414163, 414165-
414173, 414176-414188, 414190-414191, 414194, 414196-
414200, 414204-414206, 414208-414210, 414212, 414214-
414215, 414217-414220, 414222-414223, 414226, 414228-
414233, 414235-414236, 414238-414239, 414241, 414245-
414254, 414257-414261, 414264, 414266-414271, 414274-
414277, 414280-414281, 414283, 414288-414289, 414293,
414295-414299, 414302, 414305-414308, 414310, 414312-
414316, 414318-414325, 414327, 414329, 414331-414335,
414337, 414340, 414342-414346, 414348-414356, 414358-
414360, 414363-414367, 414370-414373, 414375, 414378-
414379, 414381-414382, 414384, 414386, 414388-414389,
414391, 414393, 414397-414398, 414400-414402, 414404,
414406-414409, 414418-414420, 414422-414426, 414428-
414431, 414433, 414436, 414438, 414440, 414444,
414446-414450, 414453, 414456-414461, 414464, 414466,
414469-414472, 414477, 414479-414488, 414490-414491,
414493-414498, 414500, 414503-414510, 414512-414519,
414521-414524, 414526-414529, 414537-414539, 414541-
414546, 414548, 414550-414553, 414555-414558, 414560,
414562, 414565-414567, 414569-414572, 414574, 414576-
414578, 414580-414581, 414584, 414587-414588, 414590-
414595, 414599-414603, 414605, 414618-414622, 414624-
414625, 414627, 414630-414632, 414636, 414638, 414640-
414641, 414644-414649, 414653-414655, 414657-414659,
414662-414668, 414670, 414672, 414674-414676, 414679,
414682, 414684-414687, 414690, 414692-414699, 414703-
414704, 414708-414710, 414714, 414716-414723, 414725,
414728, 414731-414732, 414734, 414736-414738, 414740,
414742-414743, 414746, 414748, 414750-414753, 414755,
414758-414759, 414762-414764, 414766-414778, 414781,
414786, 414788, 414790, 414792-414803, 414805-414807,
414809, 414811-414813, 414816, 414820-414821, 414823-
414824, 414828-414833, 414835-414836, 414838-414844,
414846-414849, 414851-414853, 414855-414856, 414858-
414859, 414861-414869, 414871-414873, 414875-414876,
414878, 414880-414881, 414883, 414890-414895, 414897,
414899, 414901-414904, 414906-414909, 414912-414915,
414917-414922, 414924, 414929-414931, 414933, 414935,
414937, 414939-414944, 414947, 414949-414950, 414954,
414957-414961, 414964-414965, 414967, 414969, 414971,
414974-414975, 414978-414982, 414984-414986, 414992-
414993, 414997, 415000, 415002, 415004-415005, 415012,
415014-415025, 415028-415030, 415032, 415036-415037,
415039-415040, 415042, 415044-415045, 415051, 415054,
415057-415072, 415077-415078, 415080, 415082-415085,
415088-415089, 415092-415093, 415095, 415097, 415099-
415103, 415106, 415108-415109, 415111, 415113-415115,
415117, 415119-415120, 415122-415125, 415127-415128,
415131-415137, 415139, 415148, 415150-415153, 415155,
415159, 415163-415170, 415173, 415175-415176, 415179-
415189, 415191-415193, 415195-415197, 415199, 415201-
415204, 415208, 415210-415211, 415219, 415221, 415224-
415229, 415231-415233, 415238, 415240-415241, 415244-
415245, 415248-415250, 415254-415264, 415266, 415269-
415271, 415275, 415278, 415280, 415282-415284, 415287-
415288, 415290, 415292-415296, 415299-415300, 415302,
415304-415308, 415310, 415314-415315, 415317, 415319,
415321-415323, 415325-415327, 415330-415332, 415338,
415341-415352, 415354-415359, 415361-415365, 415367-
415372, 415375-415379, 415383-415389, 415391-415392,
415394, 415398-415399, 415401-415402, 415404, 415407,
415410-415413, 415415, 415422, 415424-415426, 415428-
415432, 415436, 415438-415440, 415442-415443, 415445,
415447-415453, 415455-415456, 415459-415461, 415463,
415470-415476, 415478, 415482-415488, 415490-415495,
415497, 415502-415505, 415508, 415510, 415517-415520,
415522-415526, 415529-415530, 415537-415550, 415553,
415566-415568, 415571-415579, 415582-415586, 415588,
415591, 415595-415597, 415599, 415602, 415606, 415609-
415611, 415616-415619, 415623-415624, 415626-415630,
415632-415635, 415637-415638, 415641-415644, 415646-
415647, 415649, 415651, 415654, 415658-415662, 415666-
415674, 415677, 415679, 415681, 415686-415689, 415692,
415694-415695, 415697-415699, 415702, 415704-415712,
415715-415720, 415722-415731, 415734-415738, 415746,
415748, 415750, 415752-415753, 415755, 415758-415760,
415762, 415764-415767, 415769-415770, 415772-415777,
415780, 415783-415785, 415787, 415791-415793, 415795-
415798, 415800-415804, 415806-415812, 415814, 415816,
415818, 415820, 415822-415823, 415827-415838, 415840-
415844, 415846, 415851, 415853-415855, 415857, 415859-
415860, 415862, 415865-415867, 415869-415874, 415879,
415882-415888, 415891, 415895, 415897-415906, 415908-
415909, 415912-415915, 415918-415920, 415922, 415924,
415926-415928, 415931, 415933, 415935-415936, 415938-
415941, 415943-415946, 415948-415949, 415951, 415956-
415957, 415959, 415961-415962, 415964-415966, 415968-
415971, 415973, 415976-415977, 415984-415986, 415988,
415990, 415992-415994, 415998-416002, 416006-416010,
416012-416013, 416015-416017, 416020-416025, 416027-
416030, 416034-416036, 416038-416040, 416042-416044,
416047, 416051-416052, 416054-416058, 416060-416063,
416066-416067, 416070-416071, 416073, 416075-416076,
416078-416081, 416084, 416087-416096, 416100, 416103-
416104, 416106, 416108-416111, 416113, 416116-416119,
416122-416131, 416133-416135, 416137-416144, 416146-
416152, 416154, 416156-416157, 416159-416160, 416164,
416166-416168, 416171-416175, 416177-416178, 416180-
416187, 416189, 416191-416193, 416198-416205, 416207-
416213, 416215-416217, 416219-416221, 416225, 416229-
416230, 416232-416233, 416235, 416238-416241, 416244,
416246, 416248, 416252-416258, 416262, 416265-416266,
416269-416272, 416274, 416276, 416278, 416280, 416283-
416287, 416292-416296, 416303, 416305-416312, 416314-
416323, 416326, 416331-416336, 416338-416339, 416341-
416342, 416344-416348, 416351-416354, 416356, 416358-
416360, 416364-416369, 416371-416372, 416375, 416381-
416384, 416386-416387, 416389-416403, 416405, 416408-
416411, 416414, 416417, 416419-416421, 416425, 416427,
416429, 416431-416432, 416437, 416442-416444, 416446-
416448, 416450-416453, 416455-416456, 416460-416463,
416465-416466, 416469-416478, 416480-416482, 416484,
416486, 416489, 416492, 416494, 416496, 416498-416500,
416502-416503, 416505-416511, 416513, 416515-416516,
416518, 416520, 416522, 416530-416533, 416539-416541,
416546-416547, 416549-416550, 416555, 416557-416560,
416566, 416568, 416570, 416572-416573, 416575, 416577-
416579, 416581, 416585-416590, 416593, 416595-416603,
416606-416608, 416611-416613, 416615, 416617-416618,
416620, 416624-416626, 416629, 416631-416638, 416640-
416644, 416646-416654, 416657-416660, 416665, 416668-
416671, 416677-416678, 416680-416683, 416685, 416687-
416691, 416693-416699, 416701, 416703-416710, 416712-
416715, 416717-416718, 416720-416724, 416726, 416728-
416731, 416735-416739, 416741-416742, 416745-416746,
416748-416752, 416754-416756, 416758, 416760-416768,
416770-416771, 416773-416775, 416778-416781, 416785-

416786, 416789, 416791-416800, 416802-416803, 416807, 416810-416811, 416814, 416816-416825, 416827-416830, 416832, 416834-416836, 416838, 416840, 416842-416853, 416855, 416858-416859, 416861-416864, 416866, 416868-416871, 416873, 416877, 416879-416880, 416882, 416884-416900, 416902, 416904-416911, 416914, 416916-416918, 416920-416929, 416932-416936, 416938-416944, 416946-416951, 416953-416955, 416957-416960, 416962-416965, 416967-416968, 416971-416976, 416978, 416980-416981, 416983-416984, 416986, 416988-416991, 416993-417000, 417002-417003, 417005-417006, 417009-417011, 417013-417016, 417018, 417020-417025, 417027-417030, 417032-417037, 417040-417043, 417045-417048, 417050-417052, 417054, 417056-417059, 417062-417063, 417065-417071, 417073-417074, 417076, 417079, 417083-417087, 417089-417093, 417095-417101, 417103, 417105, 417107-417111, 417113, 417116, 417118-417122, 417124-417128, 417132-417136, 417138-417145, 417147-417155, 417157-417160, 417162, 417164, 417166, 417168-417172, 417175-417184, 417187-417190, 417192-417195, 417197, 417200, 417203, 417207-417210, 417213-417217, 417221-417227, 417229, 417231-417232, 417234, 417236, 417238-417240, 417242-417245, 417247-417248, 417251, 417253, 417256, 417258-417262, 417264-417266, 417270-417274, 417276-417277, 417280-417285, 417288, 417290-417304, 417306-417311, 417314-417320, 417322-417323, 417325, 417327-417331, 417333-417336, 417338-417343, 417345, 417348-417350, 417353, 417355-417357, 417360-417361, 417363-417366, 417368-417369, 417371, 417377-417379, 417381-417384, 417386, 417388-417396, 417398-417412, 417415-417419, 417429, 417432-417435, 417438-417440, 417443-417444, 417447-417450, 417454, 417456-417464, 417466, 417468, 417471-417473, 417475-417476, 417478-417480, 417482, 417490-417494, 417496-417499, 417501, 417504-417508, 417510, 417513-417516, 417519, 417522-417523, 417527-417528, 417531, 417533-417539, 417542-417544, 417546-417547, 417550, 417552, 417558-417565, 417567, 417570-417571, 417573-417574, 417576-417578, 417581-417582, 417584-417597, 417600, 417602-417604, 417607-417618, 417620, 417624-417628, 417630-417632, 417637, 417639-417648, 417650-417657, 417661-417662, 417664-417667, 417670, 417672, 417674-417679, 417681-417686, 417688-417694, 417696-417698, 417705-417709, 417712-417714, 417717, 417719-417720, 417722-417735, 417738-417742, 417744-417746, 417749-417752, 417755-417756, 417761-417764, 417766, 417768-417771, 417773-417774, 417776-417778, 417780-417782, 417785-417797, 417800, 417803-417816, 417818, 417821-417827, 417829-417833, 417837-417844, 417846-417847, 417850-417852, 417854, 417856-417857, 417859-417863, 417865-417867, 417869-417873, 417875, 417877-417882, 417884-417887, 417890, 417895, 417897-417899, 417908-417910, 417913, 417915, 417917-417922, 417924, 417926-417927, 417929, 417931-417934, 417941, 417943, 417946, 417948-417951, 417953-417958, 417960, 417962, 417967, 417969, 417971-417972, 417974, 417980-417981, 417983-417985, 417987, 417994, 417996-417997, 417999, 418002, 418004, 418009, 418011, 418013, 418015-418016, 418019-418028, 418031, 418034, 418036-418038, 418040-418041, 418045, 418048-418052, 418054, 418056, 418059-418060, 418064, 418066, 418070-418071, 418074, 418076-418077, 418079-418083, 418085-418096, 418099, 418101-418102, 418105, 418112, 418114, 418117-418118, 418120-418121, 418126-418130, 418132-418135, 418138, 418140, 418143-418144, 418146-418150, 418157-418160, 418162-418166, 418169, 418171, 418176-418178, 418180-418187, 418190-418195, 418198, 418202-418207, 418209, 418212, 418214-418215, 418217-418229, 418233-418235, 418244, 418247-418249, 418251, 418257-418262, 418264, 418267-418269, 418271, 418273, 418275, 418279, 418282, 418284-418286, 418288, 418290-418291, 418295, 418300-418302, 418305-418307, 418312, 418315-418317, 418321, 418324-418325, 418328, 418330, 418332-418333, 418335-418338, 418340, 418343, 418349, 418356-418362, 418364, 418366-418368, 418371, 418374, 418376-418380, 418382-418383, 418385-418386, 418388, 418392-418393, 418399-418400, 418402-418403, 418405-418407, 418409, 418411, 418413-418415, 418419, 418421, 418423-418425, 418430, 418432-418433, 418436-418439, 418443-418445, 418451, 418454, 418458-418459, 418463-418464, 418466, 418468, 418470-418472, 418474-418483, 418485-418490, 418494, 418496-418506, 418509, 418511-418512, 418514, 418517-418520, 418522, 418524-418525, 418528, 418530-418532, 418534-418535, 418539-418546, 418548-418550, 418552-418553, 418555-418557, 418559-418561, 418563-418564, 418566-418568, 418570-418571, 418573, 418575-418577, 418580, 418582, 418585-418586, 418589, 418591-418595, 418597, 418599, 418601, 418604-418606, 418608-418609, 418611-418612, 418614, 418616, 418618-418619, 418622-418625, 418628, 418631, 418633, 418635-418637, 418639, 418641, 418643-418646, 418648-418649, 418651-418655, 418658, 418660-418664, 418667-418670, 418672, 418675, 418677-418678, 418682-418692, 418694-418696, 418698-418704, 418707, 418709-418710, 418714-418717, 418719, 418721-418728, 418730-418731, 418734-418735, 418737-418740, 418743-418746, 418748-418749, 418751-418752, 418756-418757, 418759-418762, 418772-418774, 418776-418779, 418781-418788, 418790-418795, 418797, 418801-418804, 418806-418807, 418809, 418811, 418813-418819, 418821-418822, 418824, 418826-418827, 418832-418837, 418839, 418842, 418844-418848, 418850-418856, 418858-418859, 418861-418862, 418865, 418867-418869, 418872-418887, 418890, 418892-418895, 418898, 418903-418904, 418907-418914, 418916-418919, 418922-418926, 418929-418933, 418935-418936, 418938, 418940-418945, 418952, 418954-418955, 418957-418961, 418963-418966, 418968, 418973, 418977-418984, 418986, 418990-418992, 418995, 418997-418999, 419001, 419003-419015, 419021-419023, 419027, 419029-419030, 419033-419034, 419036, 419038-419043, 419045-419052, 419054-419055, 419057, 419059-419060, 419062-419063, 419065-419066, 419068-419077, 419081-419083, 419086-419087, 419089-419096, 419100-419101, 419104-419108, 419111, 419113-419116, 419119, 419121-419127, 419130, 419133-419138, 419141-419143, 419146-419148, 419150-419153, 419155-419167, 419169-419177, 419179-419187, 419190-419193, 419196-419202, 419206, 419209, 419211-419214, 419217-419221, 419223-419224, 419226, 419228-419230, 419232-419235, 419238, 419241, 419243, 419245-419246, 419250-419253, 419255, 419257-419259, 419261-419264, 419267, 419269, 419275-419276, 419278-419287, 419289, 419292, 419294, 419296-419297, 419299-419300, 419303, 419307, 419309-419313, 419316, 419318, 419320-419321, 419324-419335, 419338-419339, 419341-419345, 419352, 419356-419360, 419362, 419364-419365, 419367, 419369-419372, 419375-419377, 419380-419381, 419383-419390, 419393-419394, 419396-419398, 419402-419405, 419407, 419410-419413, 419417-419418, 419420, 419422-419423, 419426, 419428-419432, 419435-419436, 419439, 419441-419443, 419447-419449, 419451-419452, 419454, 419456-419457, 419459-419460, 419463, 419465, 419467-419468, 419470-419471, 419473-419477, 419479-419481, 419484-419485, 419487, 419489, 419492, 419494-419495, 419497, 419500-419502, 419504-419509, 419512-419514, 419516, 419518-419522, 419528, 419531, 419533-419538, 419541-419554, 419556, 419558-419563, 419566, 419570-419579, 419581-419597, 419600-419602, 419604-419609, 419612, 419615-419616, 419618-419619, 419621, 419623-419628, 419632-419645, 419647, 419651-419652, 419655-419656, 419659-419661, 419663, 419665-419667, 419669, 419671-419672, 419675, 419677-419681, 419685, 419687-419688, 419690-419692, 419694, 419696-419699, 419702, 419705, 419707, 419709-419712, 419715-419720, 419722, 419724-419738, 419740-419742, 419745-419748, 419751-419756, 419758-419768, 419774-419777, 419779-419785, 419788, 419790, 419792, 419797-419798, 419801, 419804-419805, 419807, 419809, 419812-419813, 419816-419817, 419819, 419822-419826, 419831, 419833, 419835-419839, 419841-419843, 419845, 419847-419848, 419850, 419852, 419854-419857, 419860-419863, 419865-419866, 419870, 419872-419889, 419893-419895, 419897-419899, 419903, 419905-419907, 419909, 419911-419914, 419917-419918, 419922, 419924, 419926, 419928-419934, 419936-419938, 419941, 419948, 419950-419951, 419953-419956, 419958-419960, 419962, 419965-419969, 419971, 419973-419976, 419978-419983, 419986-419990, 419993-419998, 420000, 420002, 420004-420009, 420012, 420015-420019, 420021-420025, 420027, 420029-420033, 420036-420037, 420039-420040, 420042-420044, 420046, 420049-420052, 420054-420059, 420064, 420067, 420070-420072, 420074-420075, 420078-420081, 420083, 420085-420097, 420100-420102, 420104-420107, 420114, 420116, 420118-420119, 420121-420123, 420125-420126, 420128, 420130-420131, 420138-420146, 420149-420152, 420156-420159, 420162-420165, 420167-420168, 420170, 420172-420177, 420180-420181, 420183, 420185-420188, 420193, 420197-420200, 420202-420204, 420206-420207, 420209-420212, 420215, 420217-420219, 420221-420222, 420224-420227, 420231-420235, 420237-420246, 420248-420256, 420259-420260, 420262-420263, 420265-420267, 420269, 420272-420273, 420275-420277, 420280-420281, 420283-420285, 420290-420292, 420302-420304, 420309, 420311-420312, 420314, 420318-420321, 420323-420328, 420330-420333, 420336-420342, 420346-420349, 420351, 420353-420358, 420362-420364, 420366-420371, 420373-420376, 420379-420382, 420384-420385, 420387-420395, 420397, 420399-420405, 420407-420408, 420413-420415, 420417, 420420-420426, 420428, 420430, 420433, 420435-420436, 420438, 420445-420448, 420450-420456, 420460, 420463-420470, 420472, 420474-420476, 420478, 420480-420485, 420487-420495, 420497-420500, 420502, 420505-420506, 420509, 420511-420516, 420518-420520, 420523-420524, 420527-420530, 420532-420541, 420543, 420547-420550, 420552-420562, 420564-420568, 420571-420572, 420574-420581, 420583, 420588-420590, 420593-420597, 420599-420603, 420605-420607, 420612, 420614-420623, 420626-420630, 420632, 420634, 420639-420641, 420643, 420647-420648, 420650-420658, 420661, 420663-420668, 420670-420671, 420674-420675, 420677-420680, 420683-420685, 420688-420689, 420691-420695, 420697-420702, 420704-420708, 420711, 420714-420716, 420718-420723, 420725-420726, 420729-420733, 420736, 420740, 420742-420747, 420750-420751, 420753-420756, 420758-420759, 420761-420762, 420764-420765, 420767, 420770, 420772-420774, 420776, 420783, 420785-420787, 420790, 420792, 420796-420801, 420803-420810, 420812-420822, 420824-420827, 420829-420830, 420832, 420836, 420839-420846, 420852-420853, 420855, 420857, 420860-420867, 420869-420870, 420875-420884, 420889-420890, 420892, 420896, 420898-420903, 420905, 420908-420911, 420915-420917, 420919-420920, 420923-420933, 420936-420941, 420943-420946, 420948, 420950, 420953-420958, 420960-420967, 420970-420972, 420974-420976, 420978-420982, 420985, 420987-420988, 420990-420991, 420995, 420997, 421000-421001, 421003-421004, 421006-421009, 421015-421018, 421020-421023, 421025, 421027, 421031-421035, 421037, 421039, 421042-421043, 421046, 421048-421052, 421055-421056, 421058-421062, 421064, 421067, 421072, 421076-421080, 421082-421083, 421086-421087, 421089-421093, 421096, 421098-421099, 421101-421105, 421108-421120, 421123, 421125-421126, 421129-421135, 421137-421138, 421141-421142, 421144, 421146, 421148-421150, 421152-421155, 421157, 421159, 421161, 421163-421168, 421171-421174, 421176-421181, 421183-421184, 421187, 421189, 421191, 421195-421199, 421201-421202, 421204-421210, 421212-421217, 421219-421225, 421227-421229, 421232-421234, 421236-421239, 421242-421243, 421249-421250, 421252, 421254, 421256-421257, 421259-421260, 421262, 421265-421272, 421274-421281, 421285-421293, 421295-421301, 421304-421305, 421308, 421310-421324, 421327-421331, 421334, 421336-421338, 421344, 421346-421351, 421354, 421356-421363, 421365-421367, 421369-421371, 421373-421374, 421376-421378, 421381, 421383-421386, 421389, 421391-421392, 421397-421401, 421403-421406, 421410-421411, 421413-421416, 421418, 421420-421426, 421429-421435, 421438, 421440, 421446-421447, 421456-421458, 421461, 421463-421464, 421466, 421469-421477, 421479-421483, 421485-421486, 421488-421490, 421493-421494, 421496, 421498, 421502-421507, 421513-421514, 421516-421519, 421521-421523, 421530, 421533, 421535-421536, 421538, 421540, 421543, 421547-421548, 421551, 421558-421563, 421569, 421571, 421581-421586, 421588, 421590, 421594-421598, 421600-421603, 421606-421607, 421609-421611, 421613-421622, 421624, 421626-421628, 421630, 421632-421633, 421636-421637, 421639-421641, 421643-421663, 421665-421666, 421668-421675, 421677, 421679-421681, 421684-421688, 421690-421696, 421700, 421703-421711, 421714-421716, 421718-421719, 421723-421725, 421727-421730, 421732-421734, 421737-421740, 421742, 421745, 421747-421748, 421751, 421754-421758, 421760, 421762-421763, 421766-421769, 421771-421774, 421776-421778, 421780, 421782, 421784, 421786-421787, 421790, 421792, 421794-421795, 421798, 421801, 421803-421815, 421822-421823, 421825-421827, 421829-421832, 421835, 421838-421842, 421844-421845, 421848-421853, 421856, 421858, 421860-421863, 421865-421870, 421872-421875, 421877-421879, 421881-421887, 421889-421890, 421894-421895, 421897-421898, 421900-421909, 421911, 421913-421915, 421918-421919, 421921-421922, 421924, 421926-421930, 421932, 421935, 421938-421939, 421941, 421943-421944, 421946, 421948-421950, 421953-421955, 421959, 421961-421963, 421965-421966, 421968, 421970-421973, 421975, 421978-421979, 421981, 421984-421985, 421987, 421989, 421993-421994, 421996-421998, 422000-422003, 422005, 422007-422010, 422013-422014, 422016-422021, 422024, 422027, 422029-422034, 422036, 422039, 422041, 422043, 422048, 422050-422052, 422054-422059, 422061, 422063-422065, 422068-422069, 422071, 422076-422077, 422079-422081, 422083, 422085-422089, 422091-422096, 422098, 422100-422101, 422108-422111, 422116, 422119, 422121, 422123-422124, 422127, 422130, 422136, 422138-422147, 422152, 422155-422156, 422158-422161, 422166, 422168-422169, 422171-422172, 422174, 422176-422178, 422180-422181, 422183-422191, 422197-422201, 422203-422205, 422207-422208, 422210-422212, 422214-422215, 422217-422222, 422225-422227, 422229, 422231-422234, 422238-422239, 422241-422242, 422246-422251, 422253, 422255-422261, 422263-422265, 422270-422271, 422273-422274, 422279, 422281-422284, 422289-422296, 422298, 422300-422308, 422313-422314, 422316-422317, 422319-422321, 422323, 422325, 422328, 422332-422335, 422337-422338, 422341-422343, 422345, 422349, 422352-422361, 422365-422377, 422380-422381, 422383, 422387-422389, 422391-422395, 422397-422398, 422400-422401, 422403-422411, 422413, 422416, 422422, 422424-422426, 422429-422433, 422435-422436, 422439-422443, 422445-422455, 422458-422465, 422467-422468, 422470-422473, 422475-422478, 422481-422483, 422485, 422488-422489, 422492-422494, 422496-422499, 422501, 422504, 422506, 422508-422518, 422520, 422526, 422528, 422532, 422534-422536, 422538, 422541, 422543-422544, 422546, 422548, 422550, 422552-422554, 422557, 422559-422566, 422570, 422574-422575, 422577-422579, 422581, 422584-422585, 422587-422588, 422590, 422592-422593, 422595, 422598-422600, 422602, 422604, 422606-422607, 422609-422616, 422619-422620, 422622-422623, 422625-422626, 422628-422631, 422633-422635, 422637, 422639, 422642, 422644, 422646, 422650-422652, 422654, 422658, 422660-422661, 422663-422664, 422667-422670, 422672, 422675-422676, 422678, 422680-422685, 422687, 422689, 422691, 422694, 422696-422698, 422706, 422708-422709, 422712-422713, 422718-422720, 422723, 422725-422726, 422728, 422730-422733, 422736-422739, 422741, 422743-422745, 422747, 422750, 422752-422754, 422756-422757, 422759, 422762-422763, 422769-422771, 422773-422774, 422779, 422782-422785, 422790, 422792, 422795-422798, 422800-422804, 422806, 422808, 422810, 422812-422817, 422821-422828, 422834-422835, 422838, 422840-422842, 422844-422845, 422847-422849, 422851-422853, 422857, 422860-422861, 422863, 422865, 422867, 422870-422876, 422880, 422884-422887, 422890-422891, 422893-422894, 422896-422901, 422906-422910, 422913, 422915-422919, 422921-422925, 422929-422938, 422941, 422944-422945, 422947, 422949-422951, 422956, 422959-422961, 422966, 422971-422972, 422974-422978, 422980-422982, 422984-422985, 422988-422992, 422994-422999, 423002, 423004, 423006-423013, 423016, 423018-423019, 423021, 423023, 423029-423033, 423037-423042, 423044, 423047-423048, 423050-423055, 423059, 423063-423066, 423068-423071, 423075, 423078-423081, 423083-423087, 423089-423093, 423095-423096, 423098-423100, 423102, 423104, 423106-423107, 423109-423112, 423114-423116, 423119-423122, 423127-423128, 423132-423135, 423138-423140, 423142-423143, 423146-423148, 423152-423153, 423155-423157, 423159-423162, 423165-423167, 423169-423172, 423175-423180, 423182-423183, 423185-423187, 423189-423190, 423192-423194, 423196-423202, 423204, 423206-423207, 423212-423214, 423217, 423220, 423222-423224, 423227-423230, 423232-423240, 423242-423245, 423247-423249, 423255, 423257, 423259-423263, 423267, 423271-423273, 423275-423277, 423281-423282, 423289-423292, 423295-423300, 423303-423317, 423319, 423321-423327, 423330-423332, 423334-423335, 423343-423345, 423347-423348, 423350-423356, 423360-423362, 423364-423379, 423381-423383, 423385, 423390-423396, 423398-423399, 423401-423402, 423406, 423408-423412, 423414-423416, 423418-423420, 423422, 423424, 423426-423432, 423435-423437, 423440, 423442-423443, 423445-423456, 423458, 423463-423464, 423468-423474, 423476, 423479-423486, 423488-423489, 423494-423496, 423499-423503, 423505, 423507-423517, 423519, 423521-423533, 423536-423543, 423545, 423548-423552, 423554, 423556-423559, 423561-423563, 423566-423573, 423576-423578, 423581, 423583, 423585-423587, 423589, 423593-423598, 423600-423604, 423607, 423610-423620, 423622-423624, 423626-423628, 423631-423634, 423636-423638, 423640-423651, 423653-423665, 423668, 423671, 423673-423675, 423677, 423679, 423683-423686, 423688, 423690-423692, 423694-423697, 423699, 423701-423703, 423706-423708, 423713-423718, 423720, 423722-423723, 423726, 423729-423730, 423732-423734, 423736-423740, 423743, 423746, 423748-423751, 423754-423756, 423758-423760, 423763, 423767-423774, 423776-423777, 423779, 423782, 423784-423785, 423787-423792, 423794, 423796-423806, 423808-423809, 423811-423813, 423817-423819, 423822-423823, 423825-423830, 423832, 423836-423838, 423840-423841, 423843, 423845-423853, 423855, 423857-423861, 423864-423865, 423867-423868, 423870, 423872-423873, 423875, 423878-423881, 423883, 423888-423890, 423892-423893, 423896-423899, 423901, 423904, 423907-423910, 423912, 423914-423915, 423917, 423920-423927, 423929, 423931-423933, 423935-423942, 423946, 423948-423958, 423961-423963, 423965-423968, 423970, 423973-423975, 423978, 423980-423983, 423987-423989, 423993-423997, 423999-424003, 424005-424006, 424008, 424011, 424015-424016, 424018-424019, 424022, 424029, 424032-424043, 424045, 424047-424051, 424053, 424055, 424058, 424060-424061, 424063, 424065-424067, 424069-424071, 424074-424078, 424080-424081, 424083-424084, 424087, 424089-424112, 424116-424118, 424120-424124, 424126, 424130, 424132-424136, 424138-424140, 424143-424144, 424146-424152, 424154-424157, 424159, 424164-424166, 424168, 424170-424173, 424175-424178, 424180, 424183, 424185-424186, 424188-424189, 424192-424194, 424197-424203, 424206-424208, 424210-424215, 424218-424220, 424224, 424226, 424228-424229, 424231-424232, 424234-424239, 424241-424244, 424246-424249, 424251, 424253-424254, 424256-424257, 424259-424260, 424262-424264, 424267-424268, 424270, 424272-424273, 424278, 424281, 424283-424285, 424287, 424289, 424291, 424293, 424295-424296, 424300-424303, 424306, 424309-424311, 424313-424322, 424325, 424329-424330, 424332-424333, 424335-424336, 424338-424340, 424342, 424345, 424348, 424351-424358, 424360-424362, 424365-424372, 424375-424379, 424382-424383, 424385-424387, 424389-424398, 424400, 424402-424407, 424409, 424411, 424414-424417, 424419, 424421-424427, 424429, 424432, 424434-424435, 424437-424441, 424444, 424446-424448, 424450, 424452-424453, 424456-424458, 424462-424463, 424466-424467, 424469, 424471-424474, 424476, 424484-424488, 424492-424497, 424499, 424501, 424503-424510, 424512, 424514-424518, 424521-424523, 424525-424529, 424531-424537, 424545, 424547, 424550-424555, 424557-424559, 424562-424563, 424567-424573, 424581-424583, 424585-424592, 424594-424598, 424600-424601, 424607-424608, 424611-424613, 424616-424617, 424619-424623, 424625, 424630-424633, 424636-424639, 424642-424643, 424649-424653, 424655-424656, 424659-424671, 424673, 424675-424676, 424678-424685, 424687, 424689-424692, 424695-424696, 424698-424702, 424705-424708, 424710-424711, 424713, 424716, 424721, 424724-424727, 424729-424734, 424736, 424738-424742, 424744-424748, 424751-424752, 424755-424758, 424760, 424762-424763, 424766-424767, 424769-424770, 424773-424775, 424777, 424779-424785, 424787-424792, 424795-424799, 424801-424804, 424806-424812, 424814-424815, 424818, 424821-424822, 424825, 424827-424828, 424830, 424832-424836, 424841-424842, 424845-424852, 424854-424858, 424860, 424862-424872, 424874-424875, 424877-424878, 424880-424881, 424884-424885, 424892-424894, 424896-424897, 424900, 424907-424908, 424910-424911, 424913-424914, 424919-424922, 424926-424928, 424930-424931, 424936-424938, 424940-424942, 424945, 424948, 424950-424951, 424954-424955, 424957, 424961, 424963-424968, 424970-424973, 424975-424977, 424979, 424981-424983, 424985, 424988-424991, 424995-425000, 425002-425004, 425006-425007, 425016-425020, 425023, 425027-425033, 425035-425037, 425039, 425041-425048, 425051-425052, 425060-425064, 425066, 425068, 425071, 425076, 425080-425081, 425084-425085, 425087-425092, 425095-425097, 425099, 425106-425111, 425113-425117, 425119-425128, 425130, 425133-425134, 425137-425141, 425143, 425145-425148, 425150-425154, 425158-425162, 425164-425165, 425167-425169, 425172, 425175, 425177-425178, 425180-425181, 425183, 425185, 425188-425198, 425201-425202, 425209-425214, 425218-425219, 425221, 425223-425225, 425228-425229, 425232-425236, 425239-425242, 425247, 425250-425251, 425253-425258, 425261-425264, 425271-425275, 425279, 425281, 425284-425295, 425298-425301, 425304, 425308-425313, 425315-425318, 425320-425324, 425327-425332, 425334, 425336-425337, 425339-425343, 425345-425348, 425350, 425352-425359, 425363-425368, 425370, 425373-425378, 425382, 425385, 425390-425393, 425395-425398, 425400-425401, 425404, 425410-425414, 425416-425417, 425420-425426, 425428-425430, 425433, 425435-425439, 425441-425445, 425447, 425449, 425451-425452, 425457, 425460-425461, 425463-425470, 425472-425473, 425475-425479, 425481-425482, 425484-425494, 425496-425497, 425499-425500, 425502, 425506-425515, 425518-425521, 425523, 425525-425526, 425533-425536, 425538, 425540-425547, 425549-425550, 425552-425556, 425558-425562, 425564-425566, 425568, 425570-425571, 425573, 425578, 425580-425583, 425588-425590, 425593-425596, 425598-425604, 425606-425607, 425610-425611, 425613-425616, 425618-425619, 425622, 425624-425625, 425630, 425633-425634, 425637-425638, 425640, 425642-425643, 425645, 425647-425653, 425655-425656, 425658-425661, 425667, 425671-425673, 425675-425676, 425679, 425681-425683, 425685, 425688, 425691-425694, 425696-425698, 425700, 425704, 425709-425710, 425713-425716, 425718-425720, 425722-425731, 425733-425735, 425737, 425740-425741, 425743, 425746, 425751-425759, 425761-425763, 425766, 425769, 425772, 425774, 425780-425783, 425785, 425787, 425790-425791, 425793, 425795-425799, 425803, 425806-425807, 425812, 425814, 425816, 425818, 425823, 425827-425828, 425830, 425832-425833, 425835, 425838-425844, 425847, 425850-425851, 425853-425854, 425856-425860, 425862, 425865-425872, 425874, 425876-425879, 425881-425884, 425887-425891, 425895-425898, 425900, 425903-425904, 425910, 425916, 425918-425920, 425922-425925, 425929-425932, 425934, 425936, 425938-425939, 425942-425944, 425947, 425950-425958, 425960, 425962-425965, 425967, 425969-425970, 425972-425980, 425982, 425985, 425987, 425989-425994, 425996-425999, 426001-426004, 426006, 426008, 426012, 426014-426018, 426020-426023, 426026, 426029-426030, 426032-426034, 426037-426038, 426040-426044, 426046-426048, 426053, 426055-426058, 426060, 426062-426063, 426067, 426069-426070, 426072-426081, 426083, 426086-426087, 426089-426094, 426096-426100, 426102, 426104-426105, 426109, 426111, 426114, 426120-426123, 426127-426128, 426130-426131, 426137-426139, 426142-426143, 426145-426147, 426152-426153, 426156, 426158, 426160, 426162-426165, 426169, 426171-426177, 426182, 426185, 426187-426190, 426192-426194, 426198, 426200, 426204-426207, 426210, 426212, 426214-426221, 426223, 426226-426230, 426232, 426234, 426236-426238, 426240-426241, 426243-426245, 426248-426252, 426254-426258, 426260, 426263-426264, 426266-426269, 426273-426275, 426277-426282, 426284, 426286-426287, 426291, 426293, 426295, 426298-426305, 426310-426311, 426313, 426320-426322, 426324, 426326, 426328-426331, 426333-426336, 426338-426341, 426344, 426346-426350, 426352, 426355-426356, 426359-426360, 426362-426371, 426375-426376, 426379-426387, 426390-426391, 426393, 426395-426396, 426398, 426400-426403, 426405-426412, 426414-426416, 426418-426423, 426425-426428, 426430-426431, 426434-426435, 426437-426441, 426444, 426447, 426450-426452, 426454-426455, 426462-426463, 426465-426466, 426468, 426470-426471, 426473-426479, 426481, 426483-426491, 426493, 426496, 426498, 426500, 426502-426507, 426509, 426516, 426518-426520, 426523, 426525, 426530-426535, 426541, 426545-426546, 426548-426551, 426553-426555, 426557-426558, 426560-426561, 426564, 426568, 426573, 426575, 426577-426585, 426588, 426594-426597, 426599-426605, 426607, 426609, 426613-426615, 426618, 426620, 426627, 426629, 426631-426635, 426640-426644, 426646-426647, 426649-426651, 426656-426657, 426660-426661, 426663-426664, 426666-426668, 426670, 426672, 426674-426686, 426692, 426695-426698, 426701, 426703-426704, 426706-426713, 426715, 426717, 426721-426722, 426725-426726, 426728, 426730, 426732-426733, 426735-426736, 426739, 426745-426746, 426757, 426760-426761, 426763, 426766, 426768-426769, 426772, 426775-426780, 426782-426786, 426790-426791, 426793-426794, 426796, 426798-426799, 426804-426806, 426808-426810, 426813-426814, 426816-426817, 426819-426821, 426825-426834, 426836-426841, 426844-426845, 426847-426850, 426854, 426856-426863, 426866, 426868-426877, 426879-426883, 426885, 426887-426888, 426892-426901, 426903-426916, 426918-426920, 426923-426927, 426929-426931, 426933-426935, 426937-426939, 426945-426953, 426955, 426959-426963, 426967-426968, 426974, 426976-426977, 426979-426980, 426983, 426985-426988, 426992-426997, 426999-427000, 427003-427005, 427007, 427010-427011, 427013-427014, 427016-427023, 427027-427035, 427039-427041, 427043-427052, 427054, 427056-427057, 427059-427063, 427067, 427070-427072, 427076-427088, 427090-427091, 427094, 427096-427097, 427099-427101, 427103, 427106-427108, 427110, 427113-427118, 427120, 427123-427130, 427134, 427136-427139, 427143-427147, 427149-427156, 427158-427160, 427162-427166, 427168-427169, 427171, 427173, 427175, 427178, 427181-427182, 427184-427186, 427188-427189, 427192, 427195-427199, 427201-427203, 427205-427208, 427210-427216, 427218-427221, 427223-427225, 427228-427234, 427238, 427240-427243, 427245, 427247, 427249-427252, 427254, 427257, 427259, 427261, 427264-427272, 427275-427278, 427280-427282, 427285-427290, 427292-427293, 427296, 427299-427302, 427304-427306, 427308, 427311-427312, 427314-427327, 427329, 427334, 427337-427338, 427341-427342, 427345, 427347, 427350-427351, 427353-427358, 427360-427366, 427368, 427370-427376, 427378-427380, 427382-427391, 427396, 427399-427400, 427406, 427408-427409, 427411-427412, 427414-427416, 427418-427419, 427425-427427, 427429, 427436-427437, 427439-427440, 427442, 427446-427456, 427459, 427461-427466, 427469-427475, 427477-427480, 427482-427487, 427489, 427491, 427493, 427495, 427500, 427503-427504, 427509-427513, 427517, 427521, 427523-427526, 427528, 427530, 427533, 427535-427539, 427541-427547, 427550, 427552, 427554-427559, 427561-427562, 427564-427567, 427569-427570, 427572, 427575-427576, 427578, 427580, 427582-427585, 427587-427588, 427592-427593, 427598-427599, 427603-427604, 427606-427611, 427613-427620, 427622-427625, 427628, 427630, 427635, 427638, 427640, 427643-427646, 427648-427653, 427655-427656, 427658, 427660-427665, 427667, 427669-427670, 427674-427678, 427680, 427682, 427684, 427686-427687, 427690-427693, 427695-427698, 427701-427703, 427705, 427707, 427709-427713, 427715-427717, 427720, 427722, 427725-427734, 427736-427737, 427740-427742, 427744, 427747-427752, 427754-427760, 427762, 427764-427766, 427774-427775, 427778-427785, 427787, 427789, 427791, 427794-427796, 427798, 427800-427802, 427804-427805, 427808-427811, 427814-427816, 427818-427819, 427821-427829, 427831-427834, 427836-427837, 427839-427841, 427843, 427845, 427848-427855, 427857, 427859, 427861, 427863-427864, 427866-427867, 427869-427872, 427874, 427876-427881, 427883-427885, 427888, 427890-427891, 427896-427907, 427909-427913, 427916-427918, 427920, 427922-427925, 427927-427933, 427935-427937, 427939-427941, 427943, 427945, 427947-427948, 427950-427952, 427954-427955, 427957-427958, 427960, 427962, 427964, 427966-427967, 427969, 427971-427974, 427976, 427982-427984, 427986, 427988-427991, 427993-427994, 427997-428000, 428002-428003, 428008-428010, 428012, 428015-428016, 428018-428021, 428023-428025, 428028, 428030-428031, 428033-428034, 428036, 428038-428041, 428045-428057, 428059-428061, 428063-428069, 428073, 428075-428078, 428080-428082, 428084-428087, 428089-428094, 428096-428097, 428099-428100, 428103, 428105-428110, 428112, 428114-428117, 428120-428122, 428125-428130, 428132-428133, 428135, 428137, 428139, 428141-428142, 428144-428145, 428148-428150, 428152, 428154-428155, 428157-428161, 428163, 428165, 428167, 428171-428174, 428176-428187, 428189-428194, 428196-428197, 428199, 428203-428205, 428207, 428209-428210, 428213-428214, 428216, 428219-428223, 428227-428230, 428232-428233, 428235-428236, 428238-428240, 428246-428249, 428251, 428253, 428255, 428257-428259, 428261, 428263-428273, 428278-428279, 428283-428291, 428293-428294, 428296-428297, 428300, 428302-428303, 428306-428308, 428312, 428314, 428317, 428320-428321, 428323-428326, 428330, 428332-428336, 428338-428339, 428342, 428344, 428346-428348, 428350-428352, 428355, 428357-428360, 428362, 428365-428369, 428371-428372, 428374, 428376, 428378-428380, 428382-428384, 428388, 428390-428392, 428394, 428399-428400, 428403-428404, 428408-428409, 428411-428413, 428415-428416, 428418, 428423-428424, 428427, 428430-428431, 428433, 428437-428441, 428443-428446, 428448-428456, 428458, 428460, 428462, 428466, 428468-428469, 428471, 428474-428476, 428479-428481, 428485-428486, 428488-428492, 428494-428498, 428500, 428502-428508, 428511, 428513, 428516-428517, 428519-428524, 428526-428527, 428530-428533, 428535, 428537, 428539, 428541-428544, 428546-428548, 428550-428556, 428558, 428561, 428563-428565, 428569, 428571-428574, 428576, 428578-428579, 428581-428584, 428586-428588, 428591-428597, 428599, 428605-428607, 428609-428610, 428613-428615, 428618, 428620-428621, 428625-428629, 428632, 428634-428645, 428647-428648, 428650-428651, 428654-428657, 428659-428660, 428662-428665, 428667-428669, 428672, 428674-428681, 428683, 428685-428688, 428691-428697, 428699-428708, 428710-428716, 428718, 428721-428722, 428725, 428727-428733, 428735-428749, 428754-428764, 428766-428767, 428781-428782, 428785-428791, 428793-428796, 428798-428804, 428807-428809, 428816-428818, 428820-428821, 428824, 428826, 428828-428829, 428831, 428834-428836, 428838-428839, 428841, 428843-428844, 428847, 428852-428853, 428857-428858, 428861-428866, 428868, 428870-428871, 428874, 428881-428887, 428889-428897, 428899-428900, 428903-428906, 428909-428913, 428915-428917, 428919-428922, 428924-428925, 428927-428929, 428931-428933, 428939-428941, 428944-428945, 428948-428949, 428952-428954, 428959-428961, 428964-428966, 428970-428972, 428975, 428977-428981, 428985, 428988-428989, 428991-428994, 428999, 429001, 429004-429007, 429009, 429011-429014, 429016-429017, 429019-429023, 429026, 429029-429030, 429033, 429035, 429037, 429039-429040, 429042-429043, 429045, 429047, 429051-429052, 429054-429055, 429060-429062, 429064-429065, 429067, 429072, 429074-429075, 429077, 429079, 429081-429084, 429086-429088, 429091-429093, 429095-429096, 429098-429105, 429107-429112, 429114, 429121, 429125-429126, 429128, 429130-429133, 429135, 429143, 429147-429149, 429154, 429156, 429158-429159, 429162, 429165-429166, 429168, 429171, 429174, 429176, 429180, 429183-429188, 429191-429196, 429199-429207, 429210, 429212-429214, 429216-429218, 429222-429225, 429227-429228, 429231, 429233-429240, 429242-429244, 429246-429248, 429250, 429253, 429256, 429258-429261, 429265-429268, 429271-429273, 429275, 429279, 429281, 429283, 429287-429288, 429290-429299, 429301-429303, 429306, 429308, 429310-429312, 429318, 429321-429322, 429324-429328, 429331-429333, 429336-429345, 429347, 429350-429352, 429356-429361, 429364, 429366-429373, 429375-429376, 429378-429380, 429383, 429385-429386, 429391, 429394-429395, 429398-429405, 429408, 429410-429414, 429416, 429418-429421, 429423-429428, 429432-429434, 429436-429437, 429439, 429441-429445, 429447, 429449-429450, 429453-429457, 429462-429464, 429466, 429468-429470, 429472, 429475-429483, 429486, 429492, 429495, 429497-429501, 429504, 429509, 429511-429516, 429518-429520, 429522, 429524-429525, 429528, 429531, 429533-429539, 429541-429542, 429545-429546, 429548-429555, 429557-429559, 429562, 429566-429572, 429575-429578, 429580, 429583-429584, 429586-429587, 429589, 429591, 429593, 429596, 429602-429608, 429612, 429615-429617, 429621-429622, 429628, 429630-429632, 429634-429635, 429637, 429640, 429642, 429646, 429649-429651, 429659, 429661-429663, 429665, 429669-429670, 429674-429677, 429680, 429682, 429684-429685, 429687-429688, 429692-429696, 429702, 429707-429710, 429712-429714, 429716, 429719-429727, 429735, 429738, 429742-429747, 429749, 429752, 429754-429756, 429761-429762, 429764-429767, 429769-429770, 429773-429775, 429777-429778, 429783, 429786, 429788-429794, 429796, 429798, 429800-429801, 429806, 429809, 429811-429822, 429824, 429827, 429833, 429835-429840, 429842, 429844, 429846-429847, 429849, 429852-429854, 429856, 429860-429862, 429864-429867, 429871, 429873-429875, 429879-429882, 429884, 429886-429890, 429893-429895, 429897-429898, 429912, 429916, 429918-429920, 429923-429926, 429928-429932, 429938, 429940-429944, 429947-429948, 429950-429953, 429955-429956, 429958-429959, 429961-429969, 429971-429974, 429977-429979, 429981-429986, 429988-429995, 429997, 429999, 430001-430006, 430008-430009, 430011-430013, 430015-430017, 430019, 430021, 430023-430028, 430030-430031, 430033, 430039, 430041-430043, 430045-430057, 430060, 430062-430063, 430065-430069, 430071, 430073-430079, 430081, 430083-430095, 430097-430103, 430108, 430110, 430112-430120, 430124-430125, 430127, 430130, 430133, 430135-430142, 430145-430148, 430150-430151, 430157, 430161, 430168-430171, 430177-430180, 430184, 430187-430190, 430197-430201, 430203-430208, 430210-430211, 430213-430214, 430216, 430218-430219, 430225-430226, 430230-430231, 430234, 430236-430238, 430244-430249, 430251-430253, 430255, 430257, 430260, 430262, 430264-430265, 430267-430274, 430277, 430279, 430285, 430287, 430291-430293, 430295, 430297, 430299, 430301, 430303, 430306, 430309-430310, 430312-430321, 430324, 430326-430327, 430329, 430332-430338, 430340, 430342-430350, 430352-430356, 430358, 430360-430361, 430363, 430365-430369, 430373-430376, 430379-430380, 430382-430384, 430386-

430390, 430392, 430395-430396, 430398-430401, 430403, 430405, 430407, 430409-430410, 430412-430413, 430415-430421, 430423, 430427-430428, 430430, 430432-430433, 430435-430440, 430442-430447, 430453, 430456-430457, 430459-430461, 430463-430464, 430467, 430470, 430472, 430474-430476, 430479, 430482, 430484-430486, 430489-430494, 430497-430498, 430500, 430502-430504, 430506-430508, 430510-430512, 430516, 430518-430528, 430531-430532, 430535-430538, 430543, 430551-430552, 430554-430557, 430559-430563, 430565, 430568-430570, 430572, 430575, 430577, 430582, 430584, 430591, 430593-430596, 430601, 430604-430607, 430609, 430611-430613, 430615, 430619-430620, 430622-430623, 430626, 430628-430629, 430632-430633, 430635-430638, 430640-430641, 430643, 430645-430647, 430649, 430651, 430653-430658, 430660-430662, 430664, 430666-430667, 430669, 430672, 430676, 430679-430681, 430683, 430688-430694, 430697-430699, 430702, 430706-430709, 430711, 430714-430720, 430722-430723, 430725, 430731, 430734-430739, 430743, 430746, 430751-430752, 430755-430756, 430761-430762, 430764, 430766-430767, 430771-430772, 430776, 430778, 430780, 430789, 430791-430793, 430795-430796, 430802, 430804, 430806-430807, 430809, 430815, 430818, 430820, 430822, 430824, 430827-430828, 430830, 430834, 430841, 430845-430847, 430849, 430851, 430854, 430861-430862, 430865-430867, 430870, 430874, 430876, 430878-430886, 430888, 430890, 430893-430898, 430900, 430904, 430906, 430908, 430910-430912, 430914, 430916, 430918-430926, 430928, 430931, 430938-430940, 430942, 430944-430945, 430947-430948, 430952-430954, 430956, 430958-430962, 430964, 430966-430973, 430975-430978, 430980-430984, 430986, 430988-430990, 430992-430996, 430998-431000, 431002, 431004-431006, 431008-431012, 431014-431015, 431017-431020, 431023-431026, 431028-431031, 431033-431037, 431040-431042, 431044-431046, 431048-431049, 431051-431052, 431055, 431057-431060, 431062, 431068-431071, 431073, 431075-431079, 431081, 431084-431087, 431091-431092, 431094, 431098, 431100, 431102, 431104-431105, 431110, 431112, 431114, 431116, 431120-431121, 431123-431124, 431126-431130, 431132-431135, 431137, 431139, 431142, 431144, 431147-431154, 431157-431161, 431163-431166, 431169-431172, 431174-431182, 431185, 431187, 431189-431191, 431193-431197, 431203-431204, 431206-431209, 431211-431217, 431220-431221, 431223-431224, 431230, 431232-431237, 431239, 431241-431242, 431244-431245, 431248-431251, 431253-431255, 431257-431267, 431269-431270, 431272-431274, 431277-431278, 431280-431284, 431287-431292, 431294-431295, 431299, 431302, 431304, 431306-431308, 431311, 431313-431316, 431318, 431320-431321, 431325, 431327-431332, 431335-431341, 431343, 431349-431360, 431362-431364, 431366-431374, 431376-431384, 431388-431404, 431408-431409, 431411, 431413-431414, 431416-431422, 431424-431426, 431428, 431431-431437, 431439-431442, 431444-431451, 431459-431460, 431462-431467, 431469-431471, 431473, 431475-431482, 431484-431485, 431488-431496, 431499, 431501, 431503-431509, 431511-431531, 431533, 431535-431538, 431541-431549, 431552-431553, 431556-431558, 431560-431566, 431569-431572, 431574-431589, 431591, 431593, 431595-431596, 431598-431600, 431603-431605, 431608-431609, 431612-431613, 431615, 431618-431619, 431624, 431626, 431628-431629, 431632, 431634-431644, 431647, 431649, 431651-431659, 431661-431664, 431667-431669, 431671, 431673, 431675-431680, 431682-431687, 431689-431695, 431697-431705, 431707, 431713-431715, 431717, 431719-431727, 431730-431734, 431736-431739, 431742-431743, 431745-431746, 431748-431750, 431752, 431755, 431758-431769, 431772-431774, 431777-431785, 431787-431788, 431791, 431793, 431795-431797, 431799-431801, 431804-431808, 431810, 431812-431816, 431818, 431820-431822, 431824-431828, 431832, 431838-431855, 431861-431864, 431866-431872, 431875-431877, 431879-431881, 431883-431889, 431892, 431894-431902, 431904-431905, 431907, 431910, 431914-431916, 431918, 431921-431922, 431926-431933, 431937-431940, 431944, 431946-431947, 431951-431954, 431957-431958, 431960-431961, 431964-431965, 431967-431971, 431976-431978, 431980, 431982, 431990-431992, 431995-431997, 432001, 432004, 432006, 432008, 432012-432013, 432015-432019, 432023, 432025-432027, 432029-432032, 432035-432036, 432039-432040, 432042, 432044, 432046-432049, 432054-432059, 432062, 432065, 432067-432069, 432073-432077, 432081-432086, 432088-432090, 432092-432097, 432099, 432103-432104, 432106, 432108, 432111, 432114, 432117, 432119-432120, 432123, 432125, 432127-432128, 432130, 432132, 432136-432139, 432145, 432150-432151, 432153-432155, 432157, 432159-432161, 432163, 432166, 432170, 432172, 432176-432182, 432185, 432187-432188, 432190-432193, 432195-432197, 432199-432201, 432203-432205, 432207-432209, 432211-432214, 432217, 432223-432226, 432228-432229, 432235-432236, 432238-432248, 432250, 432252-432253, 432255, 432257-432262, 432264-432267, 432271, 432273, 432277-432279, 432281-432282, 432284-432288, 432291, 432294, 432301-432302, 432308-432310, 432316-432318, 432325, 432327-432329, 432332, 432334-432336, 432338, 432342-432346, 432354, 432356, 432361-432365, 432367-432370, 432376-432387, 432390-432392, 432396-432398, 432400, 432403-432405, 432409, 432411, 432413-432414, 432417-432423, 432427-432434, 432436-432441, 432449-432451, 432454, 432456, 432460-432465, 432469-432472, 432475-432476, 432479, 432484-432485, 432487, 432489-432490, 432492, 432494, 432497-432498, 432503-432504, 432507-432508, 432513-432516, 432518-432525, 432527, 432529, 432531-432534, 432536-432539, 432543, 432545, 432548, 432550, 432552, 432554-432555, 432557, 432559, 432563, 432565-432569, 432574, 432577-432580, 432582-432584, 432586, 432588-432592, 432596-432598, 432600-432605, 432607-432612, 432614, 432618-432621, 432624-432626, 432628-432629, 432636-432637, 432640-432641, 432643-432644, 432648-432650, 432652-432665, 432667-432669, 432671, 432673, 432675-432678, 432684, 432688, 432691, 432696-432699, 432702, 432705-432706, 432708, 432711-432712, 432714, 432716-432719, 432721, 432723-432726, 432728, 432730-432731, 432733-432734, 432736-432738, 432740, 432742-432744, 432746, 432749-432752, 432755-432756, 432758-432760, 432762, 432766-432769, 432771, 432776-432779, 432781-432782, 432786, 432788, 432790, 432792-432793, 432798, 432800-432801, 432803-432804, 432806, 432808-432809, 432811-432815, 432817-432818, 432820, 432823-432827, 432831-432832, 432836, 432838-432839, 432841-432842, 432848-432856, 432859, 432862, 432864-432874, 432876-432878, 432880-432884, 432888, 432890-432897, 432899-432901, 432903, 432905, 432910-432913, 432916, 432919-432921, 432923-432924, 432926-432930, 432932, 432934-432935, 432940-432941, 432943-432945, 432947-432949, 432954-432957, 432960-432964, 432966-432967, 432971-432974, 432976-432983, 432985-432997, 433000, 433002-433004, 433006, 433008-433010, 433012, 433014-433015, 433019, 433022-433024, 433026, 433029, 433031-433034, 433036, 433039-433040, 433043-433050, 433055, 433058, 433061, 433063-433064, 433066-433075, 433077, 433080-433081, 433085-433086, 433088-433092, 433094, 433096-433097, 433100-433102, 433104-433106, 433108-433110, 433112-433120, 433122-

433125, 433127-433137, 433140, 433142-433146, 433148-
433149, 433151-433167, 433169-433176, 433180-433182,
433184-433189, 433191-433195, 433199-433202, 433205-
433207, 433210-433214, 433217, 433219, 433221-433222,
433224, 433228-433236, 433238-433244, 433246-433251,
433255, 433257, 433259-433260, 433264, 433267, 433269-
433271, 433273-433279, 433281-433284, 433286-433290,
433293-433294, 433298-433312, 433314, 433316, 433318,
433320-433322, 433325-433326, 433332-433334, 433338,
433342-433343, 433345-433346, 433348, 433350, 433352-
433355, 433359-433362, 433367-433373, 433380-433384,
433386, 433389-433390, 433393, 433398-433404, 433406-
433408, 433410-433416, 433418-433425, 433427-433428,
433432, 433434-433438, 433443, 433446-433455, 433458-
433470, 433472-433482, 433484-433486, 433488, 433490-
433494, 433496-433498, 433500, 433503, 433505-433512,
433515-433518, 433520, 433523, 433525-433528, 433532-
433535, 433537-433538, 433540-433542, 433544, 433547-
433548, 433550-433557, 433559-433560, 433563, 433565-
433570, 433572, 433574-433575, 433580, 433582, 433584-
433586, 433590-433596, 433603, 433607-433608, 433611,
433613-433615, 433617, 433621-433626, 433628, 433630,
433632, 433634-433637, 433639-433643, 433645-433646,
433648-433649, 433651, 433653-433654, 433656, 433658-
433659, 433661, 433663, 433665, 433667, 433671-433673,
433678-433681, 433683-433684, 433686, 433688-433690,
433693, 433695, 433697, 433699-433700, 433703, 433705,
433709-433712, 433717-433722, 433724, 433727, 433732-
433733, 433736-433737, 433739, 433741-433745, 433747,
433749-433751, 433754-433756, 433758-433762, 433766-
433767, 433769-433771, 433773, 433775-433780, 433782,
433786-433788, 433796-433805, 433807, 433809-433811,
433814-433818, 433820-433825, 433828-433830, 433832,
433836, 433840, 433844-433845, 433847, 433850-433851,
433853-433854, 433856-433858, 433860-433861, 433863,
433867-433872, 433874-433888, 433891-433893, 433895,
433898-433902, 433906-433910, 433912, 433914, 433917-
433919, 433921-433926, 433928-433932, 433934-433939,
433943, 433945-433947, 433949-433962, 433964-433965,
433967, 433970-433972, 433975-433976, 433978, 433982-
433983, 433985-433986, 433988, 433990-433991, 433996,
433998-433999, 434001, 434003, 434005, 434008, 434011,
434014, 434017, 434019, 434021-434026, 434029-434036,
434038-434039, 434041-434042, 434044, 434046, 434049-
434054, 434056-434057, 434059-434060, 434062-434064,
434066-434067, 434069, 434071-434072, 434074, 434077-
434079, 434081-434083, 434086, 434089-434091, 434094,
434096-434099, 434102-434106, 434109-434114, 434116-
434118, 434120-434123, 434125-434132, 434134, 434137-
434138, 434140, 434144-434145, 434147, 434150-434152,
434154-434157, 434159, 434161, 434165-434166, 434170,
434172-434175, 434177-434181, 434183-434184, 434187-
434197, 434199-434205, 434208-434212, 434215, 434218,
434221-434223, 434225-434230, 434233-434235, 434237,
434239, 434241-434242, 434244-434246, 434248-434250,
434252-434259, 434261-434264, 434266-434267, 434270-
434276, 434278, 434282-434283, 434285-434286, 434290,
434292-434293, 434295-434297, 434300-434306, 434308-
434314, 434316, 434319-434325, 434327-434330, 434332-
434336, 434338-434342, 434344-434346, 434348-434350,
434353-434354, 434360-434365, 434368-434369, 434372,
434374, 434376, 434378-434379, 434381-434382, 434385-
434388, 434390, 434393, 434395, 434397-434400, 434402-
434403, 434405-434406, 434409-434410, 434412-434413,
434415, 434417, 434419-434431, 434435, 434438-434439,
434444, 434446-434451, 434453, 434457-434458, 434460-
434463, 434466-434470, 434473-434484, 434487-434489,
434491-434502, 434506-434508, 434510, 434514-434516,
434518-434524, 434530-434532, 434534, 434537-434538,
434540, 434542-434546, 434549, 434551-434552, 434554-
434559, 434562-434563, 434565-434572, 434575, 434579,
434581-434582, 434584-434585, 434587-434593, 434595,
434597-434598, 434600-434604, 434607, 434609, 434612-
434615, 434619-434624, 434626-434627, 434629-434632,
434634-434637, 434639-434640, 434642-434644, 434646-
434647, 434649-434651, 434653-434654, 434657-434658,
434661-434666, 434668-434669, 434672, 434674, 434676-
434685, 434687-434689, 434691-434695, 434697-434699,
434701, 434703-434704, 434708-434710, 434712-434717,
434719-434720, 434723-434725, 434727, 434732-434736,
434738, 434746-434748, 434750, 434753-434754, 434758-
434763, 434765, 434768, 434770-434774, 434776, 434778-
434781, 434783, 434785-434786, 434788, 434793, 434795-
434798, 434800, 434802-434804, 434806, 434810-434814,
434818, 434826-434833, 434835-434836, 434838-434839,
434841-434850, 434852-434858, 434861-434862, 434864,
434866, 434868-434869, 434871-434875, 434877, 434879-
434880, 434884-434891, 434893, 434895-434899, 434902,
434904, 434906, 434909-434910, 434914, 434920, 434922-
434926, 434928-434929, 434931-434936, 434939-434940,
434942-434946, 434949-434953, 434955-434959, 434961-
434962, 434964-434966, 434968, 434971, 434975-434982,
434984-434986, 434989-434990, 434993-434995, 435001,
435004-435005, 435008, 435012, 435014, 435020, 435022,
435024, 435027, 435029-435030, 435032-435033, 435035-
435042, 435044, 435047, 435050-435053, 435055, 435059-
435064, 435068, 435071, 435073, 435075-435077, 435084,
435088, 435090, 435092-435093, 435096-435099, 435101-
435103, 435106-435110, 435112-435113, 435115, 435118,
435120-435121, 435128, 435130, 435132-435135, 435137-
435138, 435141, 435143-435145, 435149, 435151-435152,
435155-435156, 435161, 435165-435166, 435168-435170,
435172, 435174, 435176-435177, 435179-435182, 435186-
435190, 435193, 435195, 435197-435198, 435201-435203,
435205, 435214-435221, 435223-435226, 435228-435230,
435237-435241, 435245, 435247-435254, 435256, 435260-
435261, 435263, 435265-435268, 435270-435273, 435275-
435280, 435283, 435285, 435288, 435290, 435292, 435294,
435296, 435303-435305, 435307-435308, 435316-435319,
435321-435329, 435332-435339, 435342, 435344-435351,
435353-435359, 435361, 435363, 435366-435369, 435372,
435374-435382, 435384-435389, 435391, 435394-435396,
435402-435403, 435405, 435409-435410, 435413-435415,
435417-435420, 435423, 435425-435426, 435428-435429,
435431, 435434-435436, 435438-435440, 435442, 435444-
435445, 435448-435452, 435454-435456, 435459-435461,
435463, 435465-435475, 435478, 435481-435488, 435490-
435497, 435500-435504, 435507-435512, 435514, 435516-
435518, 435520, 435523-435540, 435542-435546, 435548,
435550-435556, 435558-435559, 435561, 435563-435565,
435567-435568, 435570-435573, 435575-435586, 435588,
435590-435591, 435593-435594, 435598-435603, 435605,
435607-435608, 435610-435615, 435618, 435620-435624,
435626-435635, 435637-435638, 435640-435641, 435643,
435645-435647, 435649, 435651, 435653, 435657-435667,
435670-435673, 435676, 435678, 435680-435684, 435686,
435689-435690, 435692-435693, 435695-435698, 435700-
435703, 435705-435706, 435708-435709, 435712, 435718-
435719, 435721-435723, 435726-435728, 435730, 435732-
435734, 435736-435741, 435743-435748, 435751, 435753-
435754, 435756, 435760, 435764-435767, 435770-435779,
435781-435783, 435785, 435787-435788, 435791-435796,
435799-435805, 435807-435809, 435811, 435813-435818,
435820, 435823, 435825, 435827-435836, 435839-435846, 435849, 435851, 435853, 435859-435864, 435867-435869, 435871-435873, 435875-435876, 435880-435881, 435883-435895, 435897-435899, 435904-435908, 435910, 435912, 435918, 435920-435923, 435925-435930, 435933, 435936-435942, 435946, 435948-435949, 435953-435956, 435959-435961, 435963, 435967, 435971-435975, 435978-435980, 435982-435985, 435987-435989, 435992-435996, 435998-436004, 436009, 436012-436018, 436020, 436022-436025, 436027-436028, 436031-436033, 436037, 436039-436040, 436043, 436045, 436048-436050, 436052-436055, 436058-436059, 436061-436063, 436065-436066, 436070-436076, 436078, 436080, 436083-436084, 436087-436090, 436092-436096, 436098-436100, 436102-436106, 436108-436109, 436113-436114, 436116, 436118-436121, 436123, 436125-436142, 436145-436146, 436148-436150, 436153-436154, 436156-436167, 436169-436178, 436183-436186, 436193-436197, 436199-436202, 436204-436208, 436210, 436212-436216, 436218-436219, 436221-436223, 436225-436228, 436230-436231, 436233-436250, 436252-436257, 436259-436260, 436262-436263, 436268-436270, 436276-436277, 436279-436285, 436287, 436289-436295, 436297-436298, 436300-436306, 436308, 436311-436313, 436315-436317, 436319, 436321, 436323-436326, 436328-436331, 436333-436335, 436337-436347, 436349, 436351, 436354-436356, 436358-436364, 436368-436372, 436374-436376, 436384-436386, 436388-436393, 436395-436398, 436401, 436404, 436406-436407, 436410-436417, 436420-436421, 436423-436425, 436427-436428, 436430, 436432-436433, 436436-436437, 436440, 436443-436444, 436446, 436448, 436451-436452, 436455, 436457-436458, 436460-436469, 436471-436479, 436481, 436483-436492, 436494-436501, 436503-436514, 436517, 436521-436522, 436526-436530, 436534-436537, 436540-436541, 436544, 436546, 436548, 436552, 436555-436565, 436569-436572, 436578-436587, 436590, 436593-436594, 436596-436597, 436604, 436606-436607, 436609-436612, 436615, 436617-436619, 436624, 436627-436628, 436630, 436632, 436634-436635, 436638-436647, 436649-436650, 436652-436654, 436656, 436658, 436660-436661, 436663-436668, 436672, 436674, 436676, 436680, 436682, 436684, 436686-436688, 436690-436692, 436694, 436696-436719, 436721, 436723, 436725-436726, 436728-436729, 436732, 436734-436740, 436742, 436745, 436747-436748, 436750-436752, 436754-436759, 436761-436763, 436768, 436770-436772, 436774, 436777-436779, 436781, 436785, 436791-436792, 436794-436801, 436803-436807, 436812-436815, 436817, 436821-436823, 436827, 436829-436835, 436843, 436845, 436848-436855, 436857-436859, 436861, 436864, 436866-436873, 436875, 436878-436879, 436881, 436883, 436888, 436891-436892, 436895-436898, 436900-436904, 436907-436909, 436911-436912, 436915, 436917-436918, 436920-436926, 436928-436930, 436932, 436934, 436936-436944, 436949-436950, 436954, 436956, 436958, 436961, 436967, 436971, 436974-436977, 436979-436981, 436986-436989, 436992-436994, 436997, 437000-437002, 437004, 437007, 437009-437020, 437022, 437028, 437030, 437032-437033, 437035-437036, 437038-437039, 437041, 437043, 437046, 437050-437053, 437055, 437057-437058, 437060, 437062, 437066-437067, 437069-437070, 437074, 437078-437085, 437087-437089, 437094, 437096-437097, 437099, 437103, 437108-437109, 437112-437113, 437115-437116, 437118-437120, 437128-437132, 437134-437137, 437139-437140, 437142, 437144-437146, 437148, 437151-437153, 437155-437159, 437161-437163, 437165, 437167-437177, 437179-437180, 437184, 437187, 437190-437191, 437193-437200, 437202-437208, 437213-437215, 437218, 437220, 437222-437226, 437228, 437230, 437232-437233, 437236-437238, 437240-437241, 437243-437244, 437246, 437248, 437253-437255, 437258, 437260, 437262-437263, 437265-437266, 437271-437275, 437277, 437279-437290, 437292, 437295-437298, 437300-437301, 437303, 437311-437312, 437315-437317, 437319-437330, 437332-437334, 437336-437339, 437342-437347, 437350-437351, 437353-437355, 437358-437365, 437371-437375, 437377-437386, 437389-437394, 437397-437401, 437404, 437407, 437411-437412, 437417-437424, 437426, 437428-437434, 437436, 437439-437442, 437445-437449, 437451-437461, 437463-437464, 437469, 437471-437472, 437475-437476, 437478-437480, 437489-437494, 437497-437503, 437505-437509, 437512-437515, 437517, 437520-437522, 437524-437526, 437528-437529, 437531-437549, 437553-437555, 437559-437561, 437563-437566, 437569, 437571-437575, 437577, 437579-437581, 437583, 437585, 437587-437594, 437599, 437601-437606, 437608, 437611-437612, 437614-437615, 437617-437618, 437621-437625, 437628, 437630-437631, 437633-437634, 437641, 437643, 437647-437648, 437650-437652, 437654-437659, 437661-437662, 437666, 437668, 437671-437672, 437674-437676, 437678, 437680-437682, 437684-437687, 437690-437694, 437698-437701, 437703-437705, 437707, 437710, 437712-437720, 437722-437724, 437727-437734, 437737-437739, 437741-437749, 437752-437753, 437755-437756, 437760-437761, 437763-437769, 437773, 437775-437776, 437779, 437783-437784, 437786-437788, 437790-437799, 437801-437802, 437804-437810, 437812, 437814-437815, 437817-437818, 437820, 437822-437829, 437831-437835, 437838-437852, 437856, 437860-437867, 437870-437872, 437874, 437878-437879, 437881, 437883-437884, 437886-437895, 437897-437899, 437901, 437903-437906, 437908-437909, 437912-437913, 437915-437925, 437927-437929, 437931, 437933-437935, 437937-437940, 437942, 437944-437948, 437950-437954, 437957, 437959, 437963-437965, 437968, 437974, 437977-437978, 437980, 437982-437983, 437985-437986, 437988-437990, 437992-437996, 437998, 438000, 438002-438003, 438005, 438007-438009, 438011-438017, 438020-438026, 438028-438031, 438034-438036, 438039-438052, 438058-438060, 438062-438063, 438065, 438067-438077, 438079-438090, 438092-438095, 438100-438102, 438105, 438107, 438109-438113, 438119-438134, 438136-438141, 438143-438163, 438165-438169, 438171-438174, 438176-438190, 438192-438194, 438198-438200, 438202, 438204-438205, 438207-438211, 438213-438214, 438216-438218, 438222-438223, 438225-438226, 438228-438236, 438238-438239, 438243, 438245-438257, 438259-438260, 438262, 438264, 438266, 438268, 438270, 438273, 438275, 438277-438284, 438286-438291, 438295-438299, 438301-438302, 438306, 438308-438309, 438321-438323, 438327-438328, 438331-438337, 438339-438343, 438345-438347, 438349-438350, 438355-438358, 438361-438365, 438367, 438370, 438372-438375, 438377, 438379, 438385-438390, 438396-438409, 438411-438412, 438414-438421, 438423, 438425-438430, 438435-438443, 438452, 438455-438459, 438461, 438464, 438467-438469, 438472-438473, 438478, 438480-438481, 438483-438484, 438486-438487, 438490-438491, 438494, 438497-438501, 438505, 438507-438509, 438511-438516, 438519-438527, 438529-438534, 438539-438540, 438542, 438544, 438546, 438550-438552, 438555, 438557-438561, 438563, 438566-438569, 438571-438572, 438574-438580, 438582-438583, 438585-438586, 438589-438590, 438593-438596, 438598-438602, 438604-438607, 438609-438611, 438615-438618, 438620, 438622-438635, 438637, 438640-438641, 438643-438647, 438649, 438652, 438654, 438657-438663, 438665-438669, 438672-438676, 438678, 438680-438681, 438683-438685, 438687, 438689-438696, 438699-438702, 438705-438716, 438718-438744, 438746-438747, 438750, 438752, 438754-438756, 438758-438759, 438762-438763, 438765-438773, 438776, 438779, 438781-438785, 438787-438788, 438790, 438792-438793, 438796, 438798, 438800, 438802-438816, 438818, 438822-438824, 438826, 438828, 438832, 438834, 438836, 438838-438840, 438842, 438844, 438846-438849, 438855, 438859-438862, 438865, 438867-438868, 438872-438873, 438875-438876, 438880-438883, 438885-438887, 438894, 438905, 438907, 438909-438912, 438916, 438918, 438921, 438924-438925, 438927, 438931, 438933-438934, 438938-438940, 438942, 438945-438947, 438950-438951, 438953-438954, 438957-438962, 438966, 438971-438972, 438974-438977, 438979-438981, 438984-438985, 438987, 438989-438991, 438993-438995, 438998-438999, 439001, 439003-439007, 439011-439017, 439019-439020, 439026-439028, 439031-439032, 439034, 439036, 439038-439042, 439045-439046, 439048-439051, 439054-439059, 439063, 439065-439069, 439071-439073, 439075-439078, 439080-439087, 439089-439096, 439098, 439100, 439103-439106, 439108-439110, 439112-439113, 439116-439117, 439119-439123, 439125, 439127-439130, 439133-439136, 439138-439141, 439143-439151, 439153, 439155-439156, 439158-439159, 439161-439162, 439164-439168, 439170, 439173, 439175-439179, 439181-439188, 439190-439195, 439198, 439200-439203, 439205-439206, 439208-439210, 439212, 439216-439217, 439219, 439222, 439224, 439226-439228, 439231-439232, 439234-439245, 439248, 439255-439260, 439265, 439268-439279, 439281, 439283-439286, 439289-439291, 439293-439296, 439299, 439302, 439304, 439312-439314, 439317-439320, 439323-439327, 439329-439331, 439334, 439339-439340, 439343, 439346-439348, 439350-439352, 439354-439355, 439357-439362, 439366, 439371, 439374-439375, 439377-439382, 439385-439386, 439388, 439390-439391, 439395-439396, 439399-439404, 439406, 439410-439411, 439414, 439417-439418, 439421, 439423, 439425-439431, 439434-439450, 439452, 439454-439461, 439463-439464, 439471, 439473-439476, 439478-439479, 439481-439488, 439491-439492, 439494-439499, 439502-439506, 439508, 439510-439512, 439515-439516, 439518, 439520-439523, 439525-439527, 439532-439533, 439535-439536, 439539-439540, 439542-439545, 439547, 439550-439552, 439555, 439558-439561, 439563, 439566-439567, 439569, 439571, 439573, 439577-439578, 439582, 439584-439587, 439591, 439593-439594, 439597, 439599, 439601, 439603-439604, 439613, 439615-439616, 439620-439621, 439628-439632, 439635-439637, 439644, 439648-439651, 439653-439654, 439656, 439669, 439671-439672, 439674, 439677, 439680-439682, 439684-439695, 439697-439698, 439702, 439704-439706, 439708-439715, 439719, 439721-439723, 439725-439726, 439729, 439731, 439733, 439735-439736, 439738-439742, 439748-439752, 439755, 439757-439758, 439761-439764, 439766-439768, 439770-439773, 439776-439779, 439782-439783, 439785, 439787, 439789-439793, 439795-439801, 439804-439815, 439817-439819, 439821-439825, 439827, 439829-439834, 439836-439841, 439843-439847, 439850-439851, 439853-439857, 439859, 439862-439864, 439867-439868, 439871, 439874, 439877, 439879-439885, 439887-439888, 439890-439893, 439898, 439900-439908, 439910, 439912, 439915, 439918, 439920-439921, 439923-439928, 439930-439931, 439934-439935, 439937-439938, 439940-439945, 439947-439948, 439952-439955, 439957-439975, 439978-439982, 439988-439993, 439995, 439998-440000, 440002, 440005-440010, 440012-440031, 440033-440034, 440037-440039, 440042-440044, 440046, 440049-440061, 440064-440065, 440067-440074, 440076-440078, 440081, 440083-440084, 440089-440096, 440098-440099, 440101-440106, 440109-440112, 440114, 440120, 440122-440123, 440125, 440128-440129, 440131-440132, 440136-440141, 440144-440148, 440150-440151, 440154-440158, 440161, 440163, 440165-440170, 440172-440175, 440178-440179, 440181-440189, 440198-440200, 440202-440203, 440205-440215, 440217-440221, 440223, 440225-440226, 440228-440231, 440233, 440235, 440238-440241, 440243-440246, 440248-440252, 440254-440256, 440258-440260, 440262, 440265-440266, 440269-440273, 440277-440290, 440292-440293, 440298-440302, 440304-440312, 440315-440318, 440320, 440323-440324, 440326-440327, 440331-440335, 440337-440341, 440344, 440346-440347, 440349-440352, 440354, 440357, 440360, 440362-440365, 440368-440370, 440375-440379, 440385-440390, 440393-440394, 440396-440398, 440400, 440404-440409, 440411-440419, 440421-440425, 440427-440428, 440432-440435, 440437-440439, 440441-440444, 440446, 440448, 440451-440455, 440457, 440459, 440462-440467, 440469, 440471, 440473, 440475, 440477-440480, 440482-440483, 440487, 440489-440492, 440494-440498, 440502, 440504-440507, 440509-440514, 440516-440520, 440528-440532, 440541-440542, 440544-440548, 440550, 440552-440554, 440556, 440558-440565, 440567-440568, 440570, 440572, 440574, 440576-440584, 440586-440590, 440592-440600, 440604-440606, 440609-440610, 440612, 440616, 440621, 440624-440626, 440629, 440632-440633, 440636, 440638, 440642-440643, 440645-440646, 440648, 440650-440651, 440654, 440656-440657, 440661-440663, 440665-440671, 440673, 440675-440676, 440679-440680, 440682, 440684-440692, 440694, 440697-440698, 440704-440707, 440709-440710, 440712-440719, 440722-440729, 440731-440732, 440737-440738, 440740-440744, 440746-440749, 440751-440753, 440755-440758, 440761-440764, 440766, 440769, 440773-440774, 440776-440778, 440782, 440785, 440787, 440789-440790, 440792, 440794-440800, 440802-440813, 440815-440817, 440822-440825, 440827, 440829-440830, 440833, 440835-440836, 440838, 440841, 440844-440845, 440847-440850, 440853-440860, 440863-440870, 440873-440877, 440879-440880, 440882, 440885-440887, 440889-440891, 440893, 440895-440896, 440898, 440900-440902, 440904-440906, 440908-440910, 440913, 440918-440921, 440924-440925, 440927-440936, 440940, 440942-440948, 440951-440956, 440958, 440960, 440962-440966, 440968-440970, 440977, 440982-440984, 440986-440988, 440991, 440996, 441000-441002, 441004-441011, 441013-441014, 441016-441031, 441033-441034, 441043, 441046, 441048, 441050, 441052-441053, 441055, 441057-441065, 441067-441081, 441083, 441085, 441087-441088, 441090, 441092-441096, 441099-441103, 441105-441106, 441108, 441110-441112, 441114-441116, 441120, 441122-441123, 441125-441131, 441135-441136, 441138-441139, 441141-441150, 441152-441153, 441155-441157, 441159, 441161, 441163, 441165, 441167-441170, 441173, 441176-441185, 441187-441189, 441191-441192, 441194, 441196, 441202-441203, 441205-441206, 441209, 441211-441212, 441215-441221, 441224-441225, 441230, 441232-441235, 441238-441239, 441244-441253, 441257, 441259, 441261-441263, 441265, 441267-441271, 441273, 441275, 441281-441284, 441286, 441293-441296, 441300, 441304, 441306, 441309-441311, 441315-441317, 441319-441320, 441322-441328, 441332, 441337, 441339, 441345-441346, 441350, 441353, 441355-441359, 441361, 441363-441367, 441369, 441371-441372, 441374, 441377, 441380-441381, 441383, 441393, 441395-441397, 441400-441404, 441409, 441411-441413, 441415-441422, 441424, 441428, 441430-441433, 441435-441440, 441442-441446, 441449, 441451, 441453-441463, 441465-441467, 441471-441478, 441480-441481, 441483, 441485-441488, 441490, 441492, 441495-441502, 441504-441507, 441509, 441511-441517, 441519, 441525-441527, 441531-441534, 441537-441541, 441544-441546, 441548, 441550, 441553, 441557-441558, 441560, 441562-441566, 441568, 441570-441571, 441573-441575, 441577-441582, 441584-441587, 441590-441591, 441593, 441595, 441598, 441600, 441602-441607, 441613-441617, 441619-441620, 441623-441629, 441631, 441635, 441638-441640, 441642-441644, 441646-441652, 441654-441659, 441663-441664, 441667-441669, 441671, 441675-441683, 441686, 441688, 441690-441692, 441695, 441698, 441702, 441704, 441708, 441711, 441714-441715, 441717-441718, 441720-441721, 441723-441725, 441727-441728, 441730-441731, 441733-441736, 441740-441742, 441744-441745, 441747, 441753-441757, 441759-441761, 441763, 441765-441766, 441771-441772, 441774, 441780, 441782, 441785-441789, 441791, 441795, 441797-441801, 441803, 441805-441811, 441814-441815, 441818-441819, 441822-441829, 441831-441833, 441837, 441839-441842, 441844, 441846, 441849-441850, 441852, 441857-441859, 441861-441864, 441867-441870, 441872, 441874-441884, 441886-441888, 441890-441892, 441894-441895, 441897, 441900-441906, 441909-441911, 441913-441915, 441919-441920, 441922-441923, 441925-441926, 441928, 441931-441933, 441935, 441938-441939, 441941, 441943, 441948-441949, 441951-441960, 441962-441967, 441971, 441973, 441975-441976, 441978-441979, 441982-441984, 441986-441989, 441992, 441994, 441997, 441999, 442002-442004, 442009, 442014, 442016, 442018-442023, 442026-442027, 442029, 442031-442041, 442043, 442045-442047, 442049-442052, 442054-442056, 442061-442063, 442065-442071, 442073-442079, 442081-442083, 442086, 442088-442096, 442098-442112, 442116-442117, 442120-442121, 442125, 442127, 442129-442130, 442134-442142, 442144, 442146-442147, 442150-442153, 442157-442158, 442160-442166, 442170-442171, 442173-442174, 442176, 442178, 442180, 442182-442183, 442185, 442188-442193, 442196-442200, 442202-442204, 442208, 442211-442215, 442217-442218, 442220-442226, 442228-442230, 442232-442233, 442235-442239, 442241-442243, 442245, 442247, 442249-442250, 442253-442254, 442258, 442260, 442263, 442265-442267, 442270-442275, 442277-442278, 442281-442282, 442284, 442287-442296, 442300, 442302-442306, 442308, 442312-442314, 442317-442322, 442328-442332, 442334-442336, 442339-442340, 442342, 442344-442346, 442349, 442351-442352, 442354-442361, 442363-442365, 442368, 442370, 442373-442376, 442378-442380, 442382-442392, 442394-442396, 442398-442399, 442401-442409, 442412-442414, 442416, 442418-442419, 442421-442425, 442427-442428, 442430, 442433-442434, 442436-442437, 442444-442446, 442448, 442453-442454, 442456-442458, 442462, 442464-442471, 442474, 442476-442478, 442480, 442482, 442486-442487, 442492-442496, 442498-442499, 442501-442502, 442505-442506, 442509-442518, 442521-442526, 442529-442533, 442535, 442537-442538, 442540, 442543-442546, 442550, 442552, 442554, 442556-442557, 442559-442563, 442565-442568, 442570-442572, 442575-442588, 442590, 442592-442593, 442599-442605, 442607-442612, 442614, 442616, 442618, 442620, 442624-442628, 442630-442632, 442634-442635, 442637-442639, 442641-442642, 442645, 442647-442648, 442651-442652, 442655, 442657-442664, 442666-442667, 442670-442671, 442673, 442676-442677, 442680, 442683-442684, 442686-442689, 442691-442692, 442694, 442696-442703, 442705, 442708, 442710-442723, 442726-442732, 442734-442737, 442739, 442741-442742, 442746-442751, 442755-442757, 442760-442762, 442764-442765, 442768-442769, 442772-442773, 442776, 442780-442786, 442789-442791, 442793, 442795, 442797-442798, 442800, 442803, 442805-442808, 442811-442813, 442815-442817, 442819, 442823-442828, 442830-442834, 442836-442838, 442840, 442842-442847, 442850-442853, 442855-442856, 442858-442861, 442863-442864, 442867, 442872, 442874-442877, 442879, 442881-442882, 442885-442886, 442888-442891, 442893-442894, 442896-442899, 442902-442904, 442907-442912, 442915, 442917-442925, 442927-442931, 442933, 442936-442941, 442944-442948, 442950, 442952-442957, 442959, 442961-442969, 442971-442972, 442977-442981, 442983-442984, 442988-442992, 442994-442997, 443000, 443002, 443004-443005, 443007, 443012, 443014-443015, 443018, 443021-443023, 443025-443030, 443032-443034, 443036-443040, 443043-443046, 443048-443057, 443060, 443062-443064, 443066, 443069-443070, 443072, 443074, 443076-443078, 443081-443082, 443084, 443086, 443088-443089, 443091, 443093, 443096-443097, 443102-443107, 443111-443117, 443119-443123, 443126-443131, 443137-443138, 443140, 443142-443143, 443146, 443148-443149, 443152-443153, 443155-443158, 443161, 443163, 443165-443169, 443172, 443174, 443176-443178, 443180-443183, 443187, 443191-443195, 443197-443200, 443202, 443204-443205, 443207-443208, 443210-443211, 443213-443214, 443217-443219, 443221-443222, 443224-443231, 443235-443242, 443244, 443246-443247, 443249, 443251-443255, 443257-443261, 443263, 443265-443266, 443268-443270, 443273-443276, 443281-443284, 443287-443291, 443293-443295, 443297, 443300-443303, 443306-443310, 443313, 443318, 443320, 443323-443330, 443332-443338, 443341-443343, 443345-443346, 443348-443351, 443353-443357, 443359, 443361, 443363-443367, 443369-443372, 443374-443378, 443380, 443383, 443386-443387, 443389, 443391-443394, 443396-443398, 443401, 443406-443414, 443416, 443418, 443422-443429, 443431, 443433-443435, 443437-443440, 443442, 443445, 443447, 443450-443452, 443454, 443457-443460, 443462-443467, 443471-443472, 443474-443477, 443480-443483, 443485, 443488-443489, 443491-443497, 443499-443501, 443504-443511, 443518-443520, 443522, 443524-443526, 443532-443534, 443536-443539, 443543, 443545-443547, 443550-443551, 443554, 443559, 443563-443564, 443566-443567, 443569, 443572, 443575-443577, 443579-443581, 443583-443586, 443588-443601, 443603, 443605-443610, 443612, 443614, 443616-443620, 443622-443624, 443626-443629, 443631, 443633-443637, 443639, 443643, 443645-443647, 443650-443653, 443655-443658, 443661-443662, 443664-443665, 443667, 443670-443677, 443679, 443682-443683, 443685, 443687, 443689, 443691, 443695, 443699-443706, 443709, 443711-443712, 443715-443717, 443719-443720, 443724, 443726-443728, 443730, 443732-443734, 443737-443741, 443746-443748, 443750, 443754-443755, 443757-443759, 443762-443763, 443765, 443767, 443769-443770, 443772-443775, 443779-443788, 443790-443792, 443795, 443797-443800, 443802-443803, 443805, 443809-443810, 443819, 443821-443827, 443830, 443832-443834, 443840-443841, 443843-443845, 443847-443850, 443852-443853, 443857, 443860-443861, 443864-443865, 443867-443868, 443870, 443873-443874, 443876-443877, 443879-443881, 443883-443885, 443887-443888, 443890-443892, 443895-443896, 443898-443901, 443903-443910, 443912-443914, 443920-443921, 443923, 443925, 443927, 443929-443932, 443934-443936, 443938-443945, 443948-443950, 443953-443954, 443956-443960, 443963, 443965, 443967-443972, 443976, 443978-443982, 443984-443989, 443991-443998, 444001-444002, 444004-444013, 444015-444016, 444019, 444021-444028, 444030-444032, 444034-444035, 444037, 444039, 444042-444050, 444053, 444056-444060, 444062-444065, 444067, 444071-444074, 444076, 444079-444082, 444084-444086, 444088, 444091-444095, 444098-444105, 444107, 444109-444110, 444114-444120, 444125-444126, 444128, 444130, 444132-444133, 444135-444137, 444139, 444141, 444144-444150, 444153-444156, 444159-444161, 444164-444168, 444170, 444172-444175, 444177-444181, 444183, 444185, 444188-444189, 444198-444205, 444207-444213, 444216-444217, 444220-444226, 444228-444229, 444231, 444233-444234, 444236-444237, 444239-444241, 444243, 444245, 444247-444249, 444251-444255, 444257-444258, 444260-444262, 444265-444270, 444274-444288, 444290-444291, 444293, 444295-444296, 444300-444301, 444303-444312, 444315, 444317, 444319-444323, 444325-444328, 444331-444337, 444339, 444341, 444344, 444346, 444348-444349, 444351-444356, 444358, 444360-444361, 444368, 444372-444373, 444375, 444379-444380, 444385-444386, 444388, 444393, 444395-444396, 444401-444402, 444404, 444406-444408, 444410, 444412-444415, 444418, 444420-444424, 444427-444428, 444430, 444432-444438, 444440, 444443, 444449, 444451, 444454-444456, 444458, 444460-444461, 444463-444465, 444467-444473, 444475-444478, 444481-444489, 444491-444498, 444500-444502, 444504, 444507-444510, 444512-444514, 444516, 444518-444521, 444523-444526, 444528-444538, 444540, 444543, 444545-444553, 444555, 444558-444559, 444561-444565, 444567-444576, 444578, 444584, 444587-444592, 444596-444598, 444601-444604, 444608-444614, 444620-444621, 444623-444624, 444626-444635, 444638-444640, 444643-444647, 444649-444652, 444654-444656, 444659-444660, 444663, 444665-444667, 444670, 444672-444673, 444675, 444677-444679, 444684-444685, 444687-444691, 444693-444694, 444697-444700, 444702, 444705-444720, 444722-444723, 444725-444729, 444731, 444733-444738, 444741-444748, 444750-444751, 444754, 444756, 444758-444759, 444762-444766, 444768, 444772-444775, 444777-444778, 444780, 444782-444784, 444786, 444789-444790, 444792-444796, 444798-444802, 444804-444805, 444807, 444813-444816, 444819-444820, 444822, 444824-444831, 444833-444839, 444842-444843, 444848-444849, 444852-444857, 444859-444867, 444871-444872, 444875-444878, 444880-444882, 444887, 444891-444895, 444897-444904, 444907, 444909, 444911-444920, 444922, 444924, 444926-444928, 444930, 444932-444939, 444942, 444944-444945, 444948-444961, 444963-444966, 444968, 444972, 444974-444979, 444981-444988, 444990, 444992, 444998-445001, 445005, 445007-445009, 445011-445016, 445019, 445021-445023, 445025-445026, 445028, 445032, 445036-445037, 445040-445041, 445043-445044, 445047-445050, 445052-445061, 445063, 445066-445083, 445086, 445088-445089, 445091-445098, 445100-445105, 445107-445109, 445111-445112, 445116-445117, 445119, 445121-445125, 445127-445131, 445133, 445135-445139, 445142-445143, 445145-445146, 445148-445149, 445151-445153, 445155, 445158, 445160-445161, 445164, 445167, 445169-445175, 445177, 445179, 445182-445186, 445188-445189, 445191, 445193, 445195, 445197-445199, 445202-445204, 445207-445209, 445211, 445213-445217, 445219-445225, 445230-445232, 445235-445236, 445238-445243, 445245-445257, 445259-445266, 445271-445272, 445274-445283, 445285-445286, 445291-445292, 445294-445295, 445297-445302, 445304-445305, 445307-445309, 445312-445315, 445319, 445321-445322, 445325, 445330, 445335, 445338, 445341, 445343-445344, 445347, 445349, 445352, 445354-445361, 445364-445367, 445371-445372, 445376, 445378-445384, 445388, 445390-445391, 445393-445396, 445398, 445401-445408, 445410-445416, 445418-445422, 445424, 445426-445427, 445430, 445433-445434, 445436, 445438-445443, 445445-445446, 445448-445452, 445454-445456, 445459-445463, 445467, 445470-445471, 445475-445483, 445485-445486, 445489-445495, 445497-445500, 445502-445504, 445506, 445508, 445510-445518, 445520, 445523-445527, 445530-445532, 445534-445537, 445539-445542, 445544-445555, 445558-445564, 445566, 445568-445570, 445572, 445575, 445578-445580, 445582-445585, 445587-445588, 445590-445592, 445595-445603, 445606, 445608-445609, 445611, 445614, 445616-445622, 445625-445626, 445630-445632, 445635-445636, 445639-445642, 445644, 445647, 445649-445651, 445653-445655, 445658-445669, 445671-445672, 445675, 445677, 445681-445682, 445684-445685, 445688, 445690-445698, 445700-445704, 445706, 445710-445715, 445720-445723, 445725-445726, 445728-445732, 445735-445744, 445746, 445748, 445752-445754, 445757-445758, 445760-445763, 445766, 445771, 445776-445780, 445782-445788, 445790, 445794-445795, 445799-445807, 445811, 445815-445818, 445821-445822, 445824-445830, 445832, 445834, 445836-445842, 445845-445854, 445857, 445859, 445861-445865, 445868, 445870, 445873, 445875-445877, 445879-445883, 445885-445889, 445891, 445896-445898, 445900-445901, 445903-445905, 445907-445908, 445910-445916, 445918-445920, 445922-445924, 445926-445931, 445933-445934, 445937-445939, 445943, 445955-445966, 445968, 445971-445973, 445975-445976, 445978, 445980, 445987, 445989-445993, 445996-445997, 446000-446003, 446008, 446010-446011, 446014-446020, 446025, 446027-446028, 446033-446036, 446038-446039, 446044, 446047-446051, 446054, 446056, 446058-446061, 446064, 446066-446071, 446073, 446075-446076, 446078-446087, 446089, 446092-446097, 446100, 446102, 446104-446105, 446108, 446113-446115, 446117, 446121-446122, 446124-446127, 446129-446131, 446133, 446136, 446138, 446140-446141, 446146, 446150-446154, 446159-446163, 446165, 446168, 446170-446176, 446178-446180, 446183-446185, 446187, 446189, 446191-446195, 446197-446203, 446212-446218, 446220-446222, 446226-446228, 446230, 446232-446233, 446236, 446238-446240, 446242, 446244-446246, 446250-446251, 446257, 446259-446260, 446263, 446265-446270, 446272-446275, 446277-446278, 446280, 446282-446288, 446291-446293, 446296, 446298, 446301-446302, 446304-446315, 446318-446322, 446325, 446329-446330, 446332, 446336, 446339-446340, 446342, 446344, 446349, 446351-446362, 446365-446366, 446368, 446371-446375, 446378, 446380-446392, 446394-446395, 446397-446398, 446400, 446402-446406, 446408-446409, 446411-446417, 446419-446425, 446427, 446430-446433, 446435-446436, 446438-446441, 446443-446444, 446446, 446448-446449, 446451-446459, 446461, 446463, 446465-446469, 446471, 446473, 446475-446476, 446479-446480, 446482-446484, 446487-446490, 446492, 446494, 446496-446498, 446501-446502, 446504-446506, 446508, 446512, 446514, 446516-446521, 446523-446524, 446526-446530, 446537-446538, 446540-446542, 446544, 446547, 446549, 446551-446555, 446561-446563, 446565, 446569-446571, 446573, 446575-446576, 446579, 446582-446583, 446585, 446588, 446591, 446594, 446596-446600, 446602, 446605-446610, 446612, 446615-446618, 446620-446623, 446625, 446627, 446630-446634, 446638-446640, 446642-446646, 446650, 446653-446654, 446656-446657, 446659, 446662-446668, 446670, 446672-446674, 446677, 446679-446682, 446685-446687, 446689, 446692, 446694, 446696-446698, 446700-446701, 446704, 446707, 446710-446711, 446717, 446720, 446722-446726, 446728-446731, 446735-446740, 446742, 446745, 446747, 446752-446757, 446760-446762, 446765-446769, 446771, 446773-446774, 446776-446778, 446780, 446782, 446787-446789, 446792-446794, 446796, 446801-446802, 446805, 446807-446808, 446810, 446812, 446815, 446817, 446819-446820, 446822-446823, 446825-446828, 446830-446831, 446833-446834, 446837, 446843-

446846, 446849, 446854, 446858-446872, 446874, 446879, 446882-446886, 446888-446891, 446893-446894, 446898-446904, 446906-446909, 446914-446919, 446921, 446924-446926, 446930-446935, 446939-446954, 446956-446964, 446967-446972, 446975-446979, 446981, 446983, 446986-446991, 446993, 446996, 446998, 447000-447008, 447011, 447013, 447015-447016, 447021-447029, 447031-447033, 447036-447037, 447039-447044, 447047-447050, 447053-447071, 447073-447075, 447077, 447079, 447082-447091, 447094, 447098-447099, 447103-447104, 447106-447110, 447112-447116, 447119-447122, 447125-447131, 447133-447139, 447143-447144, 447146-447149, 447151-447155, 447157-447159, 447161, 447163, 447165-447166, 447168, 447170, 447172-447175, 447178, 447181-447182, 447184-447188, 447190-447191, 447195-447201, 447204-447205, 447207, 447211, 447214, 447217-447220, 447222, 447225-447228, 447234-447235, 447237, 447239-447242, 447244, 447246, 447248, 447250-447251, 447253-447254, 447259, 447261, 447267, 447270-447271, 447274-447277, 447283-447284, 447286, 447288-447290, 447292-447296, 447298, 447301-447307, 447309-447311, 447315-447316, 447318-447326, 447328-447330, 447333-447337, 447339-447341, 447345-447347, 447352-447353, 447355-447359, 447367-447369, 447371-447373, 447375, 447377-447379, 447381-447386, 447388, 447390-447398, 447403, 447406-447408, 447410, 447412-447417, 447420-447421, 447423, 447428-447431, 447434, 447437-447441, 447445, 447448, 447454, 447456-447458, 447460-447462, 447464-447466, 447470, 447472-447479, 447482, 447487, 447490-447493, 447495-447497, 447499-447501, 447504-447507, 447509, 447511-447512, 447514, 447516-447524, 447529-447530, 447532-447534, 447538-447541, 447548, 447552, 447555-447560, 447562, 447566-447568, 447570, 447573, 447575, 447578-447583, 447585-447590, 447592, 447595-447597, 447600-447601, 447604-447605, 447609-447614, 447619-447630, 447632-447635, 447638, 447643-447646, 447649, 447651-447654, 447656, 447658, 447660-447664, 447666-447667, 447669-447671, 447673, 447675, 447679, 447684, 447686-447687, 447689-447690, 447692, 447694, 447696, 447698-447702, 447705-447707, 447710, 447713, 447716-447719, 447722-447728, 447730-447736, 447738-447745, 447749-447750, 447752, 447754-447755, 447759, 447761, 447763, 447766-447767, 447770-447771, 447773-447788, 447790-447796, 447798, 447800-447801, 447803-447805, 447807-447809, 447811-447812, 447814-447816, 447818-447820, 447822-447823, 447826-447828, 447833-447834, 447837, 447841-447844, 447847-447854, 447856, 447858-447865, 447867-447870, 447872-447873, 447875-447877, 447879, 447881-447883, 447885, 447887-447902, 447904-447905, 447907, 447912-447921, 447923-447926, 447929-447931, 447933, 447939-447940, 447943-447944, 447946-447953, 447955, 447957-447958, 447960-447963, 447965-447967, 447969-447975, 447977-447981, 447984-447985, 447988, 447990-447995, 447998-448006, 448008-448009, 448012-448017, 448019-448020, 448022-448023, 448025, 448027-448031, 448033-448035, 448039, 448041-448050, 448052-448053, 448057-448062, 448065, 448067-448069, 448071, 448073, 448076-448078, 448080-448086, 448088-448092, 448094-448097, 448101-448102, 448104, 448106, 448108-448124, 448126-448127, 448130-448133, 448135, 448137, 448140, 448142, 448145, 448147-448148, 448150-448152, 448156, 448159-448160, 448163-448169, 448171-448175, 448177-448190, 448192-448193, 448196, 448198-448201, 448203-448204, 448207-448212, 448214-448215, 448217-448218, 448220-448224, 448228, 448232-448236, 448238, 448240-448242, 448244, 448246, 448248-448249, 448253, 448257, 448260, 448263-448271, 448273, 448275-448277, 448281-448285, 448287, 448290, 448292-448293, 448295-448303, 448305-448306, 448309-448311, 448315-448320, 448322-448324, 448328, 448330-448333, 448335, 448338, 448343-448346, 448348, 448351-448352, 448354, 448356-448357, 448359-448363, 448368, 448370-448371, 448373-448374, 448379, 448381, 448384-448389, 448393-448395, 448399, 448403-448404, 448407-448408, 448410-448413, 448415-448416, 448418-448420, 448426, 448428, 448431-448439, 448441, 448443-448450, 448452-448454, 448456-448459, 448461-448465, 448470, 448472-448474, 448476-448477, 448479-448483, 448485-448486, 448489, 448491-448492, 448494, 448496, 448498-448500, 448502-448505, 448507, 448511, 448513-448514, 448517, 448521-448522, 448524-448526, 448528-448546, 448548, 448553, 448555, 448557-448558, 448560, 448564-448566, 448569-448572, 448574-448579, 448581-448582, 448584-448588, 448596-448597, 448599-448600, 448602-448608, 448610-448611, 448613-448614, 448617-448624, 448631, 448633-448638, 448641, 448643-448657, 448659, 448661-448678, 448680, 448682, 448684, 448688, 448690-448692, 448694-448701, 448703-448704, 448707, 448714, 448716-448717, 448719, 448721-448725, 448730-448733, 448735-448742, 448744-448745, 448747-448748, 448751, 448753-448754, 448757-448759, 448761, 448765-448768, 448770, 448774, 448776, 448778, 448780-448782, 448784-448786, 448791, 448794, 448797-448805, 448807, 448809, 448813, 448815-448819, 448823, 448825, 448827, 448830, 448836-448837, 448839-448841, 448844-448848, 448852-448855, 448858, 448860-448861, 448863, 448865-448868, 448870-448873, 448876-448878, 448880-448882, 448884-448889, 448893-448896, 448899-448900, 448902-448903, 448905, 448907-448908, 448912-448921, 448923, 448925-448928, 448931, 448934-448938, 448940, 448943-448949, 448952-448953, 448955-448957, 448960, 448962-448963, 448966-448968, 448971-448972, 448974, 448977-448978, 448980-448981, 448986-448988, 448990, 448994-448995, 448997-449000, 449003, 449006-449008, 449010-449012, 449014-449016, 449020-449021, 449023-449030, 449033, 449035-449037, 449041-449042, 449044-449052, 449054, 449056, 449058-449059, 449061-449064, 449066-449069, 449071, 449073, 449076-449077, 449079, 449081-449095, 449097-449100, 449102-449103, 449105, 449109-449116, 449118-449121, 449124, 449126-449127, 449129-449130, 449133-449134, 449136, 449138-449140, 449142, 449145-449149, 449151, 449153-449156, 449158-449160, 449162-449168, 449173-449174, 449177-449179, 449182, 449184-449186, 449188-449190, 449194-449195, 449197-449199, 449202, 449213, 449220, 449222-449224, 449226-449231, 449233-449237, 449240-449242, 449245, 449248-449251, 449253-449258, 449260-449262, 449264-449281, 449283, 449286-449287, 449289-449290, 449292, 449294-449304, 449307-449312, 449314, 449319-449320, 449322, 449325-449329, 449333, 449338-449345, 449347-449349, 449354-449364, 449367, 449369-449371, 449374-449381, 449383-449384, 449387-449388, 449390-449393, 449396, 449398-449400, 449404-449406, 449408-449409, 449414, 449416, 449420, 449422, 449424, 449427-449432, 449434-449441, 449443-449444, 449446-449449, 449451-449452, 449454-449463, 449470, 449472, 449475, 449477, 449479-449483, 449486-449488, 449490-449491, 449493-449494, 449497, 449499-449501, 449507, 449510-449516, 449518, 449520-449524, 449526, 449530, 449536, 449538-449539, 449541-449544, 449546, 449551-449552, 449554-449555, 449558-449559, 449561-449563, 449565, 449567-449568, 449570, 449573-449574, 449577, 449579-449580, 449582-449583, 449586, 449588-449594, 449596-449598, 449600-449601, 449603, 449605-449613, 449615-449620, 449622-449624, 449628, 449630-449634, 449638, 449640, 449644-449657, 449659, 449661-449672,
449677, 449680-449684, 449686-449695, 449697, 449703-
449712, 449714-449719, 449721, 449723, 449726, 449729-
449737, 449739-449742, 449744, 449746, 449748-449751,
449753, 449755-449756, 449759-449761, 449764, 449767-
449774, 449777, 449779, 449781, 449783, 449785-449793,
449796-449797, 449799-449801, 449803, 449805-449806,
449808-449820, 449830-449831, 449833-449840, 449842-
449846, 449848-449849, 449854-449855, 449857, 449860-
449864, 449866, 449868, 449870, 449872-449876, 449878,
449881-449882, 449884, 449886-449887, 449891, 449896,
449898-449899, 449903, 449905-449909, 449911, 449913-
449914, 449917-449919, 449921-449926, 449928, 449930,
449932, 449935-449936, 449938, 449940-449942, 449944,
449946-449950, 449955-449958, 449961, 449965-449966,
449968-449970, 449972-449995, 449997, 450000-450003,
450005-450012, 450014, 450016-450023, 450030-450032,
450037, 450041-450045, 450047-450049, 450052, 450054-
450056, 450063-450064, 450066, 450073, 450076, 450078,
450082-450085, 450088, 450092-450096, 450098, 450100,
450108, 450110, 450114, 450116-450118, 450120-450122,
450124-450131, 450133-450135, 450137-450141, 450145-
450147, 450149, 450152-450153, 450159, 450161-450163,
450165-450166, 450168-450170, 450172-450173, 450177,
450181, 450183-450186, 450188, 450190-450193, 450197,
450202, 450204, 450206-450207, 450209-450219, 450221,
450230, 450233-450236, 450238-450240, 450243, 450246-
450247, 450250-450253, 450257-450258, 450262, 450266-
450267, 450269-450274, 450276-450278, 450280-450285,
450288-450289, 450291-450292, 450294-450297, 450299-
450307, 450309, 450311-450312, 450314-450318, 450321-
450333, 450335-450339, 450341-450346, 450348, 450350-
450352, 450354-450356, 450360-450363, 450365-450367,
450374, 450377, 450379-450385, 450388-450390, 450401-
450404, 450409-450411, 450413-450420, 450423-450424,
450427-450430, 450434-450437, 450439-450441, 450444,
450456-450459, 450461-450464, 450466, 450468-450470,
450474, 450476-450480, 450483, 450485-450487, 450489,
450491, 450493-450494, 450496, 450498, 450500-450504,
450508-450523, 450525, 450527-450531, 450533, 450535-
450543, 450545-450548, 450550-450551, 450553-450554,
450556-450560, 450563-450570, 450572, 450574-450578,
450582-450586, 450589-450592, 450594-450602, 450606-
450607, 450610-450619, 450622-450624, 450626, 450631-
450632, 450634-450641, 450643-450644, 450647-450648,
450650, 450652-450654, 450656, 450658-450659, 450661-
450662, 450665-450670, 450672-450674, 450677, 450680-
450684, 450686-450688, 450690-450691, 450693-450697,
450699, 450703-450704, 450706, 450708-450711, 450713-
450715, 450717, 450719-450720, 450722-450724, 450727,
450730, 450732-450746, 450749, 450751, 450753, 450755,
450757, 450759, 450761-450762, 450764-450766, 450769-
450775, 450777, 450781, 450783, 450786-450797, 450799-
450808, 450811-450812, 450814-450818, 450820, 450824-
450825, 450828-450830, 450832-450834, 450836-450838,
450841-450845, 450847-450850, 450852-450864, 450867,
450870-450874, 450876-450878, 450884, 450886-450888,
450891, 450893-450901, 450903-450905, 450908, 450911,
450914-450916, 450918-450921, 450925-450926, 450928-
450929, 450931-450932, 450934-450942, 450944-450945,
450947-450955, 450957-450958, 450960-450962, 450964-
450965, 450967-450970, 450972-450977, 450979-450983,
450985-450987, 450989-450993, 450995, 450998-451001,
451003-451008, 451012, 451017-451019, 451021-451023,
451025, 451029-451036, 451038, 451041-451042,
451044-451046, 451049, 451051-451056, 451058-451062,
451064-451066, 451071-451075, 451081-451085, 451087-
451089, 451091-451093, 451095-451102, 451104, 451106-
451107, 451111-451113, 451115-451116, 451118-451120,
451122-451123, 451128, 451130, 451136-451137, 451141-
451145, 451150-451155, 451158, 451162-451163, 451165,
451167, 451169-451170, 451173, 451178, 451180, 451183,
451188-451190, 451194-451197, 451201-451203, 451205-
451206, 451211-451212, 451214-451216, 451221-451223,
451225, 451227-451229, 451234-451235, 451238-451241,
451243, 451245, 451251-451252, 451254-451255, 451259,
451265, 451268, 451271, 451274, 451276-451277, 451285-
451291, 451294, 451296, 451298-451309, 451311, 451314-
451318, 451320-451321, 451324-451325, 451327-451328,
451330-451333, 451335-451336, 451338-451340, 451342,
451344-451347, 451350, 451352-451354, 451357-451359,
451362-451363, 451365, 451368, 451373-451374, 451376-
451378, 451384-451389, 451391, 451393-451396, 451398-
451413, 451415-451416, 451418-451419, 451421, 451423,
451427-451430, 451432, 451434-451435, 451440, 451443-
451448, 451450, 451455, 451457, 451462-451469, 451473-
451482, 451484-451486, 451490-451492, 451494-451495,
451497-451499, 451501-451502, 451507-451510, 451512,
451516-451517, 451519-451524, 451526, 451529, 451532-
451533, 451537-451539, 451541, 451543-451546, 451549,
451551, 451553-451556, 451558-451560, 451563-451564,
451566-451569, 451575-451578, 451580-451582, 451584,
451586-451587, 451589-451592, 451594-451596, 451598,
451600-451602, 451604, 451607, 451609, 451611-451618,
451621, 451623-451624, 451626-451627, 451631, 451635-
451637, 451639, 451641-451642, 451645-451651, 451653-
451654, 451656-451657, 451659-451663, 451665-451666,
451668, 451674, 451676-451677, 451680-451683, 451685,
451687-451690, 451692-451693, 451695, 451697-451705,
451707, 451710-451711, 451713, 451715-451720, 451722-
451728, 451730-451735, 451737, 451739-451740, 451744-
451751, 451754-451755, 451757, 451759-451760, 451764-
451765, 451768-451773, 451775-451778, 451782-451787,
451789-451790, 451792-451796, 451798-451802, 451804,
451806-451807, 451809-451823, 451826-451829, 451831-
451838, 451840-451850, 451852-451857, 451859-451864,
451866-451869, 451871-451875, 451879, 451881, 451883,
451887, 451890, 451892-451893, 451895-451897, 451899-
451914, 451916, 451918-451919, 451921-451928, 451930-
451934, 451940-451942, 451945-451946, 451949, 451951-
451957, 451959-451968, 451971-451972, 451974-451975,
451977, 451979, 451981, 451983-451984, 451988-452004,
452008, 452010-452011, 452014-452018, 452020, 452022,
452025-452026, 452028, 452030, 452032, 452037, 452039-
452041, 452045-452048, 452050, 452052-452055, 452057-
452058, 452060, 452063-452066, 452069-452072, 452074-
452077, 452080-452083, 452085, 452087-452095, 452100,
452102-452105, 452108, 452110, 452113, 452117-452118,
452120-452122, 452126-452134, 452136-452139, 452141,
452143-452145, 452150, 452152, 452154, 452158, 452163,
452166-452170, 452172-452174, 452177-452178, 452180-
452181, 452183-452184, 452186, 452190-452204, 452207-
452208, 452214, 452216-452217, 452220-452224, 452226-
452227, 452229-452230, 452234-452245, 452249-452255,
452260-452265, 452267-452268, 452271-452274, 452277,
452279-452283, 452285-452287, 452289, 452291-452293,
452295-452296, 452299-452304, 452306-452314, 452316-
452317, 452319-452322, 452324-452327, 452329, 452334-
452335, 452337-452338, 452341-452348, 452350-452352,
452354, 452358-452361, 452372-452374, 452377-452379,
452382-452384, 452387-452388, 452395-452400, 452402,
452404-452406, 452408-452409, 452411, 452413-452414,
452417-452419, 452421-452423, 452425-452426, 452428,
452433, 452435, 452439, 452441, 452443-452444, 452448-

452450, 452453-452454, 452458, 452461, 452472-452475, 452480, 452486, 452488, 452490, 452492-452499, 452501, 452504-452510, 452514, 452519-452521, 452523-452524, 452526-452527, 452531, 452533, 452537, 452539, 452541-452550, 452554, 452556, 452558, 452560-452561, 452565, 452567-452568, 452572-452580, 452582, 452584, 452587-452591, 452594-452601, 452604-452605, 452609, 452611, 452617-452618, 452620-452625, 452628-452629, 452631-452633, 452635-452639, 452641-452650, 452652, 452655, 452657-452661, 452663-452665, 452669, 452671-452673, 452675-452683, 452685-452687, 452689-452691, 452693, 452697-452706, 452709-452711, 452713-452717, 452720-452722, 452726-452729, 452731, 452733-452734, 452736, 452738-452739, 452742-452743, 452745-452746, 452748-452751, 452756, 452760, 452763-452768, 452770-452774, 452776, 452779-452780, 452782, 452789, 452792, 452796-452797, 452803-452806, 452809-452810, 452812-452814, 452816, 452820-452821, 452824-452826, 452828-452829, 452831, 452834-452839, 452841, 452844-452845, 452849, 452858-452861, 452871-452872, 452874-452877, 452879, 452884-452886, 452888, 452891-452895, 452902-452903, 452908-452909, 452912-452916, 452918, 452920-452921, 452923-452924, 452926-452929, 452931-452934, 452936-452937, 452939-452941, 452943, 452946, 452948-452951, 452953-452956, 452958, 452960, 452967, 452973-452974, 452976, 452978, 452980-452981, 452983-452987, 452989-452990, 452992-452998, 453000-453001, 453003-453006, 453008, 453014-453015, 453018, 453022-453028, 453030-453031, 453033-453037, 453039-453040, 453051, 453054-453055, 453058-453059, 453062-453064, 453066, 453068-453070, 453072, 453074-453076, 453078-453079, 453084, 453087-453088, 453090-453092, 453094-453097, 453099, 453102-453104, 453106-453107, 453109-453110, 453112-453113, 453115-453120, 453122-453124, 453126-453129, 453131-453136, 453138, 453141, 453144, 453147, 453149-453150, 453152-453153, 453155-453156, 453158, 453162, 453165, 453167-453168, 453170-453172, 453174, 453176-453178, 453180-453181, 453183, 453186-453187, 453192, 453194-453196, 453198-453199, 453202-453207, 453209-453220, 453222-453224, 453227, 453230-453231, 453233-453243, 453247-453250, 453253, 453255-453256, 453258-453260, 453262, 453264-453270, 453274-453276, 453278-453284, 453286-453288, 453290-453292, 453294-453295, 453301-453303, 453305, 453308, 453312, 453314-453315, 453317-453322, 453325-453326, 453328, 453330-453332, 453334-453335, 453338-453343, 453345-453348, 453350-453354, 453357, 453359-453368, 453370, 453372, 453375, 453378-453379, 453381-453382, 453386, 453388, 453390, 453392-453395, 453397-453403, 453405-453406, 453408, 453412-453425, 453427, 453429, 453432-453433, 453435-453436, 453440, 453444-453458, 453461-453462, 453464-453467, 453469-453471, 453475, 453477-453479, 453483-453485, 453487-453488, 453490-453492, 453495, 453497-453498, 453500-453506, 453508-453509, 453511-453513, 453516-453525, 453528-453529, 453531-453545, 453547, 453551-453566, 453568, 453576-453578, 453580-453581, 453583-453584, 453595-453598, 453603-453605, 453607-453609, 453611, 453613-453618, 453623-453624, 453626-453627, 453629-453630, 453632, 453634, 453636, 453640, 453643, 453645-453650, 453652-453653, 453655-453657, 453660-453664, 453666-453672, 453674-453677, 453682-453683, 453685-453687, 453689-453690, 453693-453695, 453698-453700, 453702-453707, 453709-453710, 453713, 453718, 453720, 453723-453730, 453732-453736, 453739-453745, 453747-453751, 453754, 453756-453757, 453761, 453765-453768, 453770-453772, 453775-453781, 453783-453788, 453791-453795, 453797-453800, 453802-453804, 453806-453808, 453810-453812, 453814-453819, 453822, 453824, 453826, 453828-453834, 453836-453838, 453840, 453842-453846, 453848, 453850-453854, 453857, 453859-453864, 453866-453871, 453873-453874, 453876-453877, 453879, 453883, 453885-453886, 453888, 453891-453895, 453900, 453902, 453904-453905, 453908-453912, 453914-453915, 453917-453920, 453922, 453926, 453928-453932, 453934-453936, 453938, 453940-453942, 453944, 453946-453947, 453949-453950, 453953-453954, 453956-453967, 453970-453973, 453975-453976, 453979-453981, 453983-453988, 453990, 453992-453995, 453999-454004, 454006, 454008, 454010, 454016-454018, 454020-454021, 454023, 454030-454031, 454035-454036, 454039, 454041, 454043-454056, 454058, 454061-454064, 454067-454072, 454075, 454077-454081, 454083-454084, 454086-454090, 454092-454093, 454099, 454103, 454105-454106, 454108, 454110-454116, 454118-454121, 454123, 454125-454128, 454132, 454134-454135, 454137, 454139-454140, 454142-454143, 454145, 454149, 454151, 454153, 454155-454161, 454163, 454166, 454168-454173, 454177, 454179, 454181-454183, 454185-454194, 454199-454200, 454202, 454205, 454207-454208, 454210-454214, 454218-454222, 454224, 454226-454227, 454229-454230, 454232-454240, 454243-454245, 454250-454251, 454253-454254, 454256, 454258-454262, 454264-454265, 454267-454272, 454274-454277, 454279, 454282, 454285, 454287-454292, 454297, 454300-454301, 454305-454315, 454317, 454319, 454321-454329, 454332-454334, 454336-454338, 454340, 454342-454344, 454346-454349, 454352-454353, 454357, 454359, 454361, 454363, 454365, 454368-454375, 454377-454379, 454383-454387, 454390-454392, 454394, 454396, 454401, 454403-454407, 454410, 454412, 454418-454419, 454421-454424, 454427-454428, 454430-454434, 454436-454437, 454439, 454442-454444, 454446, 454448-454449, 454452-454453, 454455, 454457, 454462, 454464-454467, 454469-454471, 454474-454475, 454480, 454482-454484, 454486, 454488, 454490-454491, 454495-454496, 454499-454500, 454502, 454504, 454507, 454511-454512, 454515, 454518-454520, 454522-454523, 454528-454531, 454533-454536, 454538-454539, 454541-454542, 454547-454549, 454551, 454553-454555, 454557, 454559-454563, 454565-454566, 454568, 454570-454574, 454576-454578, 454581, 454583-454585, 454587-454589, 454592-454596, 454602, 454605-454608, 454611-454612, 454614, 454619, 454623, 454626, 454629-454635, 454637, 454639-454643, 454645-454648, 454650-454654, 454656-454661, 454663, 454666, 454668-454675, 454680, 454682, 454685-454686, 454688-454693, 454695, 454697-454702, 454704, 454706-454718, 454720, 454723-454726, 454728, 454731, 454733-454735, 454737, 454740, 454743-454744, 454747, 454749-454751, 454753-454757, 454759, 454764, 454766, 454768-454770, 454772, 454774-454775, 454777, 454780-454781, 454784, 454786, 454788-454790, 454792, 454794, 454796-454797, 454800-454808, 454811, 454815, 454821, 454823-454824, 454826, 454829-454831, 454833-454834, 454836, 454838-454840, 454843-454844, 454848-454850, 454853-454856, 454858, 454862-454863, 454865, 454869-454871, 454873-454876, 454878-454881, 454883, 454887-454888, 454890, 454892-454895, 454897, 454899-454905, 454907-454909, 454912-454914, 454916-454922, 454925, 454927-454931, 454933, 454939-454945, 454949, 454951-454952, 454954-454956, 454958-454960, 454962-454966, 454968, 454972-454974, 454979-454980, 454982, 454984, 454987, 454991, 454994-454998, 455001-455002, 455004-455005, 455008-455015, 455017-455018, 455020-455023, 455027, 455029, 455032-455033, 455037-455041, 455045, 455047-455050, 455056-455061, 455064-455066, 455068-455074, 455076, 455078-455084, 455086-

455088, 455090-455097, 455099-455101, 455103, 455105, 455107, 455109-455117, 455121-455122, 455124, 455126, 455128-455131, 455133, 455135, 455141-455148, 455150, 455153, 455155-455157, 455161, 455163-455169, 455173-455174, 455177-455179, 455181-455183, 455186, 455188-455190, 455205, 455208, 455210, 455212, 455218, 455224, 455226, 455228, 455232-455233, 455236-455240, 455242, 455244-455247, 455250, 455252-455255, 455258, 455263-455264, 455266, 455268, 455272, 455274-455278, 455280-455281, 455283-455287, 455290, 455292-455296, 455299-455301, 455303-455307, 455310-455311, 455314-455315, 455318-455320, 455322-455325, 455327-455334, 455337, 455339, 455341-455343, 455345, 455348, 455350-455356, 455358-455359, 455361, 455364-455368, 455372, 455374, 455377-455386, 455388, 455390-455392, 455396-455397, 455399-455408, 455410-455412, 455417-455426, 455433, 455435-455436, 455440-455441, 455445-455446, 455449-455453, 455456, 455458-455460, 455467, 455469-455470, 455472, 455476, 455478-455487, 455490-455494, 455497-455502, 455504-455508, 455510, 455517, 455519, 455521, 455523-455526, 455528-455533, 455539, 455541-455545, 455547-455549, 455551, 455554, 455556, 455558, 455560-455563, 455565, 455568-455572, 455575, 455578, 455585, 455587, 455589, 455591, 455593, 455595, 455597, 455599, 455601-455605, 455607, 455610-455611, 455613-455617, 455619-455621, 455626, 455628, 455630, 455632-455634, 455637, 455639, 455642, 455644-455645, 455647-455655, 455659-455661, 455663, 455666, 455668, 455670-455672, 455675-455681, 455683-455687, 455689-455690, 455695, 455698-455702, 455704, 455707, 455709-455711, 455713, 455715-455720, 455722, 455724, 455727-455728, 455732-455733, 455735-455737, 455739, 455744-455751, 455757, 455759, 455761, 455763, 455765, 455767-455773, 455775, 455777-455778, 455780, 455782-455785, 455788-455793, 455795, 455799, 455801-455802, 455804, 455806-455807, 455809-455812, 455814-455815, 455818-455819, 455821, 455826-455829, 455831, 455835, 455837-455839, 455842, 455845, 455847-455848, 455850-455853, 455858, 455860-455862, 455864-455867, 455869-455871, 455873, 455875, 455878-455883, 455885-455887, 455890-455894, 455896-455900, 455905, 455907-455909, 455912-455914, 455916-455917, 455919-455928, 455931-455936, 455939-455940, 455943-455944, 455946-455949, 455952-455955, 455958, 455964, 455966-455969, 455971-455972, 455974, 455977-455985, 455988, 455992, 455997-455998, 456003-456004, 456010-456011, 456013-456016, 456018-456019, 456021, 456025-456029, 456031-456033, 456036-456045, 456047, 456049, 456052-456060, 456063-456066, 456068-456070, 456072-456073, 456075-456076, 456078, 456080-456081, 456083-456085, 456090-456097, 456099, 456101-456102, 456104, 456106-456108, 456110-456111, 456113, 456117-456118, 456122-456124, 456127-456130, 456132, 456135, 456140, 456142-456146, 456148-456150, 456153-456157, 456159-456160, 456163-456172, 456174-456175, 456177-456182, 456189-456191, 456193-456195, 456203-456204, 456207-456211, 456213-456217, 456220-456221, 456223, 456225, 456228, 456230-456231, 456233, 456235, 456237-456244, 456246-456249, 456256-456257, 456259-456265, 456269, 456272-456275, 456279, 456281-456295, 456298, 456300-456301, 456303-456306, 456309-456310, 456312-456313, 456317-456318, 456323-456324, 456327-456331, 456333, 456336-456342, 456345-456346, 456348-456349, 456351, 456353-456354, 456356-456361, 456363-456366, 456368, 456370-456371, 456373, 456375-456376, 456379-456380, 456382-456386, 456388-456390, 456396-456398, 456401-456402, 456405, 456410-456414, 456416, 456418-456419, 456421-456424, 456429, 456431-456432, 456434-456445, 456447-456449, 456451-456453, 456455, 456458, 456460-456464, 456466-456470, 456473-456477, 456481-456482, 456484-456489, 456492-456495, 456497-456499, 456501, 456504-456505, 456507-456508, 456510-456511, 456513-456514, 456516-456517, 456520, 456522, 456524, 456528, 456531-456534, 456539, 456541-456542, 456544, 456546-456550, 456552-456555, 456557-456561, 456565, 456569, 456571-456573, 456575-456577, 456580-456581, 456583, 456585, 456587-456589, 456591, 456593-456609, 456617-456621, 456626, 456629, 456633, 456638, 456640-456644, 456646-456648, 456652-456653, 456658, 456661-456667, 456670-456671, 456673-456675, 456677-456680, 456682, 456685-456688, 456690, 456694-456697, 456700, 456702-456703, 456706-456716, 456719, 456721-456722, 456724, 456726-456727, 456729-456735, 456737-456742, 456744-456745, 456747-456760, 456762-456768, 456770, 456772-456774, 456776-456778, 456780-456781, 456783, 456785-456788, 456790, 456793-456795, 456799, 456801-456802, 456804-456810, 456814, 456819, 456823-456824, 456826, 456828-456831, 456833-456836, 456839, 456842, 456848, 456850-456851, 456853-456854, 456856-456861, 456864, 456866, 456868-456872, 456874-456875, 456880-456883, 456886-456887, 456892, 456898, 456900-456903, 456905, 456907-456908, 456914, 456916, 456918-456921, 456925-456928, 456930, 456939, 456943-456948, 456950-456952, 456954-456958, 456960, 456962-456965, 456967-456971, 456974-456975, 456978-456979, 456981-456982, 456985-456989, 456991-456993, 456995, 456998-457000, 457002, 457004, 457007-457010, 457013-457018, 457020-457023, 457025-457027, 457030-457032, 457035-457036, 457038, 457040-457044, 457046-457047, 457049-457050, 457052, 457055-457056, 457058-457067, 457069-457070, 457072-457073, 457076-457081, 457087, 457089-457105, 457107-457109, 457111, 457115-457118, 457120, 457122-457124, 457127-457129, 457131-457134, 457136-457138, 457143-457157, 457165-457171, 457173, 457175-457179, 457183-457184, 457186-457187, 457191, 457193-457196, 457198-457202, 457207-457211, 457213, 457217, 457219-457227, 457232-457239, 457241-457243, 457247-457252, 457255, 457261-457262, 457266-457267, 457270, 457273-457275, 457277-457279, 457281-457283, 457285-457287, 457294-457298, 457302, 457304-457305, 457307, 457315, 457318, 457322, 457325, 457327, 457329, 457331, 457334, 457336, 457340, 457343, 457345-457349, 457351-457352, 457355-457356, 457358, 457366-457369, 457371-457380, 457383-457386, 457389, 457391, 457393-457402, 457405, 457408, 457411-457412, 457415, 457418, 457425-457427, 457430-457431, 457434-457435, 457438-457442, 457444, 457446, 457451, 457454, 457456, 457458-457461, 457464, 457466-457470, 457475, 457480-457485, 457490, 457492-457493, 457495-457496, 457503, 457505, 457507-457509, 457511, 457513-457521, 457525, 457527, 457529, 457532, 457535, 457537-457538, 457540, 457542-457544, 457546-457551, 457556, 457558, 457560, 457566, 457568, 457577, 457580-457582, 457584, 457586-457589, 457592-457593, 457595-457603, 457605, 457608-457610, 457612-457614, 457617-457620, 457622-457626, 457629, 457633, 457643-457644, 457646, 457648, 457650, 457653-457659, 457661-457662, 457664, 457666, 457670, 457673-457677, 457679-457682, 457684, 457686, 457688-457698, 457705-457706, 457712-457713, 457716, 457720-457722, 457725-457728, 457730-457733, 457735-457736, 457738-457740, 457742, 457744, 457746, 457749, 457752, 457754-457757, 457760, 457763-457764, 457766-457768, 457772, 457776, 457779, 457781, 457784, 457786, 457789-457796, 457798, 457801-457804, 457806, 457808, 457810, 457814, 457816-457819, 457821, 457823, 457828-457829, 457832, 457834-457837, 457839, 457842-457843, 457846-457849, 457851, 457853-457854, 457856-457860, 457867, 457869, 457874, 457879-457882, 457884-457887, 457891-457896, 457900, 457904-457908, 457911-457915, 457917, 457919-457929, 457933-457935, 457937, 457939-457941, 457944-457946, 457948, 457950-457951, 457954-457959, 457963, 457965-457967, 457969, 457971, 457975-457976, 457978-457979, 457981-457985, 457987-457989, 457992-457994, 457997-458006, 458008-458011, 458013, 458017-458018, 458020-458022, 458025-458029, 458031-458034, 458036, 458038, 458041-458047, 458052-458054, 458056-458065, 458067-458068, 458071-458075, 458078-458080, 458084, 458086-458088, 458090-458094, 458098-458102, 458105-458108, 458110, 458112-458119, 458121-458124, 458130, 458134, 458136-458140, 458142-458143, 458145-458146, 458148-458149, 458151, 458154, 458162-458166, 458171, 458174, 458176-458177, 458179-458182, 458184, 458186-458187, 458189-458190, 458192-458193, 458195, 458197-458198, 458200-458201, 458203-458205, 458211, 458214, 458219, 458221-458223, 458225-458227, 458229, 458231, 458233-458234, 458236-458241, 458243-458244, 458246-458248, 458250, 458259-458262, 458264-458266, 458272-458276, 458278-458281, 458285-458293, 458296-458298, 458300-458301, 458305-458307, 458310-458312, 458314-458317, 458319-458324, 458327-458328, 458330-458334, 458336, 458338-458341, 458343, 458346-458349, 458352-458354, 458362, 458365, 458367-458368, 458371-458380, 458384-458391, 458393-458395, 458397-458399, 458401-458406, 458409-458415, 458424-458425, 458428, 458430, 458434-458443, 458447, 458449-458450, 458453, 458455-458460, 458462, 458464-458465, 458467-458471, 458473, 458476-458479, 458482-458485, 458487, 458489, 458491, 458493-458495, 458497-458498, 458500-458501, 458503, 458506-458511, 458513-458514, 458516, 458518, 458522, 458526-458539, 458541, 458545, 458548-458556, 458559-458561, 458563-458564, 458566-458568, 458571-458574, 458576-458582, 458585-458587, 458589-458590, 458593-458598, 458600, 458602-458607, 458609-458612, 458614, 458616, 458618-458620, 458622-458623, 458625-458626, 458628-458630, 458633-458638, 458642-458644, 458646-458648, 458650-458654, 458657-458664, 458679, 458681-458682, 458689-458690, 458692-458694, 458696, 458698-458700, 458703-458705, 458708-458710, 458712, 458714-458715, 458718, 458721, 458723-458724, 458726-458728, 458735, 458738-458740, 458742-458745, 458749, 458753-458758, 458763, 458765-458769, 458771-458779, 458782-458783, 458785-458791, 458793-458795, 458801-458803, 458807, 458810, 458813, 458817-458822, 458824-458825, 458827-458832, 458834-458836, 458838, 458840, 458842, 458845-458847, 458849, 458851, 458853-458855, 458857-458859, 458861-458862, 458864, 458866, 458868-458871, 458874-458875, 458880-458881, 458886-458897, 458901-458905, 458910-458912, 458914-458916, 458918-458921, 458923, 458926-458938, 458940-458948, 458952-458963, 458965, 458969-458970, 458972-458974, 458976-458977, 458980-458982, 458984, 458986-458996, 458998, 459000-459001, 459003-459004, 459006-459007, 459009-459012, 459014-459015, 459018-459019, 459022-459025, 459027-459034, 459036-459040, 459042-459043, 459045-459049, 459053, 459055-459062, 459068, 459070-459073, 459075-459080, 459083-459085, 459088-459091, 459093-459098, 459100-459102, 459105-459108, 459110-459112, 459114, 459116, 459118-459122, 459124-459129, 459131-459133, 459135-459136, 459140-459143, 459145-459146, 459148-459149, 459151-459156, 459159-459160, 459162-459164, 459166, 459168-459170, 459172, 459175-459178, 459181, 459183-459189, 459191, 459194, 459197, 459199, 459202-459210, 459212, 459214-459218, 459220, 459226, 459228, 459230-459231, 459233-459235, 459239, 459241-459245, 459247-459248, 459250, 459252, 459254, 459256, 459259-459261, 459263-459264, 459266-459267, 459269-459275, 459277, 459280, 459284, 459287-459288, 459290-459294, 459297, 459299, 459301-459308, 459310-459311, 459316-459317, 459320, 459325-459327, 459329-459335, 459338-459341, 459343-459344, 459346, 459348-459349, 459351-459352, 459354, 459360, 459363-459364, 459367-459368, 459370-459371, 459374-459378, 459385, 459388-459392, 459394-459395, 459398-459404, 459410, 459414-459416, 459418, 459421-459422, 459424, 459428, 459431-459436, 459438-459441, 459443, 459446-459447, 459450-459451, 459453-459455, 459457, 459462-459465, 459467-459469, 459473-459479, 459482, 459484, 459486-459487, 459490-459496, 459501, 459504, 459506, 459508-459512, 459514, 459517, 459520, 459522, 459524-459531, 459539, 459543-459544, 459546, 459550, 459553-459558, 459560, 459562, 459564-459565, 459567-459569, 459571, 459573, 459575-459576, 459578-459579, 459581-459582, 459585-459586, 459588-459591, 459593-459594, 459596-459598, 459600-459601, 459603-459604, 459606, 459612-459620, 459622, 459625-459630, 459632-459633, 459635, 459637-459648, 459650-459655, 459657-459659, 459662, 459664, 459667-459669, 459672-459677, 459679, 459683-459686, 459691, 459693-459698, 459700, 459703, 459707, 459709-459714, 459716, 459719-459721, 459724-459726, 459729, 459731-459732, 459734, 459736, 459739-459740, 459744, 459746-459748, 459752-459754, 459756, 459758-459761, 459763, 459765-459766, 459769, 459771, 459775, 459777, 459779-459780, 459782-459784, 459788-459791, 459797, 459800, 459802, 459812-459813, 459818, 459820, 459822, 459824-459825, 459827-459834, 459836, 459840-459844, 459847, 459850-459854, 459857-459858, 459860-459862, 459864, 459866-459867, 459870, 459872-459873, 459875-459877, 459879-459882, 459887-459888, 459890-459891, 459893-459894, 459898, 459901-459903, 459908-459913, 459920-459926, 459929-459934, 459941-459944, 459947, 459949, 459951-459956, 459958-459960, 459962-459963, 459965-459974, 459977-459981, 459983-459984, 459988, 459990-459991, 459993-459994, 459997, 459999, 460001-460008, 460010-460013, 460015-460016, 460018, 460020-460021, 460026-460028, 460030, 460033-460034, 460037-460039, 460041-460046, 460048-460052, 460056-460058, 460060, 460062-460063, 460065-460069, 460071, 460074-460075, 460077, 460079-460082, 460086-460096, 460100-460101, 460103-460104, 460106, 460109-460117, 460119, 460123-460131, 460133-460138, 460140, 460142, 460145-460146, 460148-460150, 460152-460153, 460155-460157, 460160-460180, 460182-460186, 460188-460189, 460191, 460194-460196, 460198-460199, 460201-460202, 460205, 460207-460208, 460211-460215, 460217-460219, 460222-460229, 460231-460232, 460237-460241, 460243-460256, 460258, 460260-460261, 460263-460264, 460268-460269, 460271, 460273-460275, 460277-460280, 460282-460288, 460292-460294, 460300, 460303, 460306-460307, 460310-460311, 460314, 460316-460318, 460320-460323, 460325, 460327, 460329, 460331, 460333, 460335-460340, 460342, 460345, 460347-460351, 460354-460359, 460362-460363, 460365-460366, 460368-460370, 460374-460376, 460380-460381, 460383, 460390, 460393, 460395-460399, 460402-460403, 460405-460406, 460408, 460410, 460412-460413, 460416-460422, 460428-460431, 460433-460434, 460436-460440, 460444-460446, 460448-460450, 460452-460454, 460456, 460458-460459, 460461-460465, 460467-460468, 460471, 460476-460477, 460483, 460485, 460490-460493, 460495-460497, 460505-460509, 460513-460518, 460520-460524, 460527-460528, 460531-460539, 460543, 460546, 460548-460550, 460552-460562, 460565, 460567, 460570-460583, 460586-460587, 460591, 460594-460597, 460599-460605, 460607-460610, 460613-460618, 460620-460624, 460626-460627, 460629-460634, 460636-460644, 460648, 460651-460653, 460655-460671, 460673, 460675-460685, 460687-460689, 460692-460697, 460699, 460701, 460703, 460707-460709, 460712, 460715, 460718-460726, 460731-460735, 460737-460738, 460740-460746, 460751, 460753-460756, 460758-460759, 460764, 460767, 460769-460770, 460774-460776, 460778-460784, 460786-460789, 460792, 460794, 460798-460799, 460801-460803, 460807-460809, 460812-460814, 460816-460818, 460821-460823, 460825, 460827-460828, 460831-460834, 460836, 460838, 460840, 460842-460846, 460849, 460852, 460854-460859, 460861-460862, 460865-460867, 460870-460878, 460881, 460883, 460885, 460888-460889, 460891, 460893-460894, 460898-460899, 460902-460905, 460908, 460910-460915, 460918-460919, 460922, 460924, 460926-460931, 460933-460934, 460937-460941, 460943-460945, 460947, 460949-460953, 460955, 460957-460958, 460960, 460962-460966, 460969-460974, 460977-460978, 460980-460982, 460984, 460987, 460989-460992, 460994-460997, 461000, 461003, 461005-461010, 461014, 461016-461019, 461024-461029, 461031, 461034-461037, 461043, 461045-461048, 461050-461051, 461054-461056, 461058-461059, 461061, 461065-461086, 461089-461091, 461094-461096, 461098, 461100, 461102-461103, 461105-461107, 461111-461112, 461114, 461117-461119, 461121-461122, 461125-461127, 461129-461135, 461137-461138, 461140-461142, 461144, 461147-461150, 461153, 461155-461160, 461163-461174, 461176-461178, 461180-461184, 461186-461187, 461189, 461192-461198, 461201-461204, 461206-461207, 461209, 461212-461217, 461219-461222, 461225, 461227-461229, 461233, 461235-461238, 461240-461241, 461244-461247, 461251-461254, 461256-461257, 461259, 461261-461262, 461265-461266, 461268-461269, 461271-461272, 461274-461275, 461279-461282, 461285, 461287-461288, 461291-461294, 461296-461298, 461300, 461304, 461307-461312, 461314-461315, 461317-461318, 461320, 461325-461330, 461332, 461334, 461336, 461338, 461341-461343, 461345, 461347-461351, 461353-461357, 461359-461367, 461369, 461375-461377, 461379, 461381, 461384-461385, 461388-461390, 461392-461407, 461409-461410, 461413, 461416, 461425, 461427, 461429-461432, 461435-461436, 461439-461440, 461444-461446, 461450, 461453, 461455, 461461-461462, 461466, 461468-461469, 461473, 461475-461477, 461479-461483, 461485-461490, 461493, 461495-461497, 461499-461503, 461506-461509, 461511-461512, 461515-461518, 461523-461534, 461536, 461540-461541, 461544, 461546-461547, 461549-461551, 461555-461556, 461558-461560, 461564, 461566, 461569-461570, 461573-461574, 461576, 461578-461581, 461583-461587, 461592, 461594, 461596, 461603-461609, 461614, 461617-461619, 461622, 461624, 461626-461628, 461631-461632, 461634-461639, 461643-461646, 461648, 461652-461656, 461659-461660, 461662-461663, 461666-461667, 461669, 461671-461682, 461685-461689, 461693-461701, 461706, 461709-461719, 461721-461729, 461731-461738, 461740-461746, 461748-461749, 461752, 461754-461759, 461761-461763, 461765-461773, 461776, 461778-461779, 461783-461784, 461786-461788, 461790, 461792, 461794-461797, 461799-461800, 461802, 461804, 461806-461810, 461813-461819, 461821-461825, 461827, 461829-461830, 461833-461834, 461838-461839, 461841-461843, 461846-461848, 461850, 461853-461855, 461859-461861, 461863-461864, 461868, 461870-461877, 461879-461881, 461886-461889, 461891, 461893-461898, 461900, 461902-461908, 461910-461916, 461919, 461921-461926, 461928, 461932, 461934, 461936-461940, 461942-461944, 461947, 461949, 461951-461952, 461955-461961, 461963, 461966-461969, 461971, 461973, 461977-461979, 461981-461982, 461985, 461988-461994, 461996-461997, 462001, 462006-462008, 462011-462015, 462023, 462025, 462027-462028, 462030-462036, 462038-462041, 462044-462046, 462048, 462050-462057, 462059-462063, 462067-462072, 462075, 462077-462078, 462084-462094, 462096-462098, 462100, 462102-462103, 462105-462106, 462108, 462112-462117, 462120, 462122, 462124-462128, 462132-462134, 462136, 462138-462139, 462141-462144, 462147-462148, 462151-462152, 462154-462156, 462158, 462160-462161, 462163-462170, 462173, 462176-462180, 462182, 462186-462189, 462192-462194, 462196-462197, 462202, 462206-462208, 462210-462212, 462214, 462216-462218, 462220-462225, 462232, 462236-462237, 462239-462240, 462242-462244, 462247-462248, 462252, 462254, 462256-462259, 462264-462267, 462269-462270, 462274, 462276-462280, 462282, 462285-462286, 462289-462292, 462294, 462300-462305, 462308, 462311, 462313-462314, 462316-462324, 462326, 462329-462339, 462341-462345, 462347-462349, 462351, 462353-462354, 462358, 462360-462365, 462367-462368, 462371-462380, 462382-462383, 462386-462388, 462391-462400, 462402-462403, 462405-462412, 462417-462419, 462421-462422, 462424-462426, 462429-462433, 462435-462437, 462443-462444, 462447-462460, 462463, 462466-462470, 462472-462498, 462501, 462504-462509, 462511-462518, 462522-462532, 462534-462539, 462541-462542, 462544-462547, 462549-462556, 462558-462559, 462561, 462567-462569, 462571-462575, 462577, 462579-462582, 462585-462589, 462591-462593, 462595-462599, 462601, 462604-462615, 462617-462623, 462625, 462628-462629, 462631, 462635-462637, 462640-462641, 462643-462647, 462649-462655, 462657-462658, 462661-462669, 462671-462678, 462680-462681, 462683-462684, 462686-462691, 462693-462696, 462698-462701, 462703-462704, 462706, 462708, 462710, 462712-462717, 462720, 462722-462724, 462726-462730, 462732-462736, 462738-462742, 462745, 462747-462748, 462750-462754, 462757, 462759-462760, 462762-462764, 462766-462767, 462770, 462772-462773, 462775-462777, 462779-462780, 462782-462783, 462785-462786, 462788, 462791-462793, 462795-462796, 462799-462801, 462804, 462806-462810, 462813-462818, 462820, 462822-462827, 462829-462830, 462832, 462835-462847, 462850, 462852-462866, 462868-462871, 462873-462880, 462883-462888, 462890-462893, 462898-462899, 462901-462905, 462908-462909, 462911-462912, 462914-462915, 462918, 462920-462921, 462923, 462925-462927, 462929, 462932-462933, 462936-462938, 462940-462945, 462947, 462949, 462951-462952, 462954-462955, 462960-462962, 462964-462965, 462967, 462969-462970, 462972-462982, 462984-462991, 462993, 462996, 462999-463000, 463003-463006, 463008-463013, 463015, 463017-463020, 463022-463025, 463027-463028, 463030, 463032, 463034-463036, 463038-463039, 463041-463043, 463046-463048, 463050-463052, 463054-463057, 463059-463061, 463063-463066, 463068-463075, 463078-463081, 463083-463086, 463088-463093, 463095, 463097, 463100, 463103-463106, 463108-463110, 463112-463113, 463116-463117, 463119-463125, 463128, 463130-463135, 463137, 463140, 463142, 463144-463148, 463150-463151, 463153-463157, 463159, 463162-463163, 463166-463175, 463177-463179, 463182-463183, 463185, 463187-463190, 463192-463198, 463200-463215, 463217, 463219-463220, 463222-463224, 463229-463230, 463235-463236, 463238-463246, 463249, 463256-463257, 463259-463264, 463273-463278, 463280-463284, 463286-463289, 463292, 463294-463299, 463301-463304, 463306-463307, 463311-463313, 463315, 463317-463319, 463321, 463324, 463328, 463330-463336, 463339-463341, 463343, 463346-463347, 463349, 463351, 463353, 463355, 463361-463363, 463365-463374, 463379, 463388-463390, 463396-463398, 463400, 463404-463408, 463411-463413, 463415, 463418, 463421, 463424, 463426, 463428, 463430-463434, 463436-463438, 463440-463442, 463447-463450, 463452-463457, 463459, 463462-463467, 463470, 463472-463474, 463477-463478, 463480-463484, 463486, 463493-463496, 463498-463501, 463503-463504, 463506, 463510-463511, 463514-463517, 463519, 463522-463523, 463525-463527, 463529-463530, 463532-463534, 463536-463537, 463540, 463542-463544, 463547-463550, 463552-463554, 463556, 463558-463571, 463573-463575, 463577-463578, 463582-463586, 463592-463593, 463596-463597, 463599, 463601, 463603, 463607-463608, 463610-463611, 463613, 463617, 463619-463620, 463623-463628, 463630, 463636-463637, 463639, 463641-463642, 463644, 463646-463647, 463649-463658, 463661-463662, 463664-463668, 463670, 463672-463673, 463677-463682, 463684, 463689, 463691-463692, 463694-463697, 463703-463704, 463706-463707, 463709-463711, 463713, 463716, 463718, 463721, 463724-463727, 463729, 463736-463744, 463747-463759, 463761-463769, 463771-463773, 463775, 463777-463781, 463784-463788, 463791-463803, 463807, 463809-463810, 463812-463814, 463817-463823, 463826-463828, 463831-463833, 463835-463839, 463842-463845, 463848, 463850-463853, 463855-463856, 463858, 463861, 463863-463864, 463868, 463870-463872, 463876-463878, 463881-463887, 463891, 463893, 463895, 463898, 463901-463902, 463904, 463907-463911, 463914-463918, 463920-463924, 463929-463930, 463936-463937, 463940-463941, 463944-463949, 463957, 463959-463962, 463965-463966, 463969-463972, 463974-463979, 463981-463991, 463993-463994, 463996, 463998-464001, 464003-464009, 464011-464016, 464019, 464021-464022, 464024-464029, 464031-464035, 464037, 464039, 464042, 464044, 464047-464053, 464055-464057, 464059, 464061-464069, 464071-464072, 464074-464077, 464079-464081, 464085, 464088-464089, 464092, 464094, 464096-464100, 464103-464104, 464106-464121, 464123-464129, 464133-464137, 464140-464156, 464159, 464161-464163, 464167-464170, 464172-464176, 464181, 464186, 464188-464190, 464192-464193, 464195-464197, 464201, 464204-464209, 464212, 464218-464219, 464221-464225, 464230, 464232-464241, 464244-464246, 464248-464253, 464255-464259, 464262-464267, 464269-464270, 464272-464278, 464280-464284, 464287-464288, 464290-464295, 464297-464298, 464300-464301, 464303-464304, 464307-464310, 464312-464318, 464320, 464324-464325, 464328-464332, 464334, 464336-464338, 464340, 464346-464348, 464350, 464352-464358, 464361-464362, 464364-464369, 464371, 464373-464376, 464378-464388, 464390-464391, 464394, 464396, 464398-464400, 464402, 464405, 464408-464409, 464414-464426, 464428-464438, 464441-464446, 464448, 464450-464457, 464459, 464461-464462, 464465-464467, 464469-464473, 464475-464482, 464485-464490, 464492-464495, 464498-464510, 464514-464515, 464518-464523, 464525, 464527-464529, 464531-464532, 464534-464544, 464546, 464554-464555, 464557, 464559-464579, 464584-464585, 464588-464590, 464593-464596, 464598-464599, 464601-464603, 464605-464611, 464615-464618, 464620, 464623, 464626-464627, 464630-464632, 464635-464636, 464638-464639, 464641, 464646-464647, 464649-464657, 464659-464662, 464664, 464667-464671, 464673-464677, 464681-464685, 464687, 464691-464693, 464696-464704, 464706-464715, 464717-464722, 464724-464726, 464728, 464730-464735, 464738-464754, 464756-464760, 464763-464766, 464769-464770, 464772-464778, 464785-464789, 464791-464793, 464796-464799, 464801-464817, 464819-464830, 464832-464833, 464835-464840, 464843-464844, 464847-464852, 464854-464856, 464858-464864, 464868-464874, 464877-464878, 464881-464888, 464891-464897, 464901, 464903-464904, 464906-464917, 464920-464923, 464925-464927, 464929-464931, 464933-464945, 464948, 464950, 464954-464955, 464960-464968, 464971, 464975-464976, 464980-464982, 464984-464985, 464987-464991, 464994-464996, 465001-465004, 465011-465015, 465017-465018, 465020, 465022, 465024, 465028-465031, 465033-465037, 465041, 465044-465052, 465054, 465056-465058, 465060-465064, 465066-465071, 465073-465081, 465086-465088, 465090-465093, 465096-465103, 465105-465106, 465108-465116, 465118-465119, 465121, 465124, 465126, 465129-465139, 465142, 465147-465153, 465155, 465158, 465161-465166, 465169, 465171-465180, 465182-465183, 465191, 465193, 465195, 465198-465199, 465201-465211, 465214-465216, 465218-465220, 465222, 465224-465229, 465231-465232, 465234-465236, 465238, 465240-465242, 465244-465246, 465248-465253, 465256, 465259-465260, 465262-465267, 465269-465270, 465274-465275, 465279-465280, 465283, 465285-465286, 465288-465291, 465294, 465296-465303, 465307-465310, 465312-465315, 465317-465319, 465321-465324, 465327-465328, 465330-465335, 465337, 465339, 465341, 465345-465352, 465354, 465356-465358, 465360-465361, 465363-465368, 465370-465371, 465374-465381, 465385, 465387, 465389-465391, 465394-465397, 465399-465402, 465405-465407, 465411, 465413, 465415-465416, 465418-465424, 465426-465428, 465430-465432, 465434-465436, 465438, 465440-465446, 465451, 465453, 465456-465459, 465462-465467, 465472-465481, 465483-465487, 465489-465492, 465494-465495, 465497-465502, 465506, 465509, 465511-465515, 465517-465520, 465522, 465524-465525, 465527-465528, 465530-465534, 465536-465540, 465542-465543, 465545-465548, 465550-465554, 465556-465557, 465560-465562, 465564, 465566-465569, 465571, 465573-465578, 465580, 465583, 465585, 465587-465592, 465594, 465598-465599, 465604, 465606, 465608-465609, 465611-465614, 465616-465617, 465619-465620, 465622-465624, 465626-465632, 465634-465638, 465641, 465647, 465650-465654, 465657-465659, 465661, 465663, 465666, 465668, 465671-465673, 465679-465683, 465685-465686, 465689-465691, 465693-465696, 465701, 465703-465705, 465707-465709, 465712, 465717-465718, 465721-465722, 465726, 465731-465734, 465737-465745, 465747-465748, 465750, 465753, 465755-465756, 465758-465760, 465766, 465770-465775, 465777-465778, 465780, 465783-465786, 465788-465789, 465791-465794, 465800-465802, 465804, 465806-465807, 465809, 465811, 465813-465819, 465822-465823, 465826-465827, 465830, 465833, 465837-465839, 465841-465845, 465847, 465849-465861, 465863, 465867-465872, 465874-465880, 465882-465885, 465887, 465891-465892, 465894-465896, 465901, 465903-465904, 465906-465911, 465914-465917, 465923-465925, 465927, 465930, 465932-465937, 465939, 465942-465946, 465948-465949, 465952-465963, 465967-465971, 465973-465975, 465977, 465979, 465982-465989, 465991-465996, 465998-465999, 466002, 466004-466005, 466008-466010, 466014-466016, 466020-466021, 466027-466030, 466033-466034, 466041, 466043-466045, 466047-466048, 466050, 466052-466057, 466059, 466062, 466064, 466067-466068, 466070, 466072-466076, 466080, 466082-466084, 466087, 466089-466091, 466094, 466095, 466098, 466100, 466102, 466104-466105, 466107-466109, 466111-466112, 466114, 466118-466120, 466124-466125, 466127-466129, 466131, 466134-466143, 466145, 466147, 466150, 466153-466158, 466160-466162, 466165, 466167-466171, 466174-466175, 466178, 466182-466185, 466187-466189, 466192-466193, 466195, 466197, 466200, 466202, 466204-466206, 466208-466211, 466215-466216, 466218, 466220, 466222, 466225-466226, 466231-466233, 466236-466238, 466241-466242, 466245, 466247, 466249, 466254, 466256-466261, 466264-466270, 466272-466276, 466280-466282, 466284-466287, 466302-466304, 466306-466308, 466310-466311, 466313-466315, 466317, 466322-466325, 466327, 466330-466332, 466334-466336, 466338, 466342-466343, 466348, 466352, 466356-466360, 466362, 466364-466368, 466370-466372, 466375-466377, 466380-466382, 466385-466390, 466392, 466394, 466396-466397, 466399, 466402-466409, 466412-466413, 466416, 466418-466421, 466423, 466425, 466427, 466429, 466431-466448, 466451-466457, 466459-466460, 466462-466465, 466467, 466469-466470, 466472, 466475, 466477-466480, 466484, 466486-466487, 466489-466492, 466494-466496, 466498-466502, 466504-466506, 466508-466516, 466518-466526, 466531, 466533-466535, 466541-466543, 466545, 466549, 466551-466553, 466560-466562, 466566, 466569, 466572, 466574, 466583-466586, 466590, 466592, 466594, 466597-466598, 466600, 466602, 466604, 466606-466608, 466612, 466614-466615, 466619-466620, 466622, 466625-466628, 466631-466636, 466639-466640, 466643, 466645, 466647-466648, 466650, 466653-466658, 466661-466665, 466667-466668, 466672, 466674-466675, 466677, 466679, 466681-466685, 466689-466692, 466702-466705, 466707-466709, 466711-466718, 466720-466721, 466724-466732, 466738, 466740-466744, 466746-466748, 466751-466753, 466755-466757, 466761-466763, 466765, 466767-466768, 466771, 466773-466775, 466777, 466780-466784, 466786-466800, 466802-466804, 466806-466812, 466814, 466816, 466818, 466820, 466822, 466828-466831, 466834-466836, 466838, 466841, 466843-466844, 466847-466853, 466855-466857, 466861-466863, 466866-466870, 466873-466878, 466880, 466888-466890, 466893-466894, 466898, 466900-466904, 466906-466907, 466910-466912, 466914, 466917-466918, 466920-466922, 466925, 466928-466931, 466934-466935, 466937, 466940, 466945, 466948-466950, 466952, 466954-466962, 466964-466965, 466969, 466973-466975, 466977-466979, 466982, 466985, 466987, 466991-466994, 467000-467002, 467006, 467008, 467013-467016, 467018, 467020-467021, 467025-467026, 467031, 467035-467038, 467048-467050, 467054, 467059, 467061, 467065-467070, 467072-467074, 467078, 467080, 467084, 467086-467091, 467094, 467096, 467098-467100, 467102, 467104, 467108-467113, 467115-467116, 467121, 467123, 467125-467126, 467129, 467133, 467135, 467137, 467140, 467148, 467150-467154, 467158-467161, 467166-467170, 467172-467174, 467179, 467181-467188, 467190, 467192-467193, 467195, 467201, 467207, 467209-467210, 467212-467213, 467215, 467217, 467220-467225, 467231-467237, 467239-467241, 467243, 467248-467251, 467253-467255, 467257-467261, 467263-467266, 467268-467269, 467271-467276, 467278, 467281, 467285-467292, 467294-467295, 467299, 467302-467305, 467310, 467312, 467315-467317, 467319-467320, 467329-467330, 467332, 467334-467343, 467345, 467347-467348, 467350, 467357-467360, 467362, 467365-467369, 467371-467372, 467374-467375, 467377-467379, 467381-467387, 467389-467394, 467396-467402, 467406-467407, 467409-467412, 467415, 467417-467418, 467421, 467423-467428, 467430-467432, 467434-467436, 467438, 467440-467444, 467447-467449, 467451-467463, 467465-467466, 467468, 467472, 467474-467477, 467479-467483, 467485-467486, 467488-467489, 467493-467495, 467498, 467502-467505, 467507-467512, 467515, 467517-467520, 467522, 467524-467526, 467528-467529, 467531-467543, 467545-467548, 467550-467552, 467554, 467556, 467560-467571, 467573-467578, 467581-467585, 467589, 467594-467599, 467602, 467604-467607, 467609-467611, 467614, 467616-467617, 467620-467622, 467624-467629, 467631-467635, 467637-467638, 467640-467643, 467646-467652, 467654, 467656, 467660, 467666-467668, 467671, 467673-467675, 467677-467680, 467683-467684, 467688, 467693-467696, 467698, 467701-467710, 467712, 467715, 467717-467723, 467726, 467728-467729, 467732, 467734, 467736, 467738-467739, 467741-467744, 467746-467748, 467752-467753, 467755, 467757, 467760, 467762-467765, 467767-467771, 467775, 467777, 467779-467781, 467783, 467787-467789, 467791-467792, 467794-467795, 467798-467801, 467803, 467805-467808, 467810-467811, 467813, 467816-467817, 467821-467822, 467824-467825, 467827-467829, 467831-467835, 467837, 467840-467845, 467847, 467849, 467851-467854, 467856, 467858-467864, 467866-467868, 467872, 467874-467875, 467878-467879, 467882-467893, 467895-467900, 467902-467908, 467910, 467912-467914, 467916-467917, 467920-467929, 467931, 467933-467939, 467942, 467944, 467946-467948, 467950-467955, 467958-467959, 467961, 467963-467965, 467967, 467969-467970, 467974-467975, 467978, 467980-467982, 467987-467989, 467991-467992, 467994-467996, 468000-468006, 468008-468011, 468013-468015, 468018-468023, 468025-468030, 468036-468042, 468044-468051, 468053, 468055-468056, 468060-468062, 468064, 468066, 468068, 468070, 468074, 468076-468078, 468080-468082, 468084-468089, 468091-468092, 468095-468103, 468105-468106, 468108, 468111-468113, 468116, 468118, 468121-468126, 468128-468130, 468133-468134, 468136, 468138, 468140-468142, 468144, 468147-468148, 468150-468151, 468153, 468155-468156, 468158-468161, 468163, 468165-468166, 468170-468171, 468174-468177, 468179-468184, 468186-468193, 468196-468197, 468200-468202, 468204, 468207-468210, 468212-468213, 468215-468217, 468219-468222, 468224-468227, 468229-468231, 468236, 468238-468239, 468243-468245, 468247-468249, 468251-468252, 468254, 468257-468258, 468261, 468263, 468265-468267, 468269-468270, 468272, 468275, 468277-468283, 468285, 468287-468295, 468297-468309, 468312-468316, 468318-468332, 468336, 468338-468347, 468349-468351, 468353, 468355, 468357-468360, 468362, 468365, 468367-468376, 468381-468389, 468392-468393, 468396, 468398, 468403, 468407-468415, 468417-468418, 468420, 468425, 468427-468434, 468436, 468438-468440, 468446-468448, 468450, 468452-468453, 468456-468460, 468462-468470, 468473, 468475-468479, 468481-468482, 468484, 468486-468488, 468490-468491, 468493, 468499-468502, 468506-468515, 468518, 468522-468526, 468529, 468531-468536, 468538-468539, 468542, 468544-468546, 468548, 468552, 468554-468558, 468562, 468565-468574, 468576-468577, 468579, 468583, 468585-468586, 468589-468591, 468593, 468595-468599, 468601-468603, 468605, 468607-468608, 468610, 468613-468614, 468616-468633, 468635, 468637-468638, 468640, 468643, 468645, 468647-468648, 468650-468658, 468661, 468666-468668, 468671-468682, 468685-468688, 468691-468702, 468705-468706, 468708, 468710, 468712-468717, 468719-468729, 468731-468735, 468738-468743, 468745-468746, 468748, 468750-468760, 468762-468765, 468767-468768, 468771-468772, 468774-468775, 468777, 468779-468780, 468782, 468785-468787, 468789-468791, 468793-468794, 468797, 468799-468801, 468803-468804, 468806, 468808-468810, 468812-468819, 468823-468825, 468828, 468830-468835, 468837-468839, 468842-468846, 468849-468851, 468853-468856, 468858-468859, 468861-468862, 468864-468870, 468872-468875, 468877-468879, 468881-468882, 468886-468887, 468889-468901, 468903-468910, 468912-468916, 468918, 468921, 468923-468924, 468930, 468932, 468934, 468936-468937, 468940, 468942-468943, 468945-468949, 468956-468960, 468963, 468966, 468968-468969, 468972-468981, 468984, 468988-468990, 468993, 468998, 469001-469012, 469016-469019, 469023, 469025, 469027, 469029-469030, 469033-469034, 469037-469038, 469040-469041, 469043, 469045, 469048, 469050-469051, 469053-469057, 469059-469063, 469066-469069, 469071-469073, 469075-469076, 469078, 469080, 469084-469085, 469089, 469091-469092, 469094-469095, 469097-469099, 469101-469108, 469110-469111, 469113, 469116-469122, 469124-469128, 469133, 469136-469138, 469141-469144, 469146-469149, 469151-469154, 469156-469158, 469160-469162, 469164-469165, 469167, 469169-469170, 469173-469179, 469181-469182, 469184, 469186, 469188-469189, 469195-469196, 469201-469204, 469206-469212, 469214-469216, 469223-469224, 469226-469233, 469235-469236, 469238-469239, 469241-469243, 469245-469248, 469250, 469253-469254, 469256, 469258-469261, 469263-469264, 469268-469273, 469275-469277, 469279-469280, 469282-469283, 469285-469292, 469295-469296, 469300, 469304-469308, 469312, 469314-469320, 469322, 469325-469344, 469347-469350, 469353, 469355-469357, 469359, 469361-469362, 469364, 469370-469374, 469376-469379, 469381-469382, 469385, 469388-469389, 469391-469393, 469395-469398, 469400, 469402-469404, 469407, 469409-469413, 469415, 469418, 469420-469421, 469427-469430, 469432, 469434, 469436-469441, 469443-469444, 469447, 469449-469453, 469456-469457, 469459, 469462, 469466, 469469, 469472-469475, 469479-469481, 469485-469487, 469490-469492, 469494-469497, 469499-469500, 469502-469509, 469511-469517, 469521, 469523-469528, 469530-469531, 469533, 469537-469538, 469541, 469543, 469545-469547, 469550-469551, 469554, 469556-469557, 469559-469560, 469564, 469567-469569, 469571-469573, 469576-469581, 469584, 469589, 469593, 469596-469598, 469601, 469606-469622, 469624, 469627-469632, 469634-469636, 469638-469639, 469641-469642, 469644-469649, 469651-469653, 469655-469656, 469658-469659, 469661-469664, 469666-469667, 469670-469677, 469679-469681, 469683, 469686, 469689-469692, 469694, 469697-469704, 469706-469708, 469710-469712, 469714, 469716-469718, 469720-469721, 469723, 469726-469729, 469732-469735, 469739-469743, 469745-469760, 469762, 469764-469769, 469771, 469773-469782, 469784-469789, 469791-469793, 469797-469799, 469801, 469803-469804, 469806-469808, 469811, 469814-469820, 469822-469826, 469828-469832, 469836-469839, 469844-469850, 469852, 469854-469856, 469858-469859, 469861-469868, 469870, 469872-469875, 469879-469881, 469883-469886, 469888, 469891, 469894, 469896-469897, 469899-469902, 469904-469905, 469907-469912, 469915-469920, 469923, 469926-469927, 469936-469937, 469939-469942, 469945-469946, 469949-469950, 469952-469953, 469955, 469957, 469959-469960, 469962-469963, 469965-469968, 469972-469975, 469977-469980, 469982-469984, 469987, 469989-469992, 469996, 469998-470002, 470004-470007, 470009-470015, 470017, 470021, 470026-470029, 470032-470036, 470038, 470040-470042, 470048, 470050-470053, 470055-470057, 470059-470065, 470067-470068, 470071, 470073-470078, 470080, 470083-470086, 470088-470097, 470100, 470104-470106, 470108, 470110-470113, 470115-470117, 470119, 470121-470125, 470127-470132, 470134-470137, 470141-470143, 470146, 470148-470152, 470155-470157, 470159-470163, 470165-470168, 470172, 470174, 470177, 470179-470180, 470182-470187, 470189-470190, 470193, 470196, 470198-470204, 470208, 470211-470221, 470223, 470228, 470230-470232, 470235, 470239-470256, 470258, 470260, 470264-470270, 470272-470279, 470281, 470283-470285, 470287, 470293, 470296-470297, 470299, 470301-470302, 470304-470305, 470307-470308, 470310-470313, 470316-470321, 470324, 470326-470342, 470344, 470349, 470351-470353, 470356-470357, 470360-470365, 470371-470372, 470374-470380, 470382, 470384, 470386-470389, 470392-470398, 470401-470407, 470410, 470412-470416, 470418-470425, 470430-470436, 470438-470441, 470444-470445, 470447-470449, 470452-470453, 470457-470458, 470462, 470464-470465, 470467-470469, 470471, 470474, 470477-470484, 470487, 470493, 470495, 470497-470499, 470501-470502, 470504, 470506, 470508, 470511-470515, 470518-470520, 470522-470529, 470532-470537, 470540-470543, 470545, 470547, 470549, 470551-470560, 470562-470563, 470565-470566, 470568, 470571-470576, 470578, 470581, 470584-470585, 470587-470592, 470594, 470596-470597, 470599, 470601, 470605, 470609-470617, 470619-470622, 470626-470627, 470629, 470631, 470633-470634, 470637, 470639-470640, 470642, 470644, 470646, 470648-470649, 470652-470654, 470656-470657, 470661-470663, 470665-470670, 470672, 470674, 470678-470680, 470682, 470684-470685, 470687, 470689, 470691-470692, 470695, 470697-470698, 470700-470706, 470714, 470716-470717, 470719-470721, 470724, 470727-470728, 470730-470736, 470738-470741, 470746-470749, 470753-470754, 470756-470758, 470760, 470762-470766, 470768-470769, 470771-470773, 470775-470777, 470779, 470781-470784, 470786-470789, 470791-470792, 470794-470797, 470799, 470802, 470804-470807, 470809-470814, 470816, 470818, 470820-470821, 470823-470826, 470830, 470834-470838, 470841-470846, 470849-470853, 470856-470859, 470861, 470863-470869, 470873, 470878, 470882-470886, 470888, 470891, 470896-470897, 470899-470900, 470902-470905, 470907-470910, 470912, 470915, 470917-470919, 470921-470928, 470932, 470935, 470937-470945, 470947-470954, 470957-470959, 470961, 470963-470964, 470966, 470969, 470971, 470973-470976, 470978, 470980, 470982-470984, 470992-470993, 470995, 470999-471004, 471007, 471009, 471012-471013, 471017-471023, 471025-471029, 471032-471033, 471039, 471042-471043, 471046, 471048-471050, 471054-471056, 471058, 471060, 471062-471065, 471068-471071, 471073, 471077, 471082-471090, 471092, 471094-471095, 471097-471099, 471103, 471106-471107, 471110-471111, 471113-471114, 471117, 471120, 471123-471124, 471127-471129, 471132, 471138-471142, 471149, 471157-471162, 471164-471166, 471168-471173, 471175, 471178, 471180, 471183, 471186-471187, 471189-471192, 471194-471200, 471202-471205, 471207-471210, 471212-471213, 471218-471219, 471221, 471226, 471229, 471231-471232, 471234-471235, 471237, 471239, 471241, 471244, 471247-471250, 471253-471255, 471257, 471259, 471262-471266, 471270, 471273, 471278, 471281-471282, 471284-471287, 471292-471296, 471298-471300, 471303, 471305, 471308, 471311-471313, 471315, 471317-471318, 471323-471324, 471326-471328, 471331-471339, 471342, 471344, 471346, 471350-471355, 471357-471369, 471372-471374, 471376-471379, 471385-471387, 471390-471395, 471397-471399, 471402-471403, 471405-471409, 471411-471414, 471416, 471420-471421, 471423-471424, 471426, 471428-471430, 471432, 471437-471439, 471444, 471449-471450, 471452, 471457-471458, 471460-471463, 471466-471469, 471471, 471473-471475, 471480-471481, 471487, 471494, 471499, 471501-471503, 471506-471508, 471510-471514, 471516-471518, 471520-471521, 471523-471524, 471526-471530, 471532-471533, 471535-471536, 471538-471541, 471545-471548, 471550-471552, 471554-471556, 471558, 471562-471563, 471565, 471567, 471570-471576, 471578-471579, 471581-471584, 471586-471587, 471590-471591, 471593, 471595, 471597-471603, 471605-471607, 471609, 471611-471613, 471617, 471620-471623, 471627, 471629, 471631-471632, 471634-471637, 471639, 471641-471644, 471646, 471650, 471652-471655, 471657-471659, 471661-471664, 471671-471675, 471682, 471686, 471688-471690, 471692-471693, 471695-471702, 471704-471705, 471708-471710, 471712-471716, 471722-471723, 471726-471728, 471731-471733, 471735, 471738-471740, 471744-471748, 471754-471759, 471762-471769, 471772-471774, 471776, 471778-471779, 471781-471786, 471788-471789, 471791-471795, 471798, 471800, 471802-471809, 471812, 471814-471815, 471817, 471819-471820, 471822-471828, 471830-471831, 471833-471834, 471837-471838, 471840-471841, 471844-471851, 471855-471860, 471866-471867, 471870-471872, 471874, 471876-471877, 471879-471886, 471889, 471892-471899, 471902, 471907, 471910, 471912, 471914, 471916-471920, 471922, 471924-471926, 471929-471930, 471932-471945, 471951, 471953-471954, 471956, 471958-471959, 471962-471963, 471968-471972, 471975, 471978, 471982-471989, 471992-471994, 471996-471998, 472001, 472003, 472006, 472011, 472013-472017, 472021-472026, 472029-472032, 472034, 472042-472044, 472046-472047, 472049, 472055-472062, 472066, 472070, 472074-472075, 472077, 472079, 472081-472085, 472089, 472093, 472096-472097, 472099-472102, 472105-472106, 472108-472111, 472114-472121, 472125, 472127-472141, 472143-472144, 472146, 472148, 472151, 472153-472156, 472158-472161, 472163-472164, 472167, 472171, 472173-472178, 472181-472182, 472184-472192, 472195-472198, 472209-472214, 472216, 472218, 472220, 472223-472224, 472227-472232, 472237-472240, 472243-472246, 472248-472251, 472253-472254, 472256, 472258-472262, 472265-472268, 472270, 472272, 472274-472278, 472280, 472282, 472284-472287, 472289, 472293-472294, 472297, 472301, 472308, 472312-472313, 472315, 472317-472319, 472321, 472323-472342, 472344, 472347-472353, 472355, 472357, 472359-472361, 472363, 472365-472366, 472368-472370, 472372, 472374-472375, 472377-472379, 472381-472394, 472397-472398, 472401, 472403, 472407-472415, 472417-472423, 472426-472429, 472437-472447, 472450, 472452, 472456, 472458-472460, 472462, 472466-472470, 472472, 472474-472475, 472477-472481, 472483-472486, 472488-472490, 472492-472499, 472501-472502, 472504-472506, 472510, 472513-472515, 472517-472522, 472525-472527, 472530-472532, 472534-472536, 472538, 472541-472545, 472547-472548, 472550, 472552-472554, 472556-472557, 472560-472563, 472565, 472567-472571, 472573-472574, 472577-472580, 472583-472584, 472586, 472590-472596, 472599-472600, 472602, 472606-472614, 472616-472617, 472619-472621, 472623-472624, 472633, 472635, 472637-472640, 472642-472648, 472651-472667, 472670, 472672-472675, 472680, 472684-472686, 472688-472691, 472693-472697, 472699, 472701, 472703, 472705, 472707-472715, 472717-472718, 472720, 472722-472725, 472729, 472731-472732, 472737-472738, 472741-472743, 472745-472748, 472752-472760, 472763-472766, 472770-472771, 472773-472776, 472778, 472781-472783, 472787, 472791, 472793-472797, 472799, 472802-472808, 472810-472815, 472817-472828, 472831-472832, 472834, 472841-472842, 472844-472845, 472847-472851, 472853-472856, 472858, 472860, 472864-472867, 472869-472870, 472872-472877, 472882-472885, 472888, 472895, 472897, 472899-472903, 472906, 472908-472910, 472912-472913, 472915-472916, 472918-472920, 472922, 472924-472926, 472929-472930, 472932-472937, 472939-472945, 472949-472954, 472959, 472961-472963, 472967-472970, 472973-472974, 472976-472983, 472985, 472988-472993, 472995-473000, 473003, 473006-473008, 473011-473017, 473019-473024, 473027, 473029, 473031-473032, 473034-473035, 473037-473039, 473042-473044, 473046, 473048-473057, 473060-473064, 473067, 473069, 473071-473076, 473078-473083, 473085-473098, 473102-473104, 473106-473107, 473109-473110, 473112-473125, 473127-473128, 473130, 473132, 473134, 473136, 473140-473145, 473147, 473149-473150, 473152, 473154-473160, 473167, 473170-473171, 473173-473174, 473176-473179, 473181-473187, 473189-473191, 473194, 473200-473206, 473210-473220, 473225-473227, 473229-473232, 473236-473237, 473240-473244, 473246-473248, 473252-473256, 473258-473259, 473263-473264, 473267, 473269-473270, 473273-473274, 473279, 473281, 473284-473290, 473292-473296, 473299-473300, 473302, 473304, 473306, 473309-473310, 473312-473314, 473316-473320, 473322-473323, 473325-473327, 473330-473331, 473334-473338, 473345-473346, 473348, 473350, 473354, 473356, 473358-473360, 473362-473368, 473372, 473376-473377, 473379, 473381-473383, 473386, 473388-473397, 473399, 473401-473409, 473413-473414, 473417, 473421-473424, 473426-473431, 473436-473438, 473441, 473443-473451, 473453-473454, 473458-473466, 473468, 473470-473472, 473476-473479, 473483-473485, 473487-473488, 473492, 473494-473496, 473498, 473500-473501, 473503-473512, 473514, 473520-473521, 473523-473526, 473529-473535, 473537-473539, 473542-473544, 473546-473551, 473553-473557, 473561-473567, 473569, 473577-473580, 473582, 473584, 473586-473588, 473591-473593, 473597-473601, 473603-473605, 473608-473612, 473614, 473616-473618, 473621-473625, 473628-473635, 473637-473643, 473645-473647, 473649, 473651-473654, 473656-473662, 473664, 473666-473668, 473670-473672, 473674, 473676, 473678, 473682, 473684-473687, 473689-473696, 473699-473700, 473702-473706, 473708-473711, 473714-473716, 473719-473721, 473724-473726, 473728-473731, 473735, 473738-473741, 473743, 473745-473751, 473758-473761, 473764-473765, 473767, 473769, 473771-473772, 473775-473780, 473782, 473784-473785, 473787, 473789-473792, 473794, 473797, 473799-473801, 473803, 473805-473806, 473809-473811, 473813-473814, 473816, 473818-473822, 473826-473829, 473832-473834, 473837-473842, 473844, 473846-473854, 473856-473862, 473865-473872, 473876, 473878-473880, 473883-473888, 473890, 473892-473895, 473897-473898, 473900-473908, 473910, 473912-473913, 473916-473917, 473922, 473924-473925, 473927-473929, 473931-473932, 473934, 473937-473938, 473940-473945, 473947, 473949, 473952-473956, 473958-473960, 473963-473965, 473967-473969, 473973-473975, 473977-473978, 473980, 473983-473984, 473987, 473990-473991, 473993-474003, 474006-474015, 474019-474021, 474023-474028, 474032, 474034, 474036-474037, 474039-474042, 474044-474047, 474049, 474052-474054, 474057-474063, 474065-474067, 474069-474070, 474072, 474074-474078, 474081, 474083-474088, 474091-474092, 474096, 474099-474102, 474106, 474109-474115, 474118, 474120-474122, 474124-474126, 474129-474130, 474132-474133, 474137-474139, 474141-474145, 474147-474154, 474157-474159, 474161, 474163-474170, 474174-474188, 474190-474192, 474194, 474196-474198, 474202-474205, 474207-474208, 474210-474211, 474214-474226, 474228-474231, 474235-474236, 474238, 474240-474242, 474244-474251, 474254, 474256-474268, 474270-474274, 474276-474282, 474284-474286, 474288-474291, 474293-474300, 474302, 474304-474308, 474313-474322, 474324, 474326-474327, 474329-474331, 474333-474339, 474341, 474343, 474345-474346, 474348, 474350, 474352, 474354, 474358-474363, 474365-474370, 474373, 474377-474378, 474382, 474384-474389, 474391-474394, 474396-474397, 474399, 474401-474403, 474408-474413, 474417-474419, 474423-474426, 474429, 474431, 474433-474435, 474439-474442, 474444, 474447, 474450-474452, 474454, 474456, 474458-474462, 474464-474474, 474476-474480, 474482-474486, 474488-474492, 474497-474499, 474502, 474504-474505, 474507, 474510-474511, 474513-474517, 474519-474520, 474522-474525, 474529-474534, 474537-474542, 474544, 474546-474555, 474559-474561, 474563-474564, 474566, 474569-474573, 474576-474579, 474581-474585, 474587-474588, 474590-474591, 474594-474598, 474602-474603, 474606-474609, 474611, 474613-474619, 474622-474633, 474636, 474638-474640, 474642-474649, 474653, 474655-474659, 474662-474665, 474669, 474672-474673, 474678, 474680-474681, 474684, 474686-474689, 474691-474692, 474695-474696, 474698, 474705-474711, 474715, 474717, 474719, 474722-474727, 474729-474735, 474739-474747, 474749-474751, 474756, 474758-474760, 474762-474763, 474765, 474767-474769, 474772-474774, 474780-474783, 474785, 474787-474789, 474791, 474793, 474797-474798, 474804-474807, 474809-474812, 474815, 474817-474819, 474821-474822, 474825, 474828, 474832-474835, 474838, 474840, 474842, 474844-474845, 474847-474852, 474855-474856, 474858-474861, 474864-474865, 474867-474869, 474871-474872, 474875-474877, 474879-474885, 474889, 474891, 474896-474898, 474902-474908, 474912-474913, 474915, 474917, 474919, 474923-474925, 474927-474929, 474935, 474937-474938, 474940, 474944, 474946-474948, 474956-474958, 474960-474964, 474967, 474970, 474972, 474974-474979, 474981-474984, 474986, 474988, 474990-474992, 474994, 474998, 475000, 475003-475005, 475007-475008, 475011-475012, 475014, 475016-475019, 475021, 475023, 475027-475028, 475030-475034, 475036, 475038-475039, 475041-475043, 475045-475046, 475048-475058, 475060-475065, 475068-475071, 475073-475074, 475076-475078, 475081, 475083-475085, 475087-475090, 475092-475094, 475096-475098, 475100-475102, 475104, 475106, 475109, 475111-475126, 475128-475129, 475132-475134, 475137-475139, 475141, 475143-475149, 475151-475155, 475157, 475159-475160, 475162-475165, 475167-475169, 475172-475173, 475175-475178, 475181-475182, 475186, 475188, 475190-475192, 475194-475198, 475200-475201, 475203-475209, 475212, 475214, 475219-475220, 475223, 475227-475229, 475232-475234, 475236-475249, 475251-475253, 475255-475263, 475265, 475267, 475269-475272, 475275, 475280-475286, 475289, 475291-475292, 475294-475296, 475298, 475300, 475302, 475306, 475310-475313, 475315, 475317, 475320, 475322-475324, 475326-475327, 475329-475331, 475333-475334, 475338-475341, 475344-475346, 475348-475349, 475351, 475353, 475355, 475357, 475359-475360, 475362, 475364-475374, 475376, 475378, 475380-475384, 475386, 475389-475394, 475397-475398, 475400-475407, 475410, 475413, 475415-475419, 475426-475430, 475433-475441, 475443, 475446, 475448-475452, 475455, 475458-475460, 475462-475473, 475475-475478, 475480, 475483-475485, 475487-475488, 475490, 475492-475493, 475496-475498, 475500, 475503, 475507-475510, 475512, 475514, 475517-475523, 475526, 475532-475533, 475535-475536, 475540, 475544-475549, 475552-475553, 475555, 475558-475559, 475561-475566, 475568-475569, 475571, 475574, 475578-475584, 475586, 475589, 475592, 475594-475595, 475597, 475602-475604, 475606, 475611-475612, 475615-475620, 475622-475628, 475630-475633, 475636-475639, 475642, 475645-475657, 475660-475661, 475663-475669, 475671-475674, 475676-475677, 475679-475682, 475684, 475686, 475688-475689, 475692, 475694, 475696-475697, 475701-475704, 475706, 475708-475709, 475711, 475714, 475716-475717, 475721-475725, 475727, 475729-475731, 475734-475735, 475740-475742, 475746-475754, 475756, 475759-475760, 475763, 475765, 475770-475774, 475777-475779, 475783-475786, 475789-475791, 475793, 475795-475796, 475798-475799, 475801, 475804, 475806, 475808-475809, 475813-475814, 475818-475825, 475829-475830, 475835, 475837-475838, 475840, 475843-475844, 475846, 475850, 475852-475856, 475860-475861, 475863-475865, 475868, 475870, 475872-475876, 475879-475880, 475882-475884, 475886-475888, 475890-475896, 475899, 475902-475903, 475908, 475910, 475912-475914, 475917, 475919-475921, 475923-475925, 475927-475935, 475941-475942, 475944-475946, 475952-475955, 475957-475963, 475965-475966, 475970-475972, 475974, 475977-475989, 475991-475999, 476001-476002, 476004-476005, 476007, 476009, 476013-476014, 476017-476020, 476023, 476025-476026, 476028-476030, 476032-476033, 476035-476039, 476041-476044, 476046, 476053-476056, 476058-476061, 476064-476067, 476069-476071, 476073, 476075, 476079, 476082-476088, 476090-476091, 476093, 476095-476100, 476103, 476105, 476109, 476111, 476116, 476118-476120, 476122, 476129-476131, 476133-476137, 476142-476147, 476149-476166, 476168-476169, 476171-476173, 476175, 476178, 476182, 476185-476186, 476188, 476190-476196, 476198-476200, 476202, 476204-476212, 476214-476216, 476218-476221, 476223-476226, 476230-476234, 476236, 476241-476254, 476256, 476258-476259, 476261, 476263-476268, 476271, 476273, 476275-476282, 476284, 476286-476299, 476301, 476306, 476311-476312, 476315, 476319, 476321-476322, 476325-476328, 476330-476331, 476333-476338, 476342-476347, 476351-476357, 476359-476360, 476364, 476368-476377, 476379, 476382-476383, 476385-476388, 476392-476395, 476400, 476404-476405, 476407-476409, 476413, 476416-476417, 476419-476421, 476426-476431, 476433-476437, 476439, 476441, 476443-476444, 476446-476447, 476450-476451, 476455, 476457-476460, 476462-476463, 476465, 476467-476469, 476471-476473, 476476, 476479, 476481-476483, 476487, 476489-476493, 476498-476504, 476506, 476509-476513, 476515-476517, 476519, 476525-476535, 476537-476540, 476542-476543, 476546-476547, 476549-476552, 476554-476562, 476564, 476566-476570, 476572-476579, 476582-476583, 476585, 476587-476594, 476596-476600, 476602-476603, 476605-476607, 476610-476614, 476621, 476623-476632, 476634-476640, 476643-476644, 476647-476648, 476650, 476652, 476654, 476656-476657, 476659-476663, 476666-476667, 476669-476677, 476679-476680, 476683-476684, 476686, 476688-476689, 476692-476694, 476696-476698, 476700-476705, 476707-476708, 476711, 476714-476717, 476719, 476722, 476724, 476727-476728, 476731-476733, 476735-476736, 476739-476740, 476742-476746, 476749-476755, 476757-476759, 476762-476764, 476766, 476769, 476771-476772, 476776, 476778-476779, 476783-476788, 476790-476794, 476796, 476798-476800, 476802-476808, 476810-476814, 476816-476822, 476826, 476828, 476830-476831, 476833-476838, 476842, 476845-476855, 476858, 476860, 476862-476863, 476865-476872, 476874-476887, 476889-476896, 476898, 476902, 476904-476913, 476916, 476918-476922, 476924-476926, 476928-476938, 476940, 476942-476944, 476948-476955, 476958-476959, 476961-476962, 476965, 476968, 476970, 476972-476973, 476976-476985, 476989-476997, 476999, 477002-477003, 477005-477009, 477013-477016, 477018, 477021-477022, 477024-477029, 477031-477032, 477034-477041, 477043-477054, 477056, 477058, 477060, 477067-477068, 477070-477071, 477073-477081, 477083, 477088, 477091-477094, 477096-477098, 477101-477104, 477107, 477109-477114, 477117-477120, 477122, 477124-477125, 477127-477128, 477130, 477134, 477136-477138, 477140-477142, 477146-477147, 477149-477151, 477153, 477155-477158, 477160-477163, 477166-477168, 477172-477173, 477175-477179, 477183-477187, 477189-477190, 477193-477195, 477198, 477201, 477205-477207, 477210-477218, 477221-477225, 477233, 477235-477237, 477239-477244, 477246-477248, 477250-477251, 477255, 477257, 477260-477261, 477263-477269, 477271-477272, 477276, 477278, 477280-477281, 477283-477287, 477290-477291, 477293-477306, 477308-477309, 477312-477315, 477317-477318, 477320, 477322, 477325, 477327, 477330-477331, 477337-477339, 477342-477345, 477350, 477352, 477356-477361, 477363-477366, 477368-477370, 477373-477376, 477378, 477382-477385, 477387-477389, 477392-477393, 477395-477399, 477401-477402, 477405, 477407, 477410, 477412-477422, 477426, 477428-477429, 477431-477435, 477437-477438, 477440, 477443-477445, 477447, 477449, 477451, 477454-477455, 477457, 477459, 477461-477465, 477468-477475, 477478-477489, 477491, 477493-477495, 477497-477498, 477500-477503, 477505-477507, 477512-477521, 477524-477529, 477531, 477533, 477535-477536, 477538-477539, 477543-477544, 477546-477548, 477550-477552, 477555, 477557-477558, 477560, 477562-477563, 477567-477569, 477572-477580, 477583, 477585, 477587, 477590, 477592-477593, 477596, 477599, 477601, 477604-477605, 477607, 477609, 477611, 477613-477614, 477616-477618, 477620, 477623, 477625-477632, 477639-477643, 477647-477649, 477652-477654, 477656-477657, 477659, 477662, 477665-477672, 477674, 477676-477678, 477680, 477682-477684, 477686-477695, 477697-477699, 477701-477702, 477708-477711, 477714-477715, 477718-477720, 477723-477732, 477736-477739, 477741-477743, 477745-477749, 477753-477756, 477759-477762, 477764, 477766, 477768-477769, 477771-477781, 477784-477786, 477788-477790, 477792, 477794, 477796, 477798, 477800, 477803-477804, 477806-477808, 477810-477814, 477816-477821, 477823-477824, 477828-477834, 477836-477837, 477841-477842, 477845-477850, 477852, 477855-477857, 477859-477862, 477864, 477866-477867, 477869-477875, 477877-477881, 477883-477884, 477886, 477888-477896, 477899-477901, 477904, 477906-477912, 477914-477916, 477918-477922, 477925, 477928-477935, 477937, 477939-477940, 477943-477944, 477946-477947, 477949-477951, 477953-477955, 477957, 477959, 477961-477965, 477967-477970, 477972-477977, 477980-477984, 477987-477988, 477990-477991, 477994-477997, 477999-478000, 478003, 478006-478012, 478015, 478017-478026, 478028-478029, 478031-478033, 478035, 478038-478042, 478044-478049, 478051, 478059-478061, 478063-478067, 478069-478070, 478072-478076, 478079-478082, 478084-478086, 478088-478090, 478092-478095, 478099-478101, 478103, 478110, 478115, 478117-478125, 478127, 478129, 478131-478136, 478139-478140, 478144-478153, 478155, 478157, 478159-478160, 478164-478174, 478176-478177, 478179-478194, 478196-478199, 478201-478212, 478214, 478216-478219, 478221-478223, 478225, 478228-478229, 478231, 478234-478242, 478249-478255, 478259-478268, 478270-478273, 478275, 478278, 478287-478298, 478300, 478302-478304, 478307, 478309-478310, 478312-478313, 478315-478317, 478320-478325, 478327, 478329-478331, 478334, 478336, 478338-478341, 478343-478349, 478351-478354, 478356-478357, 478359-478361, 478363, 478365, 478368-478369, 478371, 478373-478374, 478376-478377, 478379-478381, 478383, 478385-478389, 478392-478399, 478401, 478404-478410, 478413, 478415-478418, 478421, 478423, 478425, 478427, 478429, 478431-478432, 478434, 478437-478438, 478442-478449, 478452-478453, 478455, 478459-478460, 478462-478464, 478466-478469, 478471, 478474-478480, 478482-478485, 478487-478493, 478496-478499, 478501, 478503-478504, 478508-478513, 478516-478523, 478525-478529, 478531, 478533-478534, 478538-478543, 478545-478548, 478550-478551, 478553, 478555-478556, 478558-478559, 478562, 478564-478566, 478568-478570, 478573, 478575-478576, 478578-478583, 478588-478591, 478593-478595, 478599, 478601-478603, 478605-478606, 478608-478609, 478611-478618, 478620-478622, 478624, 478626, 478628, 478630-478632, 478636-478642, 478644-478649, 478654, 478657-478663, 478665, 478667-478671, 478673-478678, 478680, 478682, 478685-478687, 478689, 478691-478695, 478698-478700, 478702, 478704-478712, 478714-478716, 478718, 478720, 478722, 478724, 478726, 478728-478731, 478733-478738, 478743-478747, 478752-478754, 478756, 478758-478759, 478763, 478765-478767, 478769-478773, 478775-478776, 478778, 478780-478782, 478784-478787, 478789-478791, 478796, 478798-478800, 478802-478803, 478807-478809, 478816, 478818-478820, 478822-478823, 478826-478828, 478834, 478837-478849, 478851, 478854, 478856-478857, 478859-478860, 478862-478870, 478872-478875, 478878-478879, 478882, 478884, 478886, 478890-478892, 478894-478897, 478901, 478903, 478905-478908, 478911-478914, 478916-478917, 478921, 478923-478924, 478926-478928, 478930, 478932, 478934-478939, 478941-478945, 478948-478950, 478953, 478956, 478958-478961, 478963-478965, 478967, 478969-478973, 478975-478978, 478980-478981, 478984, 478986-478987, 478991-478992, 478995-478999, 479002-479004, 479006, 479009-479014, 479017-479023, 479025-479027, 479029-479034, 479037-479039, 479041-479042, 479044-479047, 479049-479052, 479054-479066, 479073-479076, 479078-479084, 479087-479101, 479103-479107, 479109-479116, 479119, 479122, 479125-479126, 479128-479129, 479134, 479138-479139, 479141, 479143, 479146-479147, 479149-479150, 479152-479153, 479156-479159, 479161, 479163-479165, 479168-479169, 479175-479176, 479179, 479181-479183, 479185-479186, 479188, 479190-479191, 479193-479194, 479196-479197, 479199-479205, 479209, 479213-479215, 479217-479220, 479222-479223, 479225-479230, 479233, 479237-479239, 479244-479246, 479255, 479257-479258, 479260, 479262-479263, 479267-479268, 479270-479272, 479275, 479285-479286, 479289, 479291-479292, 479296-479298, 479300-479301, 479304, 479306, 479309-479311, 479313-479314, 479316, 479318, 479320-479321, 479323, 479325-479330, 479334-479336, 479339-479342, 479345-479346, 479348-479350, 479352-479354, 479356-479358, 479361, 479363, 479366-479377, 479381, 479383-479384, 479386, 479388-479390, 479393-479394, 479400-479409, 479412, 479415, 479417-479420, 479422-479426, 479428, 479430-479432, 479434, 479436-479440, 479444-479447, 479449-479452, 479454-479459, 479461-479469, 479471-479472, 479474-479480, 479483-479487, 479489-479490, 479492, 479494, 479496-479497, 479499-479508, 479510-479514, 479517-479520, 479523, 479525-479529, 479532-479534, 479536, 479538-479541, 479543-479546, 479548, 479550-479560, 479562-479574, 479576-479584, 479587-479590, 479592, 479595-479596, 479598, 479600-479603, 479605, 479607-479609, 479611, 479614, 479616-479619, 479621-479632, 479635-479637, 479639-479641, 479643-479645, 479649-479652, 479656-479657, 479661-479670, 479672-479676, 479678, 479680, 479682, 479684, 479686, 479688-479690, 479692-479703, 479706-479708, 479710-479711, 479713-479716, 479720-479724, 479726-479728, 479732, 479734-479737, 479739, 479742-479743, 479745-479747, 479749, 479751-479753, 479756-479762, 479764, 479768-479769, 479773-479780, 479783-479784, 479787-479788, 479792-479803, 479805, 479808-479809, 479811, 479813-479819, 479821, 479828, 479830-479832, 479834-479835, 479838-479844, 479847-479850, 479853-479855, 479858-479860, 479862, 479865-479867, 479871, 479873-479874, 479876-479883, 479885, 479888, 479891, 479893, 479898, 479901-479907, 479913-479916, 479920-479923, 479929-479930, 479932-479937, 479941-479944, 479946, 479948-479949, 479952-479953, 479955-479958, 479960-479964, 479966, 479973-479975, 479977-479979, 479981, 479983-479984, 479986, 479989, 479991-479995, 479997, 480000-480001, 480003-480006, 480008-480016, 480018, 480020-480021, 480024-480030, 480032, 480034, 480042-480054, 480057-480062, 480064, 480069, 480073-480076, 480078, 480081, 480083-480089, 480091-480092, 480096, 480098-480100, 480102-480104, 480106-480107, 480115-480117, 480120, 480125-480127, 480129, 480131-480134, 480136-480148, 480150, 480152-480156, 480159-480162, 480164, 480166-480169, 480172-480181, 480183-480190, 480192, 480194-480195, 480197-480201, 480203-480211, 480215, 480217-480227, 480230-480232, 480235-480236, 480238-480239, 480241, 480245-480250, 480252-480258, 480260-480262, 480264, 480267, 480271, 480274-480275, 480277, 480280-480283, 480285-480292, 480294-480307, 480309, 480311, 480317-480319, 480321-480323, 480325, 480328, 480330-480332, 480336, 480338-480341, 480343-480351, 480353-480356, 480358, 480360-480372, 480374-480375, 480377, 480379-480392, 480394-480397, 480399-480405, 480407-480408, 480410, 480412, 480414, 480417, 480419-480423, 480425-480428, 480430-480437, 480439-480443, 480445, 480447, 480449-480451, 480455-480456, 480458-480459, 480461-480471, 480473-480475, 480477, 480479-480480, 480485-480487, 480493-480496, 480501, 480503-480505, 480507, 480509-480513, 480516, 480518, 480521, 480524-480525, 480527-480529, 480537-480539, 480541, 480547, 480550, 480552-480553, 480555, 480557-480560, 480562-480563, 480565-480566, 480568-480569, 480571, 480574-480576, 480578-480580, 480582, 480585-480587, 480591-480592, 480594-480595, 480598-480611, 480613-480619, 480621-480628, 480630-480631, 480634-480650, 480652-480654, 480656-480659, 480661, 480664, 480666-480676, 480678-480686, 480688-480694, 480696, 480699-480704, 480706-480712, 480719-480724, 480727, 480730-480732, 480734-480736, 480738-480741, 480743-480744, 480747-480757, 480759, 480761-480763, 480767-480773, 480775-480777, 480779, 480786, 480788, 480793-480797, 480799-480800, 480803, 480806-480807, 480809-480813, 480819-480840, 480842-480852, 480854-480864, 480866-480868, 480870-480876, 480879, 480882-480892, 480894-480895, 480898, 480901, 480903-480911, 480913-480916, 480918-480920, 480922, 480924-480926, 480929, 480931, 480934-480936, 480938-480939, 480941-480943, 480946, 480948-480949, 480951-480953, 480955, 480958-480962, 480964-480965, 480967-480970, 480972, 480974, 480976, 480978-480979, 480981-480982, 480984-480985, 480987, 480992-481001, 481004, 481006, 481008, 481010-481011, 481013, 481015-481016, 481019-481020, 481022-481024, 481026, 481028, 481030-481033, 481036-481037, 481044-481045, 481047-481057, 481059-481062, 481065-481066, 481068-481069, 481072-481075, 481078-481079, 481082-481083, 481085-481086, 481089-481092, 481097-481099, 481101-481102, 481105-481108, 481110-481115, 481117-481122, 481126, 481130-481131, 481133-481147, 481149, 481152-481154, 481159-481160, 481167, 481169-481171, 481173-481178, 481180, 481185-481186, 481188-481189, 481192-481193, 481195-481196, 481198, 481202-481204, 481206-481208, 481210, 481213-481219, 481222, 481225, 481227-481233, 481235, 481238-481240, 481247-481255, 481263-481265, 481269, 481271-481272, 481274-481275, 481277-481278, 481280, 481282, 481284-481285, 481287-481289, 481293, 481295-481296, 481298-481305, 481307, 481310, 481312, 481316, 481318-481322, 481324-481327, 481330-481334, 481336, 481338, 481340, 481342, 481344-481346, 481349-481353, 481355, 481358-481359, 481361, 481364, 481366-481373, 481376-481380, 481382-481385, 481387-481390, 481392-481396, 481398, 481403-481408, 481410-481411, 481414-481419, 481423-481429, 481431, 481433-481434, 481436, 481439-481440, 481444-481448, 481450, 481454-481460, 481463, 481465, 481467-481468, 481470-481471, 481474-481483, 481486-481492, 481494-481505, 481508, 481510, 481512-481516, 481520-481523, 481526, 481529-481532, 481534, 481536-481547, 481549-481553, 481555, 481557, 481560, 481562, 481565-481568, 481570-481573, 481576, 481580-481588, 481591-481593, 481595, 481599, 481601-481603, 481605-481606, 481609-481610, 481612, 481615-481616, 481618-481620, 481622, 481625-481626, 481628-481633, 481635-481636, 481639-481643, 481645-481652, 481655-481659, 481661-481668, 481670-481674, 481676-481678, 481680-481681, 481683-481685, 481687-481694, 481697-481699, 481703-481710, 481712-481731, 481733-481734, 481736-481741, 481744-481748, 481750-481753, 481758-481759, 481761, 481763, 481765-481766, 481768-481772, 481774-481777, 481779, 481781, 481784-481785, 481789, 481791-481795, 481797-481799, 481801, 481803, 481810-481816, 481818-481820, 481822, 481824-481827, 481829-481835, 481838-481839, 481842, 481844-481845, 481851-481858, 481860-481864, 481866-481867, 481869-481872, 481874-481878, 481882, 481885-481886, 481890, 481892-481894, 481896, 481898, 481901-481905, 481909, 481916, 481924, 481926-481927, 481930, 481933-481935, 481938-481943, 481947, 481949-481950, 481952, 481954, 481956-481957, 481959, 481963, 481966-481967, 481971, 481973-481974, 481977-481980, 481983-481985, 481987, 481990-481991, 481993, 481995, 481998-482005, 482010-482011, 482013-482014, 482016-482017, 482019, 482021-482022, 482033-482034, 482036-482039, 482041-482042, 482044, 482046-482049, 482051, 482054-482059, 482061, 482063, 482067-482073, 482075-482081, 482085-482089, 482092-482095, 482097, 482100-482101, 482107-482110, 482113-482114, 482116-482119, 482121-482127, 482129, 482133-482154, 482159-482160, 482162-482167, 482170-482172, 482175, 482177-482181, 482185, 482189, 482191, 482193, 482195-482200, 482206, 482209, 482211-482213, 482215-482217, 482219-482220, 482222-482223, 482225-482230, 482232, 482238, 482241-482242, 482245-482246, 482248-482250, 482252-482253, 482255, 482257, 482262-482263, 482265, 482267, 482269-482274, 482276, 482279, 482281, 482283-482285, 482287, 482289-482293, 482295-482296, 482299-482304, 482307, 482309-482323, 482325-482335, 482337, 482339-482343, 482345, 482348-482362, 482364-482365, 482367-482371, 482374-482379, 482381, 482383, 482385, 482387-482389, 482391, 482393-482397, 482400, 482403-482404, 482406-482408, 482410-482411, 482414-482420, 482422, 482424-482427, 482429-482430, 482433, 482435-482436, 482439, 482446-482451, 482453-482454, 482456-482457, 482461-482462, 482465, 482467, 482469-482472, 482479, 482481-482490, 482493, 482495-482496, 482498-482499, 482502-482503, 482505-482512, 482514-482515, 482518-482519, 482521, 482523-482524, 482526, 482528, 482531-482532, 482534-482535, 482537-482541, 482543, 482545-482546, 482550, 482552-482555, 482558-482561, 482563-482566, 482568, 482570-482572, 482574-482575, 482577, 482579, 482581-482582, 482584, 482587, 482589-482590, 482594, 482597-482603, 482605, 482607-482611, 482614, 482618, 482623, 482625-482626, 482628, 482630-482631, 482634, 482636-482644, 482647, 482651, 482653-482664, 482666, 482668-482671, 482673, 482675, 482679-482693, 482695, 482700-482701, 482703, 482705-482716, 482718-482719, 482721, 482723-482728, 482730-482738, 482745-482749, 482751, 482753-482754, 482757, 482761-482762, 482765-482770, 482772-482775, 482777-482778, 482780-482784, 482786-482789, 482791, 482793, 482796, 482798, 482800, 482804-482805, 482809-482816, 482819, 482821-482824, 482826-482828, 482831, 482833, 482835-482840, 482842-482844, 482847-482848, 482851-482863, 482868-482872, 482878, 482880-482884, 482886, 482888-482890, 482893-482898, 482900-482901, 482904-482906, 482910-482916, 482918-482923, 482925, 482928-482933, 482936-482949, 482952-482954, 482956-482957, 482959, 482961-482962, 482968, 482970-482972, 482974, 482976, 482979-482980, 482983-482990, 482992-482994, 482997-482999, 483001-483002, 483007-483012, 483014-483017, 483020, 483022-483024, 483030, 483032-483033, 483035, 483038-483041, 483043-483045, 483047-483048, 483051, 483055, 483057, 483059-483060, 483064-483066, 483069-483074, 483077, 483079-483081, 483083-483084, 483088-483091, 483094, 483096, 483098, 483104-483107, 483114-483119, 483123-483124, 483127, 483130, 483134-483135, 483137, 483139-483140, 483142, 483148, 483157, 483159-483160, 483163, 483165, 483167, 483169, 483173, 483178, 483183, 483186-483187, 483189-483194, 483197-483205, 483208-483210, 483212-483213, 483216, 483221-483223, 483227-483229, 483231-483235, 483239-483241, 483245-483246, 483248-483251, 483253-483258, 483260, 483262-483263, 483266, 483271, 483275-483278, 483282-483283, 483285, 483287-483290, 483292, 483294, 483296-483297, 483300, 483304-483305, 483307, 483312, 483315-483319, 483326-483327, 483329, 483332, 483335, 483337-483342, 483345, 483348, 483350-483353, 483356-483357, 483359, 483361-483364, 483367-483368, 483370, 483372, 483374-483376, 483378-483383, 483385-483386, 483389-483391, 483393-483395, 483397-483398, 483400-483403, 483405-483406, 483408-483409, 483412-483418, 483420, 483422-483425, 483429-483430, 483433-483435, 483437, 483439, 483441-483444, 483446-483451, 483453-483454, 483457-483468, 483471-483479, 483483-483487, 483489-483493, 483496, 483499-483503, 483507-483508, 483511-483513, 483517-483522, 483524-483528, 483533, 483535, 483537, 483539-483541, 483543, 483548-483550, 483553-483554, 483556, 483561, 483563-483566, 483568, 483575-483576, 483581-483584, 483586-483595, 483599-483604, 483606-483609, 483611, 483613-483617, 483619-483624, 483631, 483634, 483636-483643, 483645, 483647-483650, 483655-483660, 483662, 483668-483669, 483671-483672, 483676-483679, 483682, 483686, 483688-483690, 483692-483694, 483696, 483698-483704, 483709-483710, 483712, 483714-483720, 483722, 483724, 483728-483741, 483743-483747, 483750, 483753, 483755, 483757-483758, 483763, 483765-483768, 483771-483778, 483781-483787, 483790, 483792-483794, 483796, 483802-483809, 483812-483813, 483821, 483824, 483827-483831, 483833-483834, 483836-483837, 483839-483841, 483843, 483845-483846, 483849, 483854-483858, 483860-483863, 483865-483874, 483876-483877, 483879-483881, 483883-483884, 483886-483887, 483891, 483894, 483897-483902, 483904, 483906-483912, 483914-483915, 483917-483918, 483920-483926, 483929-483930, 483933-483934, 483936-483939, 483941-483944, 483947, 483951-483962, 483964, 483966, 483968-483972, 483975-483978, 483980-483983, 483985-483987, 483989-483990, 483992, 483994-483999, 484001-484004, 484006, 484008-484013, 484016, 484019-484020, 484022-484028, 484031-484038, 484040-484042, 484045, 484047, 484049-484051, 484053-484054, 484056, 484058-484060, 484062-484063, 484065, 484068-484070, 484073-484078, 484081-484082, 484084, 484086-484087, 484089-484091, 484097-484098, 484100, 484102, 484106-484107, 484109-484110, 484113-484115, 484122, 484124-484125, 484127-484128, 484134, 484137-484140, 484142-484144, 484147, 484149-484150, 484153-484155, 484157, 484159, 484161, 484164-484168, 484170, 484172-484174, 484176-484179, 484181-484183, 484185-484186, 484188-484192, 484194-484195, 484197-484200, 484202-484203, 484205-484208, 484210-484214, 484217-484220, 484222-484225, 484227-484228, 484234, 484236, 484238-484242, 484244, 484246, 484249-484251, 484254-484258, 484260, 484262-484264, 484270, 484272-484273, 484275, 484277-484279, 484281-484283, 484286-484288, 484290-484291, 484293, 484295-484297, 484299-484301, 484303-484304, 484307-484309, 484311-484312, 484315-484318, 484321, 484323, 484325, 484329-484332, 484334-484340, 484342, 484346-484347, 484349, 484353-484363, 484365, 484367-484369, 484373-484376, 484378-484379, 484382, 484384, 484386, 484389-484392, 484394-484397, 484401-484415, 484417, 484419, 484423-484425, 484427, 484429-484443, 484445-484448, 484450-484457, 484459, 484461-484464, 484468-484469, 484471-484472, 484474, 484476-484480, 484482-484483, 484485, 484491-484499, 484503-484504, 484506-484510, 484512-484517, 484519, 484521-484523, 484526-484533, 484535-484536, 484543-484551, 484553-484555, 484557-484558, 484560, 484565, 484567-484574, 484576-484578, 484581, 484583, 484585, 484587-484588, 484591-484594, 484599, 484603-484608, 484613-484617, 484619-484620, 484622, 484624-484626, 484629-484630, 484633-484638, 484640, 484644-484645, 484648-484650, 484652-484654, 484660-484661, 484666-484667, 484669-484671, 484673, 484675, 484682-484683, 484688-484694, 484696, 484698, 484701-484702, 484705-484709, 484711, 484715, 484717-484718, 484720, 484722-484723, 484725-484727, 484729, 484732, 484736-484738, 484742, 484747-484748, 484750-484753, 484756-484760, 484762-484767, 484769-484775, 484779-484781, 484787-484790, 484794-484795, 484798, 484800, 484802-484804, 484806, 484808-484809, 484814-484815, 484817, 484822-484826, 484831-484832, 484834, 484836-484847, 484850, 484853, 484858-484866, 484868-484869, 484876-484879, 484881-484882, 484886, 484889-484894, 484898-484904, 484907, 484910-484914, 484916-484918, 484920, 484922-484943, 484947, 484949-484950, 484952, 484954, 484956, 484959-484961, 484964-484973, 484975-484978, 484980, 484982-484983, 484986-484987, 484989, 484991-484994, 484997-485000, 485002-485006, 485008-485014, 485016-485018, 485021-485024, 485026, 485028-485030, 485035-485037, 485040-485044, 485046-485047, 485049, 485052, 485056, 485058-485063, 485068-485071, 485073, 485075-485077, 485085, 485087-485090, 485093-485098, 485100-485101, 485103-485104, 485106-485115, 485117, 485120-485124, 485126, 485128-485137, 485139-485141, 485144, 485146-485148, 485151, 485153-485156, 485158-485159, 485161-485162, 485164, 485166, 485170, 485172, 485174-485176, 485178, 485180-485181, 485183-485188, 485190-485193, 485196-485199, 485203-485204, 485207-485215, 485218, 485222, 485224, 485226-485227, 485229-485235, 485237-485239, 485242-485243, 485245-485256, 485258, 485260-485265, 485269-485275, 485278-485282, 485285-485286, 485291-485294, 485296, 485300-485302, 485304, 485306-485307, 485309-485311, 485313-485314, 485317-485319, 485321, 485325-485331, 485334, 485337, 485339-

485340, 485342, 485348-485349, 485351-485361, 485363, 485368-485369, 485371-485373, 485375-485376, 485382-485386, 485388-485389, 485391-485392, 485395-485397, 485399-485401, 485403-485404, 485409-485413, 485415-485416, 485420, 485422-485423, 485426, 485428-485429, 485431-485442, 485444-485447, 485449-485452, 485458, 485464, 485466-485474, 485477-485478, 485481-485494, 485496-485502, 485505-485508, 485511, 485513-485515, 485517-485519, 485521-485522, 485524, 485526-485528, 485530, 485533-485534, 485537-485538, 485540, 485543-485545, 485547, 485549, 485552-485556, 485558-485564, 485566-485568, 485572-485576, 485579, 485584-485587, 485591-485592, 485595, 485598-485602, 485604-485609, 485611-485614, 485616, 485621-485622, 485624-485629, 485632-485634, 485636, 485638-485639, 485641-485642, 485650, 485652-485656, 485658-485659, 485661-485662, 485665-485672, 485674-485677, 485685, 485688-485691, 485693, 485696-485699, 485702, 485704-485709, 485712-485716, 485718-485720, 485722-485725, 485731-485732, 485735-485736, 485739-485742, 485744-485745, 485747-485750, 485752, 485754, 485756-485760, 485762-485767, 485769-485770, 485772-485774, 485776, 485778-485779, 485781, 485783-485784, 485786-485790, 485793, 485796-485800, 485803, 485806, 485809, 485811-485813, 485815-485816, 485818, 485820-485822, 485824-485826, 485831, 485833-485839, 485843-485846, 485848-485853, 485855, 485858-485861, 485864-485867, 485869, 485872-485876, 485879-485882, 485886-485895, 485897-485900, 485905-485913, 485915-485916, 485919-485920, 485922-485928, 485931-485963, 485965, 485967, 485970, 485972-485973, 485975, 485977-485988, 485990, 485993, 485995-485996, 486000-486004, 486007, 486011-486018, 486022-486023, 486026, 486030-486032, 486038, 486041, 486049-486052, 486055-486062, 486064-486066, 486068-486073, 486075, 486078-486079, 486081-486082, 486084-486089, 486091-486092, 486095-486096, 486101-486102, 486104-486107, 486109, 486111, 486115-486118, 486124-486129, 486133, 486135, 486138, 486141-486142, 486144-486146, 486154, 486156-486157, 486160-486161, 486163-486164, 486167-486169, 486173, 486175-486176, 486181, 486183-486184, 486186-486189, 486193-486200, 486203-486211, 486213-486215, 486217-486226, 486229-486231, 486233, 486235-486238, 486242-486247, 486249-486250, 486252-486264, 486266-486268, 486270-486273, 486277, 486280-486287, 486289-486291, 486293-486304, 486307-486312, 486314-486318, 486322-486325, 486329, 486331, 486333, 486339-486341, 486345-486349, 486351-486352, 486355-486356, 486358, 486361-486363, 486366-486368, 486370-486377, 486379-486383, 486386, 486388-486394, 486397-486399, 486404, 486406-486407, 486410, 486412, 486415-486419, 486422, 486424-486425, 486427-486438, 486440-486443, 486446-486452, 486454-486460, 486462-486472, 486474-486475, 486477-486479, 486481-486482, 486484, 486486, 486489-486492, 486495-486498, 486500, 486502-486503, 486505-486507, 486509-486510, 486512-486518, 486520-486521, 486523, 486526, 486529-486534, 486536, 486539-486544, 486546-486548, 486550, 486552-486553, 486556-486557, 486559-486560, 486562-486563, 486565, 486571-486578, 486580, 486582-486589, 486591, 486594-486596, 486598-486599, 486602-486605, 486607-486608, 486610-486611, 486613-486614, 486616-486620, 486626, 486628, 486631-486632, 486634-486640, 486642, 486646-486647, 486649-486650, 486654, 486656, 486658-486660, 486665-486666, 486670-486678, 486681-486682, 486684-486687, 486690-486693, 486696-486697, 486700-486701, 486704, 486706, 486708, 486713, 486715-486723, 486727-486729, 486731-486735, 486737-486738, 486740-486744, 486747-486749, 486752, 486755-486757, 486759, 486761, 486763, 486766-486771, 486773-486774, 486776-486779, 486785, 486788, 486790-486792, 486795-486797, 486799, 486802-486804, 486806-486807, 486809-486811, 486814-486815, 486817, 486819, 486821-486822, 486824-486825, 486828-486833, 486836, 486838-486843, 486845-486848, 486851, 486857, 486859-486860, 486862, 486864-486868, 486877-486878, 486880-486881, 486884-486887, 486895-486896, 486898, 486900-486902, 486904-486906, 486908-486911, 486914-486915, 486917-486923, 486930-486938, 486940-486942, 486944-486946, 486948-486950, 486952, 486955, 486958, 486961, 486965, 486969-486979, 486984, 486986-486987, 486989, 486993-486997, 486999-487003, 487006, 487009-487010, 487012-487015, 487017, 487020-487026, 487028-487043, 487045-487048, 487050-487054, 487056, 487062, 487064-487066, 487069, 487071-487074, 487077, 487079-487080, 487082, 487085-487087, 487091-487095, 487097, 487100-487104, 487108-487113, 487118-487123, 487125, 487128-487130, 487132, 487136-487141, 487144, 487146-487149, 487158-487159, 487163-487170, 487172-487174, 487176, 487178-487180, 487184, 487186, 487188-487189, 487191-487193, 487196-487197, 487199, 487201-487204, 487206-487218, 487221, 487223-487226, 487228-487232, 487234-487239, 487241, 487243-487246, 487253, 487255-487259, 487261-487264, 487267-487268, 487271, 487275-487276, 487278-487280, 487282-487283, 487286, 487288, 487291-487292, 487294, 487296, 487298-487299, 487301, 487303-487304, 487306, 487308-487311, 487313-487315, 487318-487321, 487324, 487327, 487329-487330, 487332-487336, 487339-487353, 487355-487359, 487361-487363, 487365-487367, 487369-487372, 487374, 487376-487377, 487379, 487381-487383, 487385, 487387, 487389, 487396-487398, 487400-487404, 487408, 487410, 487416-487419, 487421-487426, 487428, 487430, 487432-487434, 487437-487438, 487440, 487442-487445, 487447, 487451-487452, 487454, 487456, 487463-487471, 487473, 487475-487476, 487486-487487, 487489, 487491-487493, 487495-487498, 487504-487507, 487511-487518, 487520-487524, 487528-487539, 487543-487545, 487547-487548, 487550-487553, 487555, 487557, 487560, 487563, 487568-487574, 487576-487579, 487581-487584, 487587-487588, 487590-487592, 487594, 487596-487599, 487603, 487606-487609, 487611-487613, 487615, 487617-487624, 487626-487628, 487630-487635, 487637-487643, 487645-487646, 487655-487656, 487658, 487660, 487663-487666, 487668-487670, 487672-487677, 487679, 487681-487688, 487693-487694, 487696-487698, 487700-487703, 487707-487708, 487711, 487714-487716, 487719-487720, 487722-487723, 487725-487728, 487730, 487732-487733, 487735-487737, 487740-487742, 487744-487747, 487749-487751, 487753-487754, 487756, 487758-487764, 487766, 487768-487770, 487773-487774, 487776-487779, 487781-487782, 487784-487785, 487787, 487789, 487793-487796, 487798, 487801, 487803-487805, 487808-487810, 487813, 487816-487818, 487822-487823, 487826-487832, 487834-487836, 487838-487839, 487841, 487843-487844, 487846, 487848-487855, 487857-487864, 487866-487867, 487869, 487872-487875, 487877, 487879-487880, 487884-487888, 487890, 487893-487895, 487897-487900, 487902-487903, 487905-487909, 487913, 487915-487916, 487918-487924, 487926, 487928, 487934, 487936, 487938-487943, 487945-487946, 487949-487950, 487953-487955, 487957-487958, 487961-487963, 487966-487967, 487970-487975, 487977-487980, 487982, 487984, 487986-487990, 487992-487993, 487995-488002, 488004, 488006, 488008-488010, 488012, 488018-488020, 488022, 488026, 488030, 488032, 488035, 488038-488040, 488043, 488045-488046, 488049-488055, 488058-488060, 488062-

488063, 488066-488069, 488074-488078, 488080, 488084-488086, 488088-488091, 488095-488096, 488099, 488102-488104, 488106-488107, 488110, 488112-488114, 488126, 488129-488133, 488135, 488141, 488146-488151, 488154, 488156-488157, 488159, 488161, 488163-488182, 488184-488186, 488188-488190, 488192-488193, 488195-488197, 488199-488201, 488204, 488207-488208, 488210, 488214, 488216, 488218-488221, 488223-488225, 488227-488228, 488230-488235, 488237-488239, 488242-488249, 488251, 488254-488255, 488257-488258, 488263-488265, 488267-488273, 488275, 488278-488288, 488290-488291, 488293-488295, 488298, 488300-488303, 488306-488307, 488309-488312, 488314-488315, 488317-488323, 488326-488332, 488336, 488338, 488340, 488342-488343, 488346-488349, 488355-488359, 488361, 488366, 488368-488369, 488371-488372, 488374-488376, 488379, 488381, 488386-488391, 488393-488399, 488401-488402, 488407-488409, 488411-488412, 488414-488415, 488417-488419, 488421-488423, 488425-488427, 488432, 488434-488435, 488438-488439, 488441-488442, 488444-488448, 488453, 488456, 488458, 488461, 488464, 488469, 488473, 488475-488476, 488480-488481, 488483-488487, 488492-488496, 488499-488500, 488502, 488504, 488507, 488509-488513, 488516-488517, 488520, 488524, 488526, 488528-488529, 488531-488534, 488536, 488538-488540, 488543, 488545-488552, 488558, 488560, 488563-488564, 488566-488573, 488576, 488578, 488581-488584, 488586, 488589-488590, 488594-488596, 488598-488599, 488604, 488607-488609, 488611, 488614-488618, 488620-488621, 488624-488626, 488628-488629, 488632, 488636-488638, 488640-488641, 488643-488644, 488646, 488648-488649, 488651-488653, 488655, 488657-488663, 488665, 488667, 488669-488670, 488674, 488677, 488680-488682, 488684, 488687-488688, 488691, 488693-488694, 488697-488699, 488702-488704, 488706, 488708, 488710-488711, 488713-488719, 488721, 488723-488724, 488726-488730, 488732, 488735, 488738-488739, 488742-488747, 488749-488750, 488753-488757, 488760, 488763-488768, 488775-488776, 488781-488783, 488785-488786, 488788-488790, 488793, 488798, 488800, 488802-488804, 488807-488816, 488819, 488824, 488826-488827, 488829, 488831-488832, 488834-488837, 488839-488841, 488844-488845, 488847, 488849, 488856-488857, 488860-488863, 488865-488866, 488868-488875, 488879-488881, 488885-488893, 488895-488896, 488898-488900, 488902-488904, 488907, 488909, 488911-488913, 488916, 488919-488920, 488923-488926, 488928, 488935-488946, 488948, 488950-488955, 488957-488959, 488962-488964, 488968-488969, 488972-488973, 488975-488976, 488978, 488980, 488983, 488985, 488987, 488990-488992, 488994, 488998-489002, 489004-489005, 489007, 489010, 489012-489013, 489015-489016, 489018-489019, 489021, 489023-489024, 489026-489027, 489030-489032, 489034, 489036-489039, 489042, 489044, 489046-489052, 489055-489058, 489064-489065, 489067, 489069, 489077-489080, 489082, 489090, 489092, 489094-489100, 489103-489106, 489108, 489110, 489113-489115, 489118-489119, 489121, 489123-489129, 489133-489134, 489137, 489140-489145, 489149-489150, 489152, 489154-489170, 489172-489173, 489175-489177, 489183-489196, 489200, 489202-489204, 489206-489207, 489209, 489211-489213, 489216-489217, 489219-489220, 489224-489227, 489230-489234, 489238-489241, 489247, 489250-489256, 489258-489259, 489261-489262, 489264-489266, 489270-489276, 489278, 489280, 489282-489284, 489287-489295, 489299-489303, 489305-489311, 489313, 489315-489317, 489319-489320, 489322-489326, 489329-489333, 489336-489337, 489339-489341, 489345-489346, 489348-489349, 489353-489356, 489358-489361, 489364-489365, 489367-489368, 489370, 489372, 489374-489378, 489384-489393, 489396, 489398-489400, 489402-489403, 489405, 489410, 489412-489416, 489419, 489421-489425, 489429, 489432, 489436, 489439-489441, 489443, 489445, 489448-489454, 489458, 489460, 489462, 489464, 489466-489467, 489470-489472, 489475-489476, 489478-489480, 489482-489484, 489487, 489489-489491, 489493, 489495, 489497, 489499-489500, 489503, 489506-489519, 489522, 489524-489531, 489534-489536, 489538-489539, 489543, 489547, 489553-489554, 489557, 489559-489570, 489573-489579, 489583, 489585-489587, 489589, 489593-489597, 489605, 489607-489608, 489614-489617, 489622, 489624, 489628-489631, 489633-489638, 489645, 489648, 489650-489651, 489657, 489660, 489662-489665, 489667-489670, 489673, 489675-489677, 489679, 489683-489686, 489688-489689, 489692, 489694, 489697-489699, 489701-489713, 489716-489722, 489725, 489727-489729, 489732-489737, 489739-489741, 489743, 489749, 489751-489752, 489754, 489756, 489759-489762, 489766-489768, 489770-489772, 489774-489776, 489778, 489780-489781, 489783-489784, 489786, 489788-489789, 489791-489793, 489795-489796, 489798-489800, 489804-489808, 489811, 489813-489818, 489820-489831, 489834, 489838, 489840-489843, 489845, 489848-489850, 489852-489854, 489857-489863, 489865-489866, 489869, 489871-489875, 489877-489878, 489881-489882, 489885, 489887, 489889-489891, 489895-489899, 489901-489902, 489904-489905, 489907-489909, 489912-489914, 489917, 489925-489939, 489941, 489943, 489946-489948, 489951-489952, 489954, 489959-489970, 489973-489974, 489977-489979, 489981-489985, 489987-489989, 489991, 489993, 489996-489998, 490000, 490002, 490004, 490006, 490008, 490010-490013, 490015, 490018-490025, 490029-490032, 490040-490042, 490044-490047, 490051-490054, 490056-490058, 490061-490063, 490065, 490067-490071, 490075, 490077, 490079-490083, 490086-490090, 490092-490097, 490100-490103, 490105-490108, 490110-490113, 490115, 490117, 490119, 490121, 490124-490129, 490132-490134, 490136-490140, 490142, 490144, 490146, 490149-490150, 490152-490155, 490158, 490160-490163, 490165-490171, 490173, 490175-490178, 490181-490183, 490185, 490188, 490191, 490193, 490195-490199, 490202-490204, 490206-490208, 490211, 490217, 490219-490221, 490223-490226, 490229-490245, 490247, 490250, 490252-490253, 490256-490257, 490259-490260, 490263-490264, 490266-490270, 490272-490277, 490279, 490281-490284, 490286-490288, 490290-490291, 490294-490297, 490299-490301, 490303-490306, 490308, 490310-490312, 490314-490320, 490325, 490327, 490329, 490331-490343, 490346-490354, 490356, 490359-490364, 490367-490368, 490371, 490373-490374, 490376, 490379, 490384-490387, 490390-490397, 490400-490404, 490409, 490412, 490414, 490417-490418, 490420-490421, 490423, 490425, 490427, 490431-490441, 490444-490445, 490447-490448, 490450-490452, 490457-490460, 490462-490466, 490469, 490471, 490475, 490482-490483, 490486-490489, 490491-490497, 490499-490504, 490506-490507, 490510-490513, 490515-490516, 490518-490525, 490527-490534, 490536-490537, 490543-490545, 490547-490549, 490551-490552, 490554-490555, 490558, 490560, 490562-490569, 490571, 490575, 490577-490579, 490581-490585, 490588-490592, 490594-490598, 490600, 490603, 490606, 490609-490611, 490613-490621, 490624-490626, 490628-490631, 490633-490639, 490643, 490645-490649, 490651, 490653, 490655, 490658, 490660-490661, 490667-490668, 490670-490674, 490678, 490680, 490682, 490685, 490687, 490690, 490694-490695, 490697-490698, 490702-490721, 490723, 490727-490733, 490735-490738, 490740, 490742-490746, 490749-490750, 490753, 490755-490763, 490765, 490767-490768, 490770, 490775-490778, 490780-490782, 490784-490788, 490792-490793, 490795, 490797, 490803, 490805-490809, 490811, 490813, 490816, 490818-490822, 490826-490831, 490833-490838, 490840-490853, 490856, 490859-490865, 490869-490870, 490873-490883, 490885, 490889-490892, 490894-490899, 490901-490903, 490905-490912, 490914-490917, 490920-490923, 490925-490926, 490928-490931, 490939, 490941, 490944, 490946, 490949-490952, 490954, 490956, 490958-490961, 490972-490976, 490978-490979, 490981-490989, 490991-490992, 490994, 490996-490998, 491001-491007, 491009-491010, 491012-491015, 491018-491019, 491021, 491023-491028, 491030-491031, 491034-491035, 491038-491041, 491045, 491047, 491050-491060, 491064-491070, 491072-491076, 491083, 491085-491092, 491096, 491099-491102, 491104-491105, 491108-491112, 491115, 491119-491120, 491122, 491125-491126, 491128, 491130, 491132-491136, 491142-491143, 491145, 491148-491151, 491154, 491156, 491159-491162, 491164, 491171, 491179-491181, 491184-491193, 491195-491197, 491199-491201, 491203-491215, 491218-491219, 491222, 491224-491225, 491230, 491232-491236, 491241-491243, 491245-491246, 491248, 491250-491251, 491254-491256, 491259-491260, 491262-491263, 491267-491268, 491270, 491273-491277, 491279, 491281-491283, 491285-491286, 491288-491289, 491293-491294, 491296-491297, 491299, 491302-491307, 491309-491311, 491313-491314, 491316-491319, 491321, 491325-491327, 491329-491330, 491332, 491337, 491340, 491346-491347, 491349, 491351-491352, 491356-491358, 491360-491367, 491369, 491373-491376, 491378, 491386-491391, 491393-491398, 491400, 491402-491403, 491405-491411, 491417, 491419, 491421, 491423-491427, 491429-491432, 491434-491435, 491438-491439, 491441-491445, 491448, 491451-491453, 491455, 491458-491461, 491463, 491469-491475, 491477, 491479-491481, 491484, 491486-491488, 491490-491491, 491495, 491497, 491500-491501, 491504, 491506, 491508-491510, 491515-491518, 491521, 491525-491528, 491530-491531, 491533-491540, 491542, 491544-491545, 491547-491548, 491550-491553, 491555-491559, 491566-491568, 491571, 491573-491574, 491576, 491578-491579, 491582, 491585-491586, 491588-491590, 491593-491598, 491600-491603, 491606, 491608-491610, 491612-491615, 491618-491621, 491625, 491628-491629, 491633-491634, 491636, 491640, 491643-491652, 491654-491655, 491657, 491661, 491664-491667, 491670, 491673-491677, 491680-491681, 491684, 491686-491695, 491697-491703, 491705, 491709-491718, 491720-491722, 491725, 491727, 491729, 491731-491734, 491736, 491738-491739, 491741, 491743-491747, 491750, 491753, 491755-491762, 491764, 491768-491769, 491772-491779, 491781-491782, 491785, 491789-491790, 491792, 491795-491796, 491800, 491802, 491805-491807, 491815, 491818-491819, 491822, 491824-491828, 491830-491831, 491833-491835, 491837-491838, 491844-491849, 491852-491859, 491861-491868, 491871-491874, 491876-491877, 491879-491882, 491884-491885, 491887-491890, 491892, 491896-491898, 491901, 491903-491906, 491908-491909, 491912, 491914, 491919-491923, 491925, 491927-491934, 491936, 491938-491939, 491942, 491945, 491947, 491950-491957, 491960, 491963, 491966-491967, 491973, 491976, 491978-491982, 491984-491995, 491999-492000, 492002, 492006, 492008, 492010-492011, 492013-492015, 492019, 492022-492025, 492027-492033, 492035, 492037-492038, 492041-492044, 492046, 492048-492050, 492053-492063, 492065, 492067-492069, 492071-492083, 492085-492089, 492091-492095, 492097, 492099-492106, 492109, 492111-492117, 492123, 492125-492127, 492129-492133, 492135-492138, 492140-492143, 492146-492147, 492149-492153, 492155-492164, 492168, 492170-492171, 492175, 492177-492181, 492183, 492185-492186, 492190, 492193, 492197, 492200-492204, 492206-492210, 492212-492214, 492216-492222, 492225-492230, 492233-492239, 492241, 492243, 492245, 492248, 492251, 492253-492259, 492261-492266, 492270-492272, 492274-492277, 492280, 492283-492286, 492288, 492291, 492293, 492298-492302, 492304-492313, 492316-492317, 492320-492323, 492328-492329, 492331, 492333, 492335-492337, 492339, 492341-492349, 492351-492352, 492355, 492357-492360, 492362-492363, 492365-492370, 492374-492375, 492377-492378, 492381-492383, 492385-492386, 492389, 492393, 492395-492403, 492405, 492408-492409, 492413-492418, 492421-492423, 492425-492427, 492429-492432, 492434-492435, 492440-492443, 492449-492451, 492454-492455, 492457, 492461, 492463-492470, 492474-492487, 492489-492490, 492492-492493, 492495-492497, 492499, 492506-492507, 492512, 492514, 492517-492523, 492527, 492529-492530, 492532, 492537, 492541, 492546, 492549-492551, 492553-492557, 492559-492561, 492563, 492565-492569, 492571, 492574-492576, 492578-492580, 492583-492584, 492586-492590, 492592-492594, 492596, 492598-492605, 492607-492608, 492610, 492612-492614, 492618-492621, 492627-492628, 492630, 492632-492641, 492643, 492647, 492654, 492657, 492661, 492666-492667, 492669, 492671-492673, 492676, 492678, 492681-492685, 492688-492689, 492691-492692, 492698-492702, 492704, 492706-492711, 492713, 492716-492719, 492721, 492724-492726, 492729-492730, 492733, 492735-492739, 492741-492742, 492745-492748, 492750, 492752-492753, 492756-492758, 492761-492769, 492772-492773, 492781, 492783-492784, 492786-492789, 492791-492794, 492797-492799, 492801-492803, 492805-492806, 492809-492810, 492813-492816, 492819-492821, 492823-492825, 492828-492829, 492831-492832, 492834-492835, 492837-492840, 492842-492846, 492848, 492852, 492856, 492859, 492862-492868, 492870-492871, 492873-492879, 492881, 492888-492892, 492894, 492896-492899, 492901, 492904-492907, 492909-492912, 492915, 492922-492924, 492927, 492930-492931, 492934, 492936-492941, 492943-492945, 492948-492950, 492952-492956, 492958, 492964, 492966-492968, 492970, 492974-492975, 492977-492978, 492981, 492983, 492985, 492988-492989, 492991-492994, 492997-492999, 493003-493006, 493008-493012, 493015-493016, 493018, 493022, 493024-493026, 493030, 493032-493040, 493042-493046, 493048-493056, 493058-493059, 493061-493065, 493067-493078, 493083-493084, 493086, 493088-493089, 493091-493093, 493098-493100, 493102-493103, 493108, 493110-493119, 493121-493122, 493124-493140, 493142-493145, 493147-493151, 493153, 493160, 493162-493166, 493168-493169, 493172-493176, 493178, 493182-493185, 493193-493194, 493196-493199, 493201-493204, 493207-493208, 493210-493212, 493214, 493216, 493219, 493223-493226, 493228-493229, 493231, 493236-493238, 493240-493241, 493243-493245, 493247, 493255-493256, 493259, 493261, 493264-493265, 493270, 493272-493281, 493285-493287, 493291-493295, 493297-493301, 493308, 493313, 493315, 493327-493328, 493330-493334, 493337-493338, 493343, 493345-493346, 493349, 493351, 493357-493358, 493360-493361, 493363-493365, 493367, 493371, 493373, 493376-493381, 493383-493384, 493387-493388, 493390-493394, 493398, 493401, 493403, 493405, 493409-493410, 493412-493413, 493415-493419, 493424-493428, 493431-493432, 493436-493439, 493441-493442, 493444, 493446-493447, 493450-493454, 493458-493460, 493463, 493467, 493469, 493472-493475, 493477, 493479, 493482-493483, 493485, 493488-493490, 493493-493499, 493501, 493503, 493505, 493507-493509, 493516-493519, 493522, 493525, 493528, 493530-493533, 493537, 493539-
493543, 493547-493549, 493560-493561, 493563-493565,
493568, 493570-493571, 493573-493574, 493576, 493579-
493581, 493585, 493590-493592, 493594, 493596-493597,
493599-493600, 493602, 493604-493608, 493610-493621,
493624-493627, 493629, 493631, 493633, 493641-493642,
493645-493647, 493649-493651, 493656-493660, 493670,
493674-493676, 493678, 493680, 493682-493683, 493685-
493687, 493693-493698, 493700-493703, 493705-493706,
493708-493714, 493721-493724, 493726-493727, 493729-
493733, 493737, 493739, 493742, 493744-493747, 493749-
493751, 493753, 493761, 493763, 493766, 493768-493776,
493778, 493781-493784, 493786-493787, 493789, 493792,
493796-493798, 493800-493801, 493803-493808, 493810-
493813, 493816-493818, 493825-493826, 493830, 493832-
493834, 493836-493837, 493839-493841, 493853-493856,
493858-493863, 493865-493867, 493871, 493874, 493876-
493881, 493883, 493885, 493889, 493891-493897, 493899,
493901, 493903-493904, 493907, 493909, 493912, 493914,
493917, 493924-493925, 493930, 493932, 493937-493941,
493943-493944, 493946, 493948, 493952, 493954-493956,
493959-493964, 493966-493971, 493973, 493976-493978,
493980-493982, 493985-493986, 493988, 493991-493992,
493994, 494000, 494002-494003, 494005-494006, 494008,
494011-494013, 494016, 494020-494023, 494025, 494027-
494032, 494035, 494037-494040, 494042-494043, 494045,
494047-494048, 494051, 494053-494055, 494057, 494059,
494061-494062, 494064-494066, 494068, 494070, 494073-
494085, 494088, 494091, 494099, 494101, 494104-494106,
494109-494112, 494115, 494117, 494119-494120, 494122-
494125, 494127-494128, 494132, 494135, 494137, 494142-
494147, 494149-494150, 494153-494156, 494158-494165,
494168, 494170, 494172-494174, 494178, 494180, 494183-
494184, 494186-494187, 494190, 494196-494197, 494200,
494204-494205, 494212-494213, 494215-494216, 494220,
494222-494223, 494226, 494228, 494230-494236, 494238-
494245, 494249, 494253, 494255-494256, 494258-494259,
494261-494262, 494266, 494268, 494271, 494273, 494277-
494278, 494281, 494283, 494285-494286, 494289-494290,
494292-494294, 494298, 494300, 494303-494305, 494307-
494309, 494313, 494315-494320, 494323-494327, 494330,
494333-494334, 494336, 494338-494344, 494346-494352,
494355-494357, 494360-494366, 494368, 494371, 494374,
494377-494379, 494382, 494386, 494388, 494390, 494392-
494398, 494400, 494402-494403, 494405, 494407-494410,
494414-494417, 494419-494420, 494423-494424, 494426-
494427, 494429, 494432-494433, 494436, 494438-494442,
494445-494446, 494450, 494452, 494455, 494457, 494459-
494460, 494463-494467, 494471, 494473-494480, 494482-
494483, 494486-494494, 494496, 494500, 494502, 494507-
494518, 494521-494527, 494529, 494533, 494535-494540,
494542, 494545-494546, 494549-494552, 494554-494559,
494563-494576, 494579-494581, 494585-494586, 494588-
494589, 494592, 494594, 494596-494598, 494600-494613,
494615-494617, 494620, 494622-494625, 494627, 494629-
494630, 494634-494636, 494638, 494640-494641, 494643-
494645, 494656-494657, 494659-494660, 494663-494670,
494672-494687, 494689-494691, 494696, 494698-494702,
494705-494710, 494712, 494715, 494717-494727, 494729-
494731, 494733-494736, 494742-494743, 494745, 494747,
494752-494755, 494758-494763, 494765-494767, 494769-
494771, 494773-494784, 494786, 494788-494789, 494791-
494793, 494795-494798, 494801-494802, 494804-494810,
494812, 494815-494816, 494822-494827, 494829-494831,
494837-494840, 494842-494848, 494851-494854, 494856,
494858-494859, 494861-494866, 494868-494885, 494887-
494888, 494890-494893, 494895-494901, 494905-494909,
494911, 494914-494915, 494917-494918, 494920-494924,
494926-494927, 494929, 494931, 494934, 494936, 494938-
494939, 494944-494945, 494947-494949, 494952-494953,
494959-494960, 494963, 494965-494986, 494988-494990,
494992-494994, 494996, 494998, 495000-495004, 495006,
495008-495009, 495011, 495017-495020, 495022-495027,
495029, 495034, 495036-495043, 495045-495046, 495052-
495060, 495063, 495066-495071, 495073-495074, 495077-
495083, 495087-495092, 495094, 495096-495098, 495100-
495109, 495112-495122, 495126-495132, 495134-495137,
495139, 495141, 495143, 495145, 495147-495151, 495154-
495155, 495158-495161, 495166-495168, 495171, 495177-
495182, 495184-495186, 495188-495190, 495192, 495194-
495197, 495199-495201, 495203-495204, 495206-495209,
495211, 495213-495217, 495219, 495221, 495226-495233,
495235-495237, 495239, 495242-495245, 495247-495249,
495251, 495256-495260, 495262-495265, 495267-495268,
495270, 495272-495273, 495275-495277, 495280, 495282-
495293, 495295, 495297, 495299-495304, 495307-495308,
495310, 495312, 495314, 495316-495317, 495319-495320,
495322, 495325, 495329, 495333-495334, 495336, 495338-
495340, 495342-495345, 495347-495352, 495354-495355,
495357-495360, 495365-495372, 495374-495376, 495382-
495383, 495385-495388, 495390-495399, 495401-495403,
495405-495406, 495408, 495410-495411, 495414, 495417,
495419-495420, 495422-495423, 495427-495428, 495430-
495438, 495440-495441, 495443-495452, 495454-495455,
495463, 495465-495470, 495472-495475, 495478-495479,
495481-495487, 495491-495493, 495495-495496, 495498-
495499, 495502-495503, 495506-495508, 495510-495513,
495517, 495519-495523, 495526-495528, 495531-495533,
495535-495537, 495541-495544, 495546-495550, 495552-
495556, 495558-495563, 495566-495567, 495569-495583,
495585-495587, 495591, 495593-495594, 495596-495597,
495600-495601, 495603-495609, 495613-495614, 495616,
495620-495623, 495627, 495629-495637, 495639-495640,
495642-495661, 495665, 495667-495668, 495670, 495676-
495680, 495682-495685, 495688-495693, 495695, 495699-
495700, 495702, 495704-495708, 495713-495715, 495718,
495721-495724, 495726, 495728-495729, 495731-495732,
495734, 495737-495747, 495749-495750, 495758-495763,
495768-495769, 495771, 495774-495777, 495784-495785,
495788-495789, 495791-495795, 495797-495798, 495800-
495804, 495807-495819, 495822, 495826, 495828, 495836,
495839-495841, 495843, 495845, 495847, 495849-495850,
495852, 495856, 495859-495861, 495863-495872, 495875-
495877, 495879-495886, 495888, 495892-495896, 495898-
495918, 495920-495921, 495924-495930, 495932-495939,
495942, 495944-495947, 495952-495958, 495960, 495962-
495963, 495965-495966, 495968-495969, 495971, 495973,
495976, 495980-495981, 495983-495985, 495987, 495989-
495991, 495994-495995, 495999, 496001-496004, 496006-
496007, 496009-496015, 496017, 496019-496022, 496024-
496028, 496030-496033, 496035-496040, 496046-496047,
496049-496051, 496053-496056, 496059, 496061, 496063,
496066, 496068-496069, 496071-496074, 496077-496080,
496082-496083, 496087-496088, 496090-496091, 496093-
496096, 496100-496102, 496104-496105, 496109, 496111-
496117, 496120, 496125-496129, 496132-496134, 496139-
496141, 496144-496149, 496152-496155, 496157-496159,
496161-496164, 496166-496176, 496180-496183, 496185-
496191, 496193, 496195-496201, 496203-496206, 496208,
496210-496212, 496214, 496216-496217, 496220-496221,
496224-496226, 496230-496233, 496235-496236, 496238,
496240-496245, 496249, 496251, 496254-496259, 496261-
496262, 496264-496265, 496267, 496269-496272, 496275-
496276, 496278-496280, 496282, 496284-496285, 496287-

496291, 496294-496299, 496301, 496303, 496305-496307, 496310, 496312, 496314-496318, 496320-496322, 496324, 496329-496330, 496332, 496335-496337, 496340-496342, 496344-496345, 496348-496349, 496351-496360, 496363-496364, 496366-496369, 496371, 496374, 496376-496378, 496380-496389, 496391-496395, 496397-496401, 496404, 496406-496407, 496409-496414, 496416-496420, 496422-496425, 496427-496431, 496433, 496437, 496441, 496443-496461, 496463-496464, 496466-496467, 496469-496471, 496473-496476, 496478-496479, 496482, 496484-496486, 496488-496489, 496491, 496493-496494, 496497-496498, 496501-496502, 496504-496506, 496508-496515, 496517, 496519-496522, 496525-496526, 496528, 496531-496535, 496537, 496540-496541, 496543, 496545-496552, 496554-496556, 496558-496564, 496568-496572, 496575, 496578-496585, 496587, 496590-496591, 496594-496596, 496598-496601, 496607-496609, 496612-496615, 496618-496621, 496623, 496625, 496627-496628, 496631-496632, 496636-496645, 496648-496651, 496653-496654, 496657, 496660, 496662-496665, 496667, 496669-496672, 496677-496682, 496684-496695, 496697-496698, 496702-496703, 496705, 496710-496713, 496715-496720, 496722, 496724-496728, 496731, 496733-496739, 496741, 496745, 496747-496750, 496753-496763, 496765-496766, 496769-496773, 496775, 496778, 496780, 496784-496787, 496791-496792, 496794-496795, 496797, 496799-496800, 496803-496811, 496814-496815, 496817-496822, 496825, 496828, 496830-496833, 496835, 496839-496841, 496845, 496848-496849, 496851-496854, 496858, 496860-496863, 496865-496868, 496870, 496872, 496874-496875, 496879-496885, 496887, 496890, 496892-496896, 496898-496900, 496902-496911, 496913-496914, 496916-496917, 496919-496921, 496923-496930, 496932, 496935, 496938, 496940-496941, 496943-496944, 496946-496948, 496953-496955, 496957-496958, 496960, 496962-496968, 496973, 496975-496979, 496981-496986, 496989-496993, 496995-496997, 496999-497002, 497005-497010, 497012, 497015-497023, 497025-497028, 497030-497032, 497034-497037, 497039-497042, 497046-497051, 497054-497060, 497062, 497066-497067, 497069-497071, 497073-497076, 497080-497090, 497092, 497094-497097, 497099, 497101, 497105, 497107, 497109, 497113-497115, 497117, 497120-497121, 497123, 497125-497126, 497128, 497130, 497133-497140, 497142-497146, 497148-497162, 497164-497167, 497171-497181, 497184, 497187-497189, 497193-497195, 497197-497201, 497204-497208, 497211, 497217-497218, 497221-497225, 497228-497231, 497233-497235, 497240, 497247-497252, 497254, 497256-497263, 497266, 497268-497271, 497276, 497279, 497283-497289, 497292-497293, 497295, 497298, 497300-497301, 497303-497306, 497308-497310, 497313, 497315-497320, 497323-497324, 497327, 497329-497333, 497339, 497341-497343, 497345-497362, 497364-497372, 497374, 497378-497384, 497386-497389, 497392, 497394, 497396-497401, 497403-497404, 497408, 497410-497412, 497418, 497424, 497426-497430, 497432, 497434, 497436-497437, 497439, 497441, 497449, 497451-497459, 497461-497462, 497467-497468, 497472-497476, 497478-497479, 497481-497484, 497489, 497493-497496, 497498-497505, 497507-497512, 497514-497533, 497535-497554, 497556-497562, 497564-497565, 497568, 497570, 497572-497579, 497581, 497583-497588, 497591, 497593-497594, 497596-497603, 497609-497614, 497616-497618, 497622-497624, 497626, 497629-497630, 497632, 497636-497637, 497639-497640, 497644-497645, 497649-497653, 497656-497657, 497661-497664, 497668, 497671-497673, 497675-497679, 497681, 497684-497685, 497689, 497691, 497693-497696, 497698-497699, 497701-497709, 497711-497712, 497714-497727

The foregoing written specification is considered to be sufficient to enable one skilled in the art to practice the invention. The present invention is not to be limited in scope by examples provided, since the examples are intended as a single illustration of one aspect of the invention and other functionally equivalent embodiments are within the scope of the invention. Various modifications of the invention in addition to those shown and described herein will become apparent to those skilled in the art from the foregoing description and fall within the scope of the appended claims. The advantages and objects of the invention are not necessarily encompassed by each embodiment of the invention.

SEQUENCE LISTING (497809 sequences)

SEQ ID NO: 1 - DNA, 585298 bp, Homo sapiens
gaaatctccaaaggaaggagtaatattccttcaataagagtggaaagatgttgggcacagcaagacaacaggtgccttttaggattcctactcaaccactaaggctcaactcaggtgtcacttcttggtactgcccattcctgtcctttctattgggttatgtgtccctctcctggctcatgttacattttggctgtactggtgtaccctattaatttataattgtctatctatgtgttggtctttctcacgagacagtgagctctttgaaggtaaccactgtggcctatcccatttgcatatcctgctttgcagcagataatggaagttccaggaatgttttcaataaagaatgaatgaagacaatcacaaaatggcagccaatcctcttgagttaagagaaaggggaaaggaacataataaaagtaaaaagtaccagatttggtggtaaatgctttatgttaactaactcatttgattctcacaacacttgcagaaggtattactctttctactttacaggtaggaagctaaaggttaagttccacaagcttacatggctaatagccttcaatatcataatgagtacttaggtaactaaaatctagaccagttctctttcggctacgctcgctttcttcccccaccttctcccctcttcttctggttaacaatgaactcatgtaacatagggatcttctcttttcacttctcagtaatttggacactttcccccaatagattgttttattttacctaaaggtattccctgatcagctttgtatctttcatttgcttctttgtaaaatcagagggttggccgggggcagtggctcacgcctgtaataccagcactttgggaggctgaggcgggcggatcacgaggtcaggagatcgagaccatcctggctaacaaggtgaaaccccatctctattaaaaatacaaaaaattagccgggcatggtggtgggcgcctgtagtcccagctactcgggaggctgaggcaggagaatggtgtgaacccgggaggcagagcttgaagtgagccgagaccacgccactgcactccagcctgggagacagagcgagactctgcctcaaaaaaaaaaaaaaaaaaaaaaaaaaaaaaaaattcagagggttgatggaaagactctgtaaaatctttttcagcaacaacattataaaattatacaaattaaattaagccaagaaaaatttataagtaggataaactcagcgtagactgtgttttgttcagttttccccgaaggtggtgctctgggtttcccatcctccaccctctctgcgtctcttccttctctttttggcgcttcctttattctcccattttgatcaatcagttgctcttctctgcccaacaacttagtgcttttattttgcccttagcttctttggattccacatttcagctcctgtattctcaatattcctgtcctccttgtcctctcatcattaaactttctcttcagagcctcatttcctcagaactgggccatgcttcctaccacctgtgcaggttaaattgccaggaatagtcctagggttttaccaattgtaggtaacctccagggtggtccgaatcgaatgaaacacttgaattcaaagagataaagctaatcacgggtatttcataattatgattgattcagtatggatttttttttggtagggcaatttcttgacccctccaatcatccaaagtggcctatttaaggccagcaccccagggcacaggggctcaaagtgtggctcctcagctattctgatctaaagctaaggcatgttaaacctgcagcttcctgggccccaccaggcctagtcaatcagaatttctggggaatggcaatcaatctgaatttaaaatatattctctgggtaattcttgagtgcattaagttgtaaggaactcagcctttgtactatttattttctaaaagtttcatgtgctattattttttgtttcttcaattctattacaaaaatttatatgataaaattttatcaactcgcacacatactagacgtttgactgaagaatttaccaacaatactcagcaaaaatccagtatctattacacacaagctccagatttatactttttttacctgaaaaatataagaaaggctaaattccctaaactttcctcctctcttaaatgcttgtatgtggggctttaattatagtcaataccaaaggtaaagctaaaggagtgtcttgtttttttatacattgtgtattttcccctgtttctactgtttaaagaaaaactgcatttatatagtcttgcacaaagtttagtagcaaatgttttccttttggttcttatattaggatgcagttccctgtatgggaataatatttatgtgaatcatgtctatatacactatacacacatatacatatatctttatatatgaatctatatatacactactcatatcataattttctcctttgtcaaaggctttctatcctgcagtgacactaactccattttccttaattttcacagttctgtggtgacagcagggcaattctgactttgggttaccagtagacccagggccacattcctattattctctccagatgttctacagcgatctgatctttgggatgagcagacaaaaccccactgagcatccttgttgcaggcccattaccttagaggcctgtctccaccgtgcctcacctagattctctggatataaaggaagatcacactgtgctttatggaaatatagccctctgtggtcaagatcgcccaccaaatgtggtttccctaccaaataaagaaagtgttgggggacaggaccagcacaggaccagcttgagatctcttgatcgttccatcaacaagaattccgccctccctccctcccttcctcttccttccctccctccctcctttatttctctctttctctctttctttctttctgacagtcttgctctgtcacccaggctggagtgtagtagcgccatcttggctcactgcaacgtctgccccggggtttaagcgattctcatgcctcagcctcctgagtagctgggattataggcatgtgccaccacgcccagctaatttttgtatttttagtagagacagagtttctccatgttggccaggctgatctcgaactcctgacctcagatgatccacctgtctcgacctcccaaagtgctgggatcacaggtgtgagccactgcacccagtcaacaagaatttctttagcctcttttgctcattacctacaaagagcatcagtctctgcctggagagaagggctagaaacagatagggcacaggtccccaggtaactggctgtaagccactatggctgatatgcggggcaggtcactcctgcacagaaggtggcttgttggcctcctgttccatctcttacaggcgttgaggaagctcgactaaacatctcctcacagcttacaatcccagaaatcataggaccctaaacgtgcgtttttcaaaatttttgagctaaaatgatgtattactttgtaaattgtgaaaagtgtcacaaatattaatttaagtgacaacatcatcaaacactccaatgtggccttattatctattttgaaggagaaaatctgagtttcatcaactcaaccaggatacagtgagtgataagcaacttttggtgtctgcaaaatgatcagttaaaaaaaacctgggggctgggcacggtggctcatgcctgtaatcccagcactttgggaggccccgtctctactaaaaatacaaaaaattagcagggcgtggtggtgggcgcctgtagtcccagctactagggaggctgaggcaggagaatggcgtgaacccaggaggcggagcttgcagtgagcgagatcgcgccactgcactgcagcctgggcaactgagagagacactgtcaaaaaaaaaaaaaaaagaaagaaagaaagaaagaaaaaatcctggagtccctctatgtgaccatactcagctagcacttgatctgttcttttcttatggcatttatctcccggatcttgtatatacttacttgtttacatgtcttatctcacctactacattccaagttctttaagggtaagatcactatcagatttatctttgctttacccacagaaccagcaaacctgacagccctaaactgatgcttgttaaatgaatgaatgaagtgaatgaataaaatcatacccatttcaagttaatcctttggattttatttggcttatacgtagaaaatcatcaaaaggaaggaaactgtcctagaaaccttacaaggaagagtctcttttgggaatctcctacctgccccctccctggagcacttagggatggatgggggaaactttcactataacaaaaggcgagtaaactctttctgaaaattagtttaaggcccctagtggtttaatctttactgccgcgtaaattaactcaaatattaagccagcaataaaccggcgctccagtatcaaccatccttttctctgttaatacgaactaggaactcaggttgctgttttctttcccctcccacgtgtgctgatcgtgtaaaagaatcacaggaacacacgagcaatgaaatgtgtaaataagaaaaatgcacacacatcacgagctcatttcttcccagatattttttggtcaacctctcaagcttggaacaggctctataacagatgtgcgtttgtgtgtgcatattggaaaacagaaaaataaggtcagcgcaaacactacttgtaatacaaactaatgtaagagaaaacttctttttcaatattaacaacgacactagagaaataatgtaaaataaatatacggttggaactaggggtaaaaaaaaaatcagcaacgtcagcaaactgagatggggtgagttggaaggcagattggaatttatctcttaaaaaaatatcaccctaactagagacctgttttgcctaaggggacgtgactcacattttcggataatctgaataaggggaattgtgtctgctcgaggcatccattctggttcggtctccggactcccggctcccggcacgcacggttcactctggagcgcgcgccccaggccagccaagcgccgagccgggctgctgcgggctgggagggcgcgcagggccggcgctgattgacggggcgcgcagtcaggtgacttggggcgccaagttcccgacgcggtggccgcggtgaccgccgaggcccggcagacgctgacccgggaacgtagtggggctgatcttccggaacaaagttgctgggccggcggcggcggggcgagagcgccgagggggagccggagcgctgcagaggcgcgggccggagggctggcgctgatctgcacccttctcatctggagagcggacccctggctgcccggaggcgagccccttcccggggggtgggggcggcaacgcgcgacccagcggtcctgcgccccaccctccctcctccgcctccagcgctcggctccaacaaaggggcaggcccgcagcggggaggaggaggaggagccgccgaaggagcgagcctctctcgcgcacaaagttgtggagtcgtttttcctcggagcagggaagcgggcagcagcagccggccgcgggctttctcccgccgaggggcgaggaggagcctctggctccagaagccgattggggaatcacggggagcggcgccccccttcttttgggtcatttctgcaaacggaaaactctgtagcgtttggcaaagttggtgcctgcgcgccccttccaggtttgcgctttgactgttttgtttttggcggaactaccaggcaggaagattgcacaagtaaggggcgttttcagtcgggtgtcaatttctctttctttctttctttttttaaaatttcggttcgtgtctgcttctccaagctttatttttttttttaaatacatcgcaccaccaaactaacactcgcacacacccccgcggttactccgtgtcaaactcctagaggagcccttggccagctcggggtgcggcggtggcgaccggcaggcgaggaggcccgcgggcagcaggtaagcccatgcattattgaagcctcgggctggtaatgtgactacagcccccgagggaatggggcgggggccgggaggaggatggctctttctgtggttcttccgcctgggatcggcgtcccgagctgcttcccaagtcccagagtcgaagatgggagtaacttttgcgtgccctttcctcggggcctcagtttagctccccgcggtgcgagagagaatgccggaggcgtggagagctcgggcgtggaggtccttgggatccgtactagttgtgaacgatccaaacttatctgaccagctctgtgctgcctccctgctcccctaatcttcctccccgccggggtgacagagtcgccctccgtgcatcgcgcggtgcagggcgctgggccagtgatttgcaagaggggacgtggcctcttaggagagtctgtcacagacacccgggcccggggaaggcggggctccggcggtgtccacaggagagggtgggcagagggtggctgtgtggtcggcggccagcggagcgcttcccagccagccgcccggcggggaacgtgcttgacctctgggtggttgctgctcccaagggtggggctccggagagtgtggcgcgatcgccaagctccctggcagcggccctggagagactgaggggacaggaggaggggggcgccccattggtgtgtagtcccgcgcagtcgccggctctccttttccggactctggggatctcttgctgcaactgacaaggtaattcatgccccgctttggcccggggtccgaggctgtggttgctcaaggccacttaaaaaccaacaaagcaccaattgaaggctgtgcaactttcagatggcaggttgttcaaaggattttttcctccaagcctcagattatgaaagggactcattccagtgcgtttttcgaggaggagggagaaaacgttgcccgacctccgagagagctgtgggaccagcactttattttacaaggaactgcagagctcgggttctaactccacggccccgctctctgaggtgttcaggacagggcctcctctttcccagccttcaggtcagccggatcaccagggccttgcgggccagttccccctgccgcggttgggagggtcagtgcagcggtcgccgcggccagagcgcgcggagctcgggggaggccggattccctaggtctgagccgaccctcccggccgcccggccgggcggcagcgaccgcatccattcctttgtaagttgcaccggcctcaggaagtcgatctgggccctcccggttcgttggcggtgggcgtgggagacgcagcctgcggatagctcagggtcaggggagaggtggaggaatgcgaagcttgtgggtagttctgcggtgacggacagggttggcgtggaaccattccccgccccttttaccagcctttatgggaccgatgagacaactctttaactctcctttgggtgtttacctaaaatttattggctctgtaaacagtattaatcacagtagtattaaccttccctggagcgcttccgagtgtaaatggcagttcttggcactcaccgttttcttttactgtgtttcaagcagagcagcaaactcttgtccgcttggcttccttttctactatctcaatcgttcctaggttttggttcctatagtaaattaatgaatagtgtttgcattacacagcatttccatcataatgcacactgttggatatatatgtgctatatacataaaatatagtacaaaataaaaattatatacatatattcattgtataattcctaaaatcttaaaaaattgaaacattagttttgtctttaaggctgtcaccttatgtttattttttaaacaccttatgtttatttcatacactcttgcttggtggtccatatgacagccggaagcgttctgaagggagagttagtgaatatcgacttgactggattggtttcagtaagaacatctggcttttacagaatatcatttgagggaagggaaatctagggcagaggtaacaataaattgcatttgtatagggcttgaagcttctaaagcaacatctcattcattgattctcagtttctcacctagccttctgtgaagatggtgttccctccattttataggtgtggaagacggagggtcacactgggatgcattgttcgtggtgaaactttgattctgtctcctgagaaccaaagattctgcatttggcaattagaaggagtcatcctttgccttaagtgtactcaaattcctctggccattaatggcaagtaacctcagtggctatcactatttaaatagccttctgttattcttctttctccccattttcctctgtactctgatcaccttttctgctgtatctttgcaacctgtaagggattttcattatcaagaagagaaaaatttgaaaaatcaccttgaggagagtggcaagtgaaacattatagtgaagaagtgttactgataatgggcaaatggaataaagtagtgtgtaaacagttgacttttctcttttatgggtgaataaaggctttgggtagcatagaagtggagatcttggctaagaccaatagtgaagaaaagcattagacttactgctccaaagtgatacactgtagttctttccaggaaagagaatttttccctgggcaaacttaattttccatgataaacttttatagacattcttctgaacaaagtttttgattcttgaatataataaaatacacttaagaatttagcaaatcctttatagttatgtacttgaatgaaagaatgtaatcatataataatccataaatttttagcagtagtagagcctataaaaaatgaaaaaagttttttagactctcataaaatctgtcagattgatgatccaatcctttatatccaactctctctctctctcttttttttttttttttttttgagatggagtctcacccactcggtcgtcaaggctggagtgcagtggcagcgatcttggcccactgcaacctttacctcctgagttcaatcaattcccctgcctcagcctcctgagtagctgggattacaggtgtttgccaccatgcctggctaatttttatatttttagtagagacagggtttcgccatgttggccaggctggtctcaaactcttgacctcaagtgttagccaggttggtcttgaactctggacctcaagtgatctgcctgcctcagcctcccaaagagctgggattacaggcatgagccaccatgctgggcccaactctctttttgtcatctccgcttatataactcagaggcatttcaagctctgcaaatccaaatcacattgatgattcctttctcccagcctgctatcctcagtgttgcccagctcaatgactcacacttcacctaattgcctaagccaaaattggggagtcattttgcacattttgcacattggatatgaatctctcatatccaatcaattcccaaatcctattgactttctttgatatctaaatatcccacatattcacccatttctttctatctactcttgtttagaccacacttgtttcctgcatataatattacaatagaaagaatagcacaataaacacccagatgtcctttttattttattttattttattatttaaaatttttatttacatggagtagagacaaggtctcaccatgttgcctaggctgatctcaaacttctgggctcaagtaatcctctcgcttaagcttcccaaagtactgggattacaggtgtgagccacctcgcctagacccagatgccctttaacaagttttcccacttactttattttttttgagatggaattttgcccttgtcacccaggctggagagtaatagcacaatttcggctcactgtaaccaccgcctcctggattcaagtgattctcctgcctcagcctcccaagtagctgggattacaggcacctgccaccacacccagctaatttttgtatttttttttaagtagagatggggtttcaccatgttggccaggctggtctcgaactcctgaactcaggtgatgcacctgccttggcttcccaaagtgctgggattacaggcgtgagccaccttgcccggcctagttttcccacttattttacaatacttactgcatttttctgtctgtctgtgtgtatgcatatatacatctacatacatatatcaacctaaatatacctatatcagtatagacagatatatgctattctgtttgaacttaagttgaagataccatcacacttcattgctaaatatttcaccacatgtctcttacaatcaaagacattctcctgcaacaataccataattaatgttaaagaaatttaacattgatacaataatattgtctaatacatagtccaaattcagatttttcaaatgatcctcaaatgttttattttaaaattctgaattcaatcaaagattacatttcattgtcatgtctatttagtctcctttaattcacaaagctccccctctcccaggtaattttggttttcaagacgctgacagttttgaagaaaccaggccatttcttttgaaaactagccacagtctagatttgtctgctcatgagaagattcacgttcaacatcttggcaaggatattgtgtagatgatgtggtgattttccattcaattgcatgatgccccatgattggttatgtgaattttgatcacttggttaagattaggaatttttccccaacatattactatgaaaaaattctcagacatacagaagagttgcaagaaattttcattcagcattcatatacccatgagctaggttccttaatttgcattttgctatattctgccatagtcttcactggttccccacatattactgtggtctacctacaagccacaatcgtctttttttttttttttttttttttttttttgagatggagtctcactctcgttgcccagggtggagtgcagtggcgtgatctcagctcactgcaacttccacctcccaggttcaagcaattctcctgcattagcctcctgagtagctgggattacaggtgcacaccaccatgcctggctaattttttttttttttttgtatttttagtagagacagggtttcactgtgctggccaggctggtctcgaactcctgacctcgtgatccacctgcctcggcctcccaaagtgctgggattacaggcatgagccaccgtgcccgtcccttgacgatcttttaaaaaggccaatttgaccatgttggttccctccttcgaaccatctactggctccccattgctcttcagataaagacacaaacccttgacctgttctccatggtcctatccctggtcctgcccagcttcttcacctggttcaacaggtacacttgtctcttggctgtcttctttccagaaacactggcttgtgctccattctttgactgctccatgattctttctgccacttcacataggaagctcttaccttttctctttctgtttccctttttggctaattaaattcttgtcatctttaaaggcttggctcaaatgtctcttcaagaaagccttctctaattgcccagggcaggtcagactcctctgctgtgtgctcttaatactctgtgcttctcctttgtatgatttgtagtctgtcagtattgtaatgaaataattcattatgtaattaattgcttagtgtgcataagcgccgtaatggcagaggctatgtctcttgttcatagtcataacaccattgcctggcttggtgctttacacgtggtaggcactcaataaatatttggtgaatgaatagttactacgaataactatataaaatatataaatacattttttcaagtcagtactttcccttttccttttaggtattgatgtcaagctgaaccatcgtaggaagttgaaagccttagaaagaggacttggtaaagtttttggattatcttgaaactctggcaagatggccaagtatggagaacatgaagccagtcctgacaatgggcagaacgaattcagtgatatcattaagtccagatctggtaggtaaaggaagctcaagaaagctatggatttttatgtatttagaaaacctatgtttcttggattgatttgcattgttcttgcaagaacttcttggaggtgaagttcttttaagaaactgaattctgacaaatgactataattttgtaaaaggtatatgtaaaaggtataatatctctgagtgtcctatcctttctcaacccaattttgtgcttagtgaaactgctgcttgtagctaaaggttgttcatttggaagactactccattaaaataaaatacgaccgaacatttctctttctattttctggaaattgaagggattatatgcttaatgtaggaagtgccacagtttctggcaggaaagatctttcacagtttgatttcattaccatatatcctcacccccatccctgttcatagccattgataggccaacaggtgtcctaccttgaaatatcttatgagccttctcaaggtaaaattttcacctaggtaatctaataaaccagactcagacagattcatggttttcacacgaacagttaaattggggtcctcaggataccaccccctcctccaatctttttatataaccgagtgctttttgactctggctgtacagatgaatcaactggggagttttaaaaaacgcagatgcattggctccattccagacccattgaataaaaatttctgtatttttaaaaagcttcaaatatgattctgagacaaactcaaaggggagatatttttgaacaggcagaacacttctcagccttgaaaattacacagaactccaccctgagtgtgaacactatacttaagtaactttgaaaagttactttgaggtataaaattacatccagtgtcactttaaagacaaaaaaggaacccaaagcctgtttttgctgtgtgaaccatctttatgttctgttaggagcttgtttcttattatgtgaaactgtagaaatacacagtgaaaataagatctaaattaactgtcttaaaatacacattttcctccatgataccggtgttggttgattgataaagattttagttattacagatttggctgtaaatatgtagcaactattgtgtagcttgacgggtcttttgaaggtatagcttaatatcttgttttaaaatatgctttgaggatgttctcttcctgtaaaattctttttgttttaaatgttttagtggtataaggtactacaaaaatgtaagggattattaatatcatcttaggagtacggaatacatattcagacatatgtaaatataacagaggaaaatggaagagagacgatttaatgtctccatactagtcattttctataaattgtgaggaggtatattcctaaatagttttctgagtcagccttcattctagtaagacctttgatatttataacttgtactttagccgtgtccataaaagagtaattatctaatttcagaaataccgtgtatatataatgaacatataaactcccaaactattttaatttaaaattatcttttaaaaaggctgatgaacctaaaatattgctggagaacaatttggcaaaaatgataacatgtttttaacacatgcatatcaattaactgagtaattctgtttctagagtttttccctaggcaatacataaaaaggtacactcaagaaattgatcacagtatcatttataatagaaaacattgtaaacaccatgaaaatctaatattaggaattggttagatcattatttcccaaagtatttcgaaaagatcaaaagttctaggattgttaatgtgtaattcacaaaaggatgttatggtcaaatagctttaggaaatagttgtttaaacctattattctgtttctttactctagcacatctgaacagatcatacatgatctcagtagaggtaactaaattagggtatatccataaagtagaagattaagcattcataaaaagtgatacagatgtgtgtgatgtgtgtgtgtgtgtgtgtgtgtatgaatatagaaatgtgttcttgatatagtaagtaaacaagtatgtattatatgaagtcatttatatgaaaaatgttttttaaaaatttagtgaagtatacaataaatgttaatagtggtcatcttggcatttgagattattacttttttttttgctgatttatattttctaaagttcttcaatgaacccacattactgagttcttatatttttaaagattatcaaattgcttagagtgtttagatgccaaggttatgactattactttttttgtggtggcatctacttcaaaacacactgaaaatttagttgttacatagctcagatatgaatcacattcttttggctgaattatgttgcaaaagccagtagataaatttggatttgaatggacccattagtcccaatctggcttcctctaagggactttttttgattcttttaaggcaaatgcttactatacagaggtaatatttcatggtactctaaaacttacatattttaagagatttttagtttagattaagtcataggaattgtctacatatcatatatgtattttaaagatcctctgtctacatgctgtatgccaaattggttgcttttccattttttaaaagggaatactttcctttaggaaaattttgatcctcatctgctcttccaggtttcttttttggggggaaattggatgaaagtggggggacggagagtgtggtttctgctctccaaatcctcgagtttggacaatccaaaaggctggcataattaaattggcataataaaaatgtctatgcattttatgttaagttattgtgattatttttattgtcctcacttagtattactttgtttcatgccattttgaatattataattttttaaattttataattttaaagccatttctaccatctaaacagaaataggaagttgtcaagggtacgtaatgaagtagtttcataaatacaaagccatgtatttatttatggttgtagtatacttgccttgggtttgggtgagtgttagaaaggaactggaaagaatttgatctataatgaccaaggatttggtgttgggtaaaagtagacctgtctttctctaacttaaaagcacatatgccaagttcatcatcaagtactgtattattaacagccttaattagtaggctttagaaagttcaacaagttagtaaatattttgaaacaataggccaagactaagaatttttaaaaagtgaaatttattgccagtagagtgtgtgatgcagaaagtactgcttggaacattttaaacatgaaataataaaatggtttgggatgcatatacaatcgaagaatatcctcactgctatttcattcaataattaacatacattaaagctagtaacacagaataagtcatccttttctgttgctgtcagtgttgttgtggttttatcccagagccctgtagaaagagtagacctcagggctaaggacagtgtgtcagctggctccatgtggagttcttgacagtttgggattatagactctcagctgggaaagaactgtttgatgaatgaaatagttgggcaagcttcacatttttggataattcaatgtgttcttcaagcgaccttgggctggaagcctgtgtgtaacaattttatcatttcttcctttgcattttctcttcttgtctaatcttaggatctaattgttgagggaaccttaaacgccctataacccagccattcctgtgatgtgctcacccagtctctgtttgcacacctccaatgatggcatctcactgctgctgctgatgatgacgattctagcaacttacactaattgaacacattctgtgtgcagatgtggtgctaacagtttaatcctcacaaccgccattttgcagatgataaatgtgagccatactgaagtgatttgtggcactggacttctttctatttctccaaaggcccagtgtgtcttcctcagggcctttgcacatctctcttcttccatctttgcctggctggttccttcttgtcatttagatgtaggcctaatgtcacctcttcagagatcttccttgctgactttagaaagtagctctcccagtcactcttgactgcatctctgtatttacgttccctgtgttgttcttagcactctctggtaccttttctggtactgtgtgttcattaatagccttcccactagaacagggctccccaactcccagggcctggactggtaccagtccgttgcctgttagggaccaggtggcacagcaggaggtgagtggtggctgagcaagcactaccgcctgagctctgcctcctgtcagatcagcggcagcattagattctcataggagtgagactctatggtgaaccgcacatgcgagggatctaggttgcctgctccttatgagaatctaatgcctgatgatctgaggtagaacagtttcatcccaaaaccatccccctcatcccttggaaaaattgtctgccatgaaactggtccctggtgccaaaaaggctggggactgctgcactttaattaactccccaagagcagggaccaatacatccctggtactgagcccaatgcctggctcataataggtgagcaataaatgtttattcaatgataaaggctacagagtctggaagtgccagagctggcatttgaactcagatgatctgactctagaaaccctgcatttgacctctatggagtgcccagtctcctaactcacaagacattttattccattgctgctcggtgactcttcttcattttgtgcctaattctgtcccttacacattttgcactgtattaattgtatttatacagctcttctatctctttttttgtagttttcaggggtgggaccctggactgtgaggtagagctcctctggaccccaggttagtatctcagagccctgacaagggaaggccaattgtaagagacacagcctactgcttctgggccagttgcatcctttcttgatttttggctctagtctctgtcattctctgttgagttagcaaaggggaaaataccagaggacaaacagtcctttgggtggaagatagagaaatggataatgtgtttctgacatgaattcctttttctcttttcttctgactactgctcaaggcttttaacgagctgaagttaaaaaaaaaaaaggtagtggatttcataaggactgacatttggcacagtgtaggtcctggtccgatgcccagataggtatctgtggtactgaaagagttggttgaggagtgtaggggaaggaagcaaagggttggttgaggagtgtaggggaaggaagcaaagagagaccagtgaaataaaaataaaacaaattattaaatatgaaatattataccaggttacatttatagcaagcctcctgaaaatctgctatgtttggaaagtaaacttgcttaacaagattcaattttatgaaaattctgaggaggattaccttatttgtttatctttctgaggcctttcttgaggaaagacagtggttaagttgtatttaggcagtcatcggtctatttctttcttttatgtttaaagcagtatctgtgaggggatttttctaaacagctcaagggactgtgaaaaaatagttcattttttgtttctcctgaagctttccttggctggaatacctgtgctttgaagggaggtctttgagcaggtttgtttttttccatgagccctggggatttgtagtgatagacagtaaccctgatggaaattcaactctggcagagaagggcagctattcttgtcctgcttgtaaagatattctccatgttgttacctcattatgctgaagtagtgcaatcatgagaaagtttttttgtattaatgtgattctcatgacctgttactatggttgtgaaacttttagaggagatccattcccgactggaaaacgtgaattgctgaggatgattctaagcaaaggaagtacgttaattatatagacagaacagagaactcaattttattgaaccttatttgtacccagaagtttgaactagatgctgatatgatgatttttctgggaacaagtcaacatgcaagactatttgagcagctgtaaatattagttaaaatttaatctaaagcaatggagaaagggtactctgctgaagtggtttcagatgcattggctggatttttttttctccccttaaattgtgtggaggcatagacatttactatgttatatttttatctttttatatgccttaactgtttaataataaatagacttatttcaatatttgaaatgtgaggcagtatgagttcttaatgtatacttactctcgagatgatggctcttggactgagaaattgaaaccaggtcccagtcctttcgcttttacttcctgtgacactggatttgcacatgtcaattccaggaagcaggtagtttccagcatccatgtggttttccaatctttgcatttgtgcctttaaacaaccaaatacctgacgtttattaatatcctgtggggctcttctatcagaagcacattctcttggcccggttcataagggaaatgtctgtgtatgcgcatctggcagctaagattaaggtttacagtggtataacctcaccttcacttttaagaaattaagtttaaaaaaaatgcagatctgtctttcatagcagtggagctcaacaacacatagagcatgagagtcacattttttgtgtgaatattttcgaatgagccttttttggtatgtggacgggtggctagttacattcagttcaatccttttaacatttaattatggaacaaaatcttttttcaaagtgtagagaaaagcatataagggcatttctgatgtagcagaggaatccaataaaaaatatgactttgtgtctctaaagtggtacagctttgaaattaacacatctgtataatttcaaaagtatgatctctttagatctttttctttaatttcatagtcttaatttttgcaaatttcttcaactccattctctaattaagattttggtatacaatatttatatgcaaaagatttttggtgcaggaaataacattttgaggttgatactaattgatttgttcacttgcccctcaaaggctacgtgtgagtcatgttatttaacattgatccagtcaatatgtagatttatgcacatgcttttattttgaaaactaggttttgagcttctcacatatggagttcctaattcaagctttatgtcagaaccacccttctgggtccagactcagatatgtggggtggggtcccagcatctggagttttaacaagttctgtgggctattctctttagtgctcttaatttatagacaaggaaggcaggtttaaaagtcatagaaccaaagtgaaaatgatctgcattttagaggagcaaggaaagctacaacgtttattatttctacttataaacacttccctttaaataatttgaaaagataatagatttcatgatgttgggcattttttcttttacactgtattttgaagagtttgggttgtgttgggtgaagttaaaagtgaggaaagtgggtcaggagagtgatgaaacctggtgcatttcttattttggcccattgaaccagaagatgataccaatatatctagtgccgacatatttctccactgcgctccttagttattgctgcagtgtgttcaaggtcttcttgctgtgagtgtaacatcacatcttgaactctttttctagggaatgcatcagcttagagtccgctgatgcattcattataaaaatgtattgtgtatattttctattacattatttcaaagacagacgtgtttttgaatcatggtgggaaaaaaactcctcacattcaacctctatgctagttttcttatcttaagggggggtggttagagaaatgtattatatatgtattaatatttgcctccctgttttttaattctaaataggtgacatatttaatataactatgcttgcttttgaaataatttgcctaccattctttaaaatgagtgaattttaaaagatgtatagtgatttttatgtgaagatgaattaaagagttaagtgacatagaccaccgtagcattttccctatggatctgtaaaaacagcccaaaagtcttgtgatttttttttttttttgagccgtagtcttcctcttgctctgttgcccaggctggagtgcagtggtgccatctcagctcactgcaacctctgcctcctaggatcaagtgattctcccacctcagcttcatgagtagctgggactacaggtgtgtgccaccatgcctggctaatttttgtatttttggtagagatggggtttcaccatgtcagccaggctggtctcgaacttctgacctcaagtgatctacccacctcagcctctcaaagtgctggaaatacaggcatgagccatggttcccggcctcttgtgatatccttatattcagttaaccaaaccaaatcaagtcaaataacaaaccccaaaccttttatagaccttgagttatttgcagatctttggggttatttacctgtcttttgagctttaatcttttacctctttgaagatacaggaagggatctttatttcttctttgataaaataaccttcagagtgacttgagatacggaattgcttctttgtatatcattgtgtggtatttgagatcacatctcaaaatttaatgagacctgctcctcaggcagttttaagattaaggatcaaaaagggagccactggaaaggtgtgagtggctggtaatctatgttagaacagagactttggtgcagaggttggccatgttcatatgtggagtaagttttcatgaaacaggaggaagccttttcttatttgaaactaagaaactgcaaaataaaagtaataaaataccccgaagcaaatagactttaaaacaacatttggtcctaagttgtatatgaccaatttcttaaagtgattgttatattgccagttttgaaattatattatcttttaaaatttaaaatgtaaatattgtctcaggggtgggaggatgaatctccatcttatttagtgttaaaggctcctggacttaccctaaagcccagctttttcggtggggggctcataaataaaactgtgtgtgttctagtttactctgttacctcatctagttcctttaggtgattagaaaatgccgtattagcaaatataaaaaggtttacttttgtgtttttacatgtgaaatcaatggccagttctataatgttaacatatcagacccttaattatatattaactcccattttgatagtttgtatagaaaaatcagagttgacttgaattatttgaacttgcatacgctttttcaagatacgtaacgtgttgtaaattagaagagtgttggtgttttcggaacacatgcatatgcttgctgtctcagggcagccttgttgggcatttggtgtcagacataccttattctgagggccttggcatcaaggcagattgctcagagagggggtctctctgcatatatgtctaagggagacatttagggaagtctcatgccatcctatctttctttctttctttttttttttttttttttttttttgagacagggtcttgctccattgcccaggctggagtgcagtgactcaatttcagccctccgcctcccaggttcaagtgattcttctgcctcagcctcccaagtagctgggattacaggtgcctgccaccatgcttggctactttttgtatttttagtagaagtggagtttcaccacgttgccgaggctggtcctgagctcctaacctcaagtgaaccgcctgccttggcctcccaaaatactggattacaggcgtgagacactgctcatggccaccatcctactttctaacagcactgccccaccctccccctcgccccaaaaaccaccatgaaggaggcagagggcaccaggtgaagactgcccatggtccttttcttacctctgtgacttcgcttgttttgtgttctgggcttgattgttctccttctccctgcgtccccagttttgcaacctccatctttaaaacatcagcatcagtgccaccaggtgttctgctctctgtgctatctgcatgccagaatcaatctttcccacgtgttcactcttcatttctgtttgtggcccttctggcttgtgtatgtctatatgccttttttcatctgactttctgatgctagcctttagcttagtctccacacacacagtaagtgcttaacaaagacttgtggccgtgtgcagtggctcatgcctgtaatcccagcactttgggaggctaaggtgggtggatcatctgaggtcaggagttcgagaccagcctggccaacatgctgaaacctcgtctctactaaaaatacaaaaatcagccaggcgtggtggcactcacctgtaatcccagctacttgggaggctgaggcaggagaatcgcttgaactgggaggcagaggttgtagtgagacgagattgtgccaatgcactccagcctgggcaacagagtgagactctgtctcaaaaaaaaagacttgctatgccttttaatggttttaaaaattacacttgcttacatacatacctcattcattcagcaaatggttattgttcattcattgttagatgctgggctcagagataagcaagacccacctctgttcttaagatgctctcaggctagttggaaagaaagacatcaataaacatccccacacaaaccagggacacatggagggaggaaggatgtcttgctttggttggaatgagggtaggtttgagtaagagagcgtgaaagaggcaaggaatttgaggtgtgccttgaaggatgtgtaagaggcaacgctgtggacagtgtgggaagaacattgcagatgatgagaaaagagcaaggcatttgaagtctgtccctggtaactgagtgtggctggggtaatggggatgatgggagaagctggggtcagatttcgaaagcccttttgaagcagggtttatttgatctttccctgtaagaagccactacaggattttaggtgagttaatgactagctcagaactgtttttcagaaagataacttggctggcagcaggaaagatagatttggaaggtagcagagttagggggaggcagggaacaggtaagagttgtgaaaaaattgaggttaaggagtataaggacttggaccagagtggtacaagaggagactgagcaggggaaaggatgtgaaaagtggttagcagttagtaacagggtgtgcaaagcctcaatgtaaacttcgcctttgtgggatttgttagttagtaacagtatgtttaaagcctctaggtaaatttcacctttgtgggactttttagtaacagtatctataaagccgcaatgtaaacttcaccttggtgggatttgctttatgttttcaatgaggtatgtagtttttcaaatcgtactgtaattcagattttcaacactttcggttattagctttttctctagaattttcttgatcaatttcttaaccgtttacagttacttctacttcttactgaagttgactactgctgtttttctcacagtacctcttggtcagtttatatggggaacttcaaattcagttcagctgcaataggatctgtatttttttctatatatattctgagagaagggtcatgctttaggaaaaagttgatgaaaatgagaaaagagatggtttattcatgtctatgcagtatactattaacagttctttgaaaaagtagcaaagaaaggtaatgttaatctcatcttaaatgaaggtaaaactcttgcacagctaagagaaaatctatatactaaaagagtttggaaaactacttcagaggaactttaattaaagagtagtctaatgtgatgctgtgaagataatgccatcctctattagtaatttcagcttcaacaaataggatagaataaatgcaaattaaaaataaattaggagcagatgttgagaaatatcttacatttagggaattcttaagtggtagaagggccctggagttcagttaataaagctgggatgctcagaaattataataattcaggtaacaaatgctttccttaatgtgatgctctgctgtggaggttttgggaatagaagaaagaagaggctgttattgtcatactgtttgtaagttcatctttctttacattcagtggataactaaaatctactatatatgctgatatttcagaaatggtggttcccttaaccttcaagaaaaaacaaaagctctcatttgtaaacacttgcaagcattcttgggttgtctcttggtggtacccaagtttttgctttggccggtaagagacttttgcatagtactttgttgccttgcctctacaacatgttaggcttgtggattggcgcatggtgaataagacacagttccagttgtcgactgtctgtcacctagagagggcaggtacacaggaatttaagaaaacagattaaacaggcagttacacagttgtaaaagtaaaaacagcacagattgctgtgtgagctcacgggagtggtacctgacatcccagggcttcaaggaaggcatcttggaagagtggatatctaagctgagatctgaaagaatgagtggggatgtggggaggctgttaagacagagggagttgatgacaagaggtttggaggtgagaattgtgaggttttcaatatggctaaagcaggatgctggagaatgaagctgagaagagtgttataagccatctttaggagtttgagttgtatcctaagcataatggtgaatctttgaaagggctttaaaattaaaaaaatttatatttatatatttatcatttttaaaattctgaagtattcaatctaaaaaaatgtacaggaaatgatatatcagatatgctcgtgccctcatttgaaatttatcagctgttaatgttttgacttttttttttttttgaaatggagtttcactcttgttgcccaggctggagtgcaatggcgcgatctcggctcactacaatctccccttcctgggttcaaacaattcttgtgcctcagccacccgaatagctgagattacaggcatataccatcatgcccagctaattttttttgtatgttttgtagagacatggtttcaccatgttggccaggctggtaatgttttgacgtatttgatttaggttgtattttaaagagctaattatgtcagcatagataaatcttaaaaacaatttgactacaaacaaaaatcaggttgcacaatgtattgaatggtactgtatataaagctcatatacctgcagaaattgccctgcagtgtttatgtattcatattataaatatatagcaaaatacaaaaatttttatggaaattataaacactagatttctttagagatagtgagagaggaggttcttcagttttatctataatatttaattcctcaatgaaaatagaaatagaatcttaaattaatatgaaataatgctgatttgtgaactgagtgatgactgtcttaagcccagttccttggaagtaggatttgagacagagatttgtgtgcacttgagaacaattcctgttaatgaaagaaatgagggaagaaggactgggccagggaaaagctgaagtgtagttgagttacagcagggccaccattggatccatagggaatgctggtgctgggatggcccttcagagatttcccaacttgaggcaatgtgttgagcctggggacctttgccttgaccagtaggcttttggctgaccctgggaaggaggtgaggtgaaaatctgggcaaggtaacttggccaagggcagttcctggacggatgctcagctatgagccctcagctgctgggggaatgaatttgtgcattgccttgcctgaaaggcagatctggataggagattcactgcagtcatggaccttgtaccattttcttttgcctattattgtctatttctatgtctgaaagatatgacatattaaataaaaaaagcttccaatttctaggagcagtattcaccgaactacttccctgacacatacatacctcacaccctgcacacaccacacaccacaaaccgtagctgtaatatcaggttacatactttctgttttattttcccttttctctgtgtttttggttacttgagatggcctcctctctctcactcctggtttgggaaggccttgcttcctctgaaagcttgtgagcagagggctgatctgatcagatttgctcttctgagtggtgctctagaagccacgtggagcatggatggtgtggggtgtgtgctggatgaggcaagcctggggttctggaggacctttgggtggctgtcacagttagaggataagaggtattgaagccaaaactgagattgaggtagctgggaaggaggagaggggagagtttagaagctttaggtaggaggcagacctgataggacatggtggtggtcttcagatgatgggtggtggatgggatggagagagaagcctggtttttgactttaacactcgcaaatgaagcctttctttctaggttttgtggagagggcagtgcataaggggatagtaagtgaagttctagattgagttttgaggtgcctggagatatctgggaaaaatatgtaatatatatatttctcttacatgtatgagactggcttgggctggggtctgcccttgaaaactggcagctggagtcttgagtactttcctgagtcattttttgagctctttgcaagataatgttaaaaattcaagaggccgggtgtggtggatcatgcctggaatcccagcactttgaaaggccgaggcgggcggatcacctgaggtcaggagttcaagaccagcctggccaacatagtgaaaccctacctctactaaaaatacaaaaaaaaaaaaaattacctgggcatggggtcgcgcacctgtagtcccagctactcaggaggctaaggcatgggaataatttgaacctgggaggtggaggctgcggtgagtcaatatcacatcactgcactccagcctgggtggcagagtgtgactctgttgaaaaaaaaaaaaatcaagaactgttgcatattttatttatctttgtattttctgagatatttttgactgaccctaaaatgagcatctggatggtagatgacggcagcggaagatgaagaattaagaagtggtttttgatttgtaatattttttagtagatattattagttgatgccgcagttgttgactgtatttatctcccaagggcataggaagcccccttgcagatattactctacctagcctgactgggtgtttggggagggagagaagaggttaacaataaatcctgcaatatgtgcagaagtttttacacttgtgtttctgcatattttcttagaaaaagggtccacagttttcattatattctcaaaggagacctatgacttaatgaaaagttaagtcttgttagaggaagagtgacatattatagggttatgtcttcataatgtttctttttttctgaaattagattggcagtccaatacgctggcacgaactgagggtctcacacttttgctgtaactcaaattctggtccttactttacttctactgccttaaagccactcaaacaaaagacctgattgctagaattaggttgagaagacacaaagtttgaagggcaaaatttctgataatgtttgacccagttttgcatataatgtatttttatttgttgatgaatatttcccttttgttgctaaaagtggcaaataatcagacatagattactaattaacagtctgcctcagttttttttttttttaattaatgaaacttgggcttcatcaagctcaggtggaatggatatcacagtgctttattttttctgacatcaaaagaaatttctttgtcaaagtgtagacatgtttgttgtgactgccttttgtgtgggttcttttctcccagccctctcctactacaggagagagagataatggccctttgctcctcattccgcattcagaccagattccccagctgcaatctcctgccatcggattgcatcaccaactcaacctaattggtgagatgtcactccctccctccaccgctcactctcatttctcagtgagtttagctctgtcactctctctaaaagttactcttgttttagtgatttgggtgtaaacattgatgatccttctaatactctgtcctcttaatttctctaagttctctttctagtgatcttgtctcccagtgtggtgggtatattctggctagaccaggtcattgtttatggtggcagcccctctgtcatctgaatttaagcgtcccattttttcggtactagcatggctcactgcaacctccgcctcctgggctccagcaatcctcccaccctcgggtagctggggctataggcatgtgccaccacgcctggctaatttttgtatttttttttgtagataagaggtttcaccatgttgcccaggctggtctcaaactcctgggctcaagcaatccatccacctcagcctcccgaagtgttgggattacaggtgtgagccaccatgcccggctgactttgcctactcttgccctaagaaaattgaagcaaaccaaagaggaatccagaaacttcaataccacatctatcctcaaccagaacccacccaaggccaccctaaccgtgtacattgtacccatcctcctttacttactcaaagtcacctcccttctctcttctgcatccctatgatttcccctttagtggatccgcttacaaacatgctattgtttttcttctagcaaaactttactttgatcccacctgtctctgtagctaccacgccattcctctggtcccctttatgaaagagctcctcaaagattgtatgtaccaacatttgcagttcgtctcctttcattccctcttaagaccactcaaatcaggcagaccccctaccagtccagtaaaactgctcttgtcaaagttattagggacctccttgttgctaaatccagtagcctgttctcagtccttaccttattccacctctcaatagcatcaacactgctgatcactccctcctccatgactctttcttcatttggcttctaggacaccccacacgctcctggtttcccacccattatcttttgctgattcttcctcttaacgttggagggcccaggacccagtccttggacctcctctctgtccccactgttgccgtttgtcatctcaccagtatcctggtttaaatactatctgaatgctggctcaaatttctatctctagcccagacctcttcctctgaactgcatacttgcatttccagttgtttacttcacatcttctatgttcagatctgaaaatctgaactcctgatctcccgtaaaccccaaagctgatcccacagtcttgcttgtctcagataaaggcaatgtgattcttccaattgccccagttttggagtcatctttgtagtcctttctttctcgtatacccacatccaatgcagcagatcctgctggttctattttcctaatactgaatttatacagaatccggtcatattttacgatctccactgctactgtcctggtctaggggaccattgctttttctggaattgcctccttacttgtctctctgcttcctcccttggcccatggaggctggtctgaaccccacagtagagggatccttttcaaatcagaagtggatatgttgcttcaggtttccaagtctgcagtgactccccattccagttgtaataaacgcgaaagaccttacagtgatctacaggaccctgtttatcctgcctggcttcatctccccttactagtttgtgctcattatatgaggcaggcacctcccaggtcagggcctgagccctcttctagcagataaccttgtggctaactccctcctctcagagagctactgtgccagtcaattaaaatagcaaatccttccctcattagccctctccacccactttatcctgtttcattttttcccatagcacttactggattatgctgattgtctttttccactagaatgcaggtattttgtctaggttgaatcactagtatctagaacagtgcctgacacatagtatgtgctcaataaatacacgtgtgcagaagcaaatcacatttttcattgctttccacaagtgtgagcctgggctacatagtgaaaccccatctctacaaaagatataaaaattggtctgggtgcagtggctcatgcctgtaatcccagcactttgggaggctgaggcaggcggatcacctgaggttgggagttggagaccagcctggccaacatggagcaaccctgtctctacttaacatacaaaattaaccaggcatggtggctcatgcctgtaatcccagctactcagtaggctgaggcaggagaatcgcttgaacctgggaggcggaggttgcagtgagctgagatgagccattgcactccagcctgggtaacaagagtgaaactccgtctcaaaaaaaaaaaaaaaaaatggctgggcatggtagtgcatgcctgtggtcccagctacctgggaggccgaggtggggagacagggatcactgggcgtggcggggggtggggggcgtgcctgtaatcccaactactggggaggctgaggcacaagaatcgcttgaacccaggaggcagaggttgcattgagctgagatcgtgctactgcacgccagcctggataacagagcaagatgctgtctcaaacacaaacaaacaaacaaaaaacaaacaagtgtgcaatccctgagaaaaatatcagttcaatctttgttgatctttattgtcccgattgattagctgcatgtcagcctttgactgtgtttcccagatgctcacgacagatcgatcacttgatgttgttttcaacaggcagtcatgaaatgagcagactgaggtcagtgtagtatagatatttgtcagcgtggttgccaactgcctttcctcttctaagattgccctttattgtgtgattatattacatttttagttggcatgaaaatgcccatttagtgaaatgatgaggatcttcctgggggaagaattctggcgtaagaagctttcttcagattactaagcactctaaaaggtcccaggttatggggctctggaaagtaacgatgcgaatacttcacttggttatgtgatttttatttttgccttggaagtctttctgcaaacaagtcttccagtggaggctcattttaggaatgtgacgatgcattgctgataggtaggatgtggctttctatacagcagagtttggggggtgggactggcaggtgagtagctcaacccaggcttctgagggtccttcatgtcttttggaacacaatttgaaaatcactgctttaattgctaaattctagaaaacctggatgccctatttaaaaaaagagcttagcttagtgtcaaagaggaactaggttccagttttagctctgcagatcaccagctgtgtgaccttgaatatgtcactcaagctgtctgcacaattaattgatttgtttgtaaggtaaggagtatggactagatgacctcacactgatcactttctaagctccagaaaacctaattgttaatgcttaattgtgcgagctgtgctcgggaagggctgtgttctagtaccttcttcctcatcactgtcatttcagtattatctacactgatcttcacaaatattctgcacacttggattctaacctgcaatattgctgttggggttatagaaatatagattatatgatggtatttagggtaagcatttttatctctaaaatgagttagatatcaaggatggcatggtattagattacacaatatttgaaaagaataataagaaaaatcctgcaggatttaaaaatcttattagtactcttctgtagaaatactttagggaatggttcagacagtatcaggtgctgtgggtgtaagcatggccacctgctagctctgtgaacctggacaaatggcttagctgctctgtgcctgagtaaagtagagatagtaatagcatcaacctcctcgtgttgtaaaaagtaagtgaattaacatatataaagcaatttggggccaggcgcggtggctcatgcctgtaatcccagcactttgggaggccgagacgggtggatcacgaggtcaggagatcgagaccatcctggctaacacggtgaaaccccgtctctactaaaaatacaaaaaattagccggcctgatggcaggcgcctgtagtcccagctactcggaaggctgaggcaggagaatggtgtgaacccaggaggcggagcttgcagtgagccgagattgcgccactgcactccagcctgggtgacagagcaagactccatctcaaaaaaaaaaaaaaagcaatttggaacatagaagcactcaagaaatgtaagccgttacctccatacaaataattattataatgtgggtttatttctttccagtcttttaaaataagcatgtaaaaatagttttaatcatattgcactaggaagatttgtttttgtttcttaaatatatacagaatttccctttttctgcttctttatatttaataacaagacattctaggatagactaagccttttcatggctaattgtcctgtggaattcttttagtttttctcttccatgtttatatatttgatatgattttctggtagaattcttgaaaaaataactgcatcacacagtagctctcctctcccattttattttattttacttgctgaggctggatattatattcttttggctgaagtcaccatagtggattcatacaactaatttccagccagtttatgtagatcatttgcaaatgtattagttacagagaggctccaggggtgtaccaaagaaacctcaaaatacagtggctcaaataaaatcagagtttatttctttctctccttacagttcagagttggtgggtgatggagggtgggaaggtggctccgcttcatatggtctctcagggatcctggttccttctctcttgttctgcctttccaaagtgttgttccattttcttgatgaggcttgcccctcaacactatgtcaagttctagtccaaggaaagagaaaagagaagtaaaaaataagcaattttttaaaacgtgcatggccctcaggttgcattcctgatttcttttcacatcccactggctgctgcttagccacgtggactcatcttgctgcaagggaggttgagaaatatggcttgtgctgagctagaactgtggggatggaggagaagagcaggtttctgatactgaaaaaaaaaaaaagaaaagaaaatagaaaggagaatggataataataaatatacatatgctttgatcacaatttcatgggccaagtttgagtttggaattttccaagtcctcagattctatgacagaacatggtggtggagagagctgccccctggctccagtttgcagactttcccctttgtctgcccatgctggctccatttggcactgggaagggctttgcacccaagtttgtggtcagttggccaagcacccatggtctcccactcttccccacttgcaaacagtagtgtggtccacccttgcttgggaaagagcccagtgctcatttgagcagtgagtactaggaccctgtgcctctagaccgtgctttaggacttgcatatccccttggtcctctgatttctctatttctgggggagagatggggatggaagagggtagagtgaggccctctaaaagtcaggatttaaggcaaggtccttgcttgtctaggtctacaggtgatgctacaaagagaatgttacattgattcagttcttaaaattttcccttttcctcatgcttctgtttcattaatattcatatttactttttataatatacatgttatgtctttaatacactaggagtagaatatttgtaatgaaatggagtgctgttttaatggatgagaaaggtagggaggggctcagagagggaggctggagaatattcacttatttagcttaatgttttcaacagcttaaaaaaagagaaaaaacaacctttgagtggcccttgtgattaaatggcagtttgcccagactagagggagccagcgttgggaataaaaactaagattcactttgaaaatctagaaaaaaaaaatgactacacaagtcataagaatgtgcttgatggcttgggttgtctgagtgcaagtgaagtagggcgcaggcctggtttccgcattccctgtctgctcagccttttagctcctaaccccatccactccctagagctggccagcccagacccaggacctggatgctgacctcttcagggcggagctgttgctgtgctcagacatcgtgacaacttgttgatgggaaatgtagctgaaagtctagcacaaaaagctgctcttgggttggccagcgaacctccttcatggtaaaactccccatcccttatccaaatccttgggaccagatatgcttcagaatttatgatttttctttttcccatttcagaaaggctatggcccatatgccctatgttacataaagcctccagaggagtttgggacagtaccctatcatccaatatcttcatcattctgcagaaaatgtatgaatatttacactaagtggaacacaaacagggttataaatagcctcaggtcagttcaggtcacgttttgctgccaaatgggttatggaaaaagcctttggtttccagagcttttcagatcctggcattgtggataagggattgtgcacctggtatggtgactgctttctcagtgtccatttggtgccattttacatgtattgcatttgaagtactcacaacaaaaatacctatgtatatatatacctctctctatatatttttttccttatttatttatttatttatttaacagctaaggaaacaggtttcatgagctcgaatggcttacacaagatcaagaggagatgatctcctttgcaaacagaggccaggacccagggcctgggcacttagtgggctataagagtttctaatttgcttgtttgaagcattggaacataagccagcctgcagaatcctgtttcacatttaatggtagctgaaagacaatactgcagtaaaagtgccataggatgtaattatcctaacattgtttcttaagaaaagacatcttaagttcaaccagcggggtcaggaagtggggtccctggcctgaacagtggcttatcttccttcctggatggctggcaggggcagtaggtcagtcagggcactgttccaggacccagtggcagtgtgggcagcactgtggtgagatgggaagagaggaaggaaggttcgggtgcttgatgtgcattgaaggggtcagggaagggggaattggctactggctgaggttctgacactagttggacagggcccgatgccaaactcttgttcttgttctcacctagaaattgccattagttagtgctgctgctgggcattattttaacttagaccaaggcagcccttttgcgtgggcaattagataacggcgcccactctggagagacacagtctgatggacacactacttcgtgggctgtgcctttgtgcaaagcaaaaggtgttctttcctccgtgccgctgtgctggctggatttcagcgtcgtttttcaccttggcctcgtgcctttatgcagtggacagatttcaggcagcttggcattagtaggaatctacctgaaaagcactttatatgtgtttgaatccttggcatgatctggtgatgatctggcagaataggtattaccatgatttgccagatgagaacgtcatggcgctgtgaactgctgaaggtcgcctcggctccattgctatctggacaggactgttccctgtacactccctctttcaaaatggaagaggcagctagaggatttcaggatacatttccctcagttgtttccttctgcactaccttctcatctttcatggttgtattaaaagtggggcctggcacagtggctcacgtctgtaaccccacactctgggaggccgaggcaggaggattacttgaggccaggagttcgagactaggctgggaaacacagtgagaccctgtctctgcaagaaaacaaaaaaagtctctaaaaaacaaaacaacggatagactgatgttggttcctatttggatatgtgtggcaattggtggctcttactgaccccatagctctcattcaggtggtttgtgtgatagtgggcacaatgttgttgccaattgagttgaaaatgctgtcatgttgaaagaaaacatcggaaatgagagggtctgggtaaatatattagtagtatagctgttgctttgtttgcagtctcttcacttacattactttcatttaaaattaaccataatctgttaaacttttacttccaataatgtatgggttcaggagtcttagccaaagtcaatgtttttcacaggaagtatctggatatacattaacttttaaaattgtaaccagttagtttcactataaaagttagcaaagtgtgaatgaattgatcgcttgctaatctggagcacacaagggaaattaattttagatggagaaaatatttcctaaaataacagagggaggcagagagctaggtgtatgtgttgggcctttcaaatatattatttcatttactccctaccataattttatggggaagatataattgtcagtgtttcatagatgaggatatgcttgttattagttaggacttagagtaagttttttatcatatttaaaaaatgccccatctaattctgaattcttacagagagccacataggaagtaggattttgaaaaagcaaaaatcaacaacaatgcagagaggaagaaatgagtggattggtaagataaggccatgggtagttcacagaaactgcttgctttctctaacatgcttgctccctttggtaaactttggatgcatatttgtctcaaagtgtcatattagacaaagcaataagaaaatggttagttttaagattgacataattcataaattctcacaaatacatttgatgaaataaggcagtttgtgtttctcctggtcctgaggacccccaaaactcagaacctcataaataggacagcgaatgatatggaggaagctatttcttcagctacatgtgataatctagatgaatagaactctcatttgtggcatcccatattgtaaaccagttacagtacagaaaatcattttaaaaaaagagagattgcaggaagttcgccaacgatttgccttaatcctgaagccaatttaaacattccaatctgatatatatatttattttagtttattttttttgagatggagtcttgctcttttcggagtgcagtggggccatctcggctcactgcaacctctgcctctcgggttcaagcaattctcctgcctctacctcctaaatagctgggattacaggcacccaccaccatgcctagctaatttctgtatttttaatagagatggggtttcaccatgttggccaggttggtctcgaactcctgacctcaagtgatccacccacctcggcctcccaaagtgctgggattacaggcatgagccaccgcgcccagccccaatctggtatcttgataaattaccaaattgttgtaatagagattagtaccttctcttacctttctttttataaattaattttttaaaatagtcctcagactttcctgtcaaggaaccctttgatagttgatcatattgcatggtactttttccattgctttatgtaaatttctgctctcacagtcagtaaatctgaacataagcatttctttctgggctttgttctgtcctttcctttcctggaaatagcttccagatgggattgttttcttttgacaaacctcacgactgtatgtttcaccattttttgacctattatctctttttgagtttcattttcggcttaggtactctgcttgtaggattttttttttaacaccctgtgatatatactgaaaatactttgcactgttaagagcctgtacaataatactgttaacgatgaagtgctgtggacttctctgtaactcccaattcttcaaaggaaaattttccttcagtgtattccatctttcttacttcttcaagtttatttagggaataccaagaaataaagtgttgcttagtttaattcctttataatgtctttatttttatttatttatttattttctgagatggagtctcattctcttgcccaggctggaatgcagtggtgggatctcaactcactgcaacctctacctcctgggctgaagtgattcttgtgcctcagcctcctgagtagctgggattacaggtgcctaccactacgcctggctaattttattttattttatttttgagaccgagtttcgctctatcgcccaggctggagtgcagtggcgtgatcttggcttactggaacctctgcctcccgggttcaggtgatcctcatgcctcagcctcccgagtagctgggattataggcacttgccaccacgcctggctaatttttgtatttttagtagagatggggtttcatcatgttggccaggctggtcttgaactgctgacctcaagtgatctgcctgtctcgggctcccaaagtgctgggattacaggcgtgagccactgcacctggcctataatgtctactgaaaataaatctagctgggcatgttggctcatacctgtaatcccagcactttggccggcgtaggcaggcagattgttggagctcaggagttcaagaccagccttagcaacatggtgaaactcctctctacaaaaaatacaaaaattagctgggtgtgatgccagcacctgtggtcccagctacttgggaggctgaggtggagggatcacttgagccttggaggtcgaggctgcagtgaactatggtggtaccactgcactccagcctggttgacagaatgagaccctgtctcaaaataaaacaaacaaaaataaatttgcttaaaatttttttgaattaaagttaatttttataatatttagttaggtttttttttttcctcattattctttcacatttttccaggttaaggtacatgaattttactcttttaatgttgtggcccagggtagtctgtctgccaatcaggctgttaagttgtgggtctgacattttccttggaaatgctgtttctgggcatgttagactttctgtacttgtgtgttgccttttggcagagacttcgacacttaaggatttgttgataaaatgacaaattgtttcatgaggcatttacttggtactagacatttagatgattgtttctcggaataacttggttgactaacatctttctgcttcctgtcgtcatgatcacttctgcaaaggacgaagcctagtacattttctggtagaatcttatataccataagatttagttgaaacattgtatgtttctatcttcagtttttggtcccaagttattttaagtaattttttctttttctgttgcccaggctggagtgcagtggcgccatctcggctcactgctaccttgatctcctgggctcaaatgatcctcccatctcaaccttcagagtagctgggaccacaggcacatgccaccatgcccagttaatttttatactttttgtagcgacaggctggtctcaaactcctgagctccagtgatccacctgcctcaccctcccaaagtgctgggattataggcatgggtcaccatgcccagacttaagtacatttttttttttttttgagacggagtcttgttctgtcacccaagctggagtgtaatggtgtgatcttggctcaccgcaatgtccgcctcctaggttcaagcaattctcctgtctcagtctcctgaatagttgggattacaggcacgtgccaccacgcccggctagtttttgtatttttggtagagacgggctttcaccgtgttggccaggcttgccttgaactcctgacctcgtgatccgcccgcctccgcctcccaaagtgctgggattacaggcgtgagccactgtgcctggtctttaagtaaatttttaaaggtgtaaattctgcagactcggataaaaataattattctattgtgtcttaacagatcgttataattgtgaagattaaatgagttcaaagtatttggctaatattgttaggggctgttgcttttgttattattattactattactattacgtcctggcttcattcctgctctctctttccctctttgcatcattgcctctgactatctccaggctgctgatagtgagaggggccgtctcccaatccaggttaccaggtctggatgaatggactctgacccacttttctggccactggaattttgcctttgtgaatattataaatagtaatatgtatacaaagaatgattatgaaataatcaattataaattggttggaatgtgtctgatgctcagacatacacacacaatttgacattctggttagatttctctgtgcaggaagcaagggaacaacagagcagtgagaaatcaaaggagagaagggtattctggggcaaaggacagtttccataggtagaattacagaggtaaaaccattaatcaaaaaaaactagtgcaccactcactcgatttttccaccccttcctttcagtcgtggtctgagctttcgcattcaggttgaagatgaactagcatgtgcctcatttaatactgggaacttttatttacctgagtctgctttttgaaatctgttaagtgttgagtttctatttgcaccttattcaccagatttacttattgtctttccctgctaatggggatggagtggggggaggtgctcgtggcaggcactcagacaagctcgctgtgcagcagtggctctgagggcacagctgtttggaatcagctgatcattttcaagcatctctagctcatcatattaaacacagttgcacacgtttagtggttgcttaattttaacctgaaacactgtatgaaataatttgatgtataagaagtattgtagtgataagaagagtagcttaatggtttttcatgttttctatgccagccactatttaaccgttttactatttacaaacacacacacacacacacaaccatatacacccatatctgggtatatgtgtttgtctatatacatacatatatgtgcatgtacacacatatataaattcatttgatcctcacaataaccctataaaagaggcacttctattttcgcctttttacagtcaggaagccaaggcagagagtgggtaagtagcttgcccaacacgggtaatgagggacagaggtggagtttaaacccaagtagctgtgccatatcttttttttttttttttttttttttttgagacagagtctcgctctgtcatccaggctggagtgcagtggcgtgatctcggctcactgcagcctctccctcccgggttcaagcgattctcctgcctcagcctcctgagtagctgagattacaggtgtgtaccaccatgcccggctaatttttgtatttttagtagagacagggggtttcaccatgttggtcaggctggtttcgaactcctggcttcgtgatctgcccacctcggcctcccaaagtgctaggattacaggcctgagccactgtgcctggccttttttttttttttgagatggagttttgctctatttcccaggctgaagtatagtggcgtgatctccactcattgcaacctccgcctcgggttcaagcgagtctcctgcctcggcctcccgagtagctgggattacaggtgcctacattcacgcctggctgatttttgcatttttagtagagatggggttttaccatgttggccaggctggtcttgaacttctgacttcaagcgatccacccgcctcggcctcccacagtcctgggattacgggcgtgagcacccggctgcccatactcttaatcactaccctggagtagttctcagtgctgagcctctaactccaagcaaatgataattaaataattaccacaatatgcccaaagttattttattacaagcaaatttatgaaatgatgcagttttttttcacatggaaactggtttcttttgtttaccttggatggatgtttgtttgggagttggctgttttcatttgttaaataaatattttagttgggtgtttgtgtagcaagtgatcttggtggctccctgcagtgtgtcctgcactggtgagcacctggtgagcattcactgaatgtgtctgatggatttaccacactcatctgtgaacctgtagctcagctaatccccctaaatctgtgagtggcccttctcagctgccctgcaggggactttgtggagcaggaatttattttgaccagcaaactacccttgtgactcatcaccaagagcttctatcattctctagcaggatttggaaattaaagacactttgactcagaaatatcttccacacagggactcattaaatgaaactaacatcctggtgggcaaagtgtaggagaaatagtaaaagtggatttcggccgggcgcggtggctcacgcctataatcccagcactttgggaggccgaggtgggcggatcacgaggtcaggagatcgagaccatcctggctaacacatcctggtgaaaccccgtctctactaaaaatataaaaaattagccaggcgtggtggcgggctcctgtagtcccagctactcgggaggctgaggcaggagaatggcgtgaacctgggaggcggagcttgcagtgagccgagattgcgccactgcattacagcctgggtgacagagtgagactccgtctcaaaaaaaaaaaaaaaaatggatttcatgggccattggaagtcactgtcttaagcagtgctttgtacctggggactccatccatgtgtaaaggattagtgagcaggatacacatagggaaatgtgtagggagtgtgtgattctgatctttttagaggcaaatccagtttaaatgtggagagtggcactattttggcttcctagcaattccaggtctaatgcttacatttaagtaacaaagatgtttgcattgatgaagcataaccttggcaattcttaaatttggggattggattgactatatatatgcccttcagtaagctattaaatcatcatgaccactaggtaaatggtggattaactactataaagattatttatgagtattccaacatcattcatctccatccccttatcaagattaatagacaaattattatcatttgaatgagagccagaagagccctccctccctccaattaatgatgggctggaaaagagcaaggagatcactttttgtgataatctgttttaaatgttaggggattttaaacattcttacatcagaatccatgaagcacaacattaatatttattttgcttaaaagtttgcagtcatttagtagcaattacttttatcttttccttaagctttctcaaaaacattaaggtttaaagaaaataaaagaacactttattaaaatttctctctttctcttccttgttctctctttctcttgcttgtttttttggtcatatattaaacatatatcacgatatgggcaaaatattttttacaagcttcttgactgccaggggattaatcaaactggctgtatgtgtccttttaaaccaagtaatttgggcgaaagcttgcaattttatgaatatgctggaaaatcttacctttattagcttgagaagttttctccatccttaggtagccaaagacaattttactcggttttgtggggaacattggtatcagaggtgaagttctttctgatctgcaaggtggccttgaaattatttctgtatttcaccatattactatcaacaacatttgttttcctttcagccaggatgagaattgctatctgttttcagaacttggaggcagacctttaggggtcagagaaagctgagcatttgggttctagaaacctttacactgggtgtatttttatttcattgttaatatctcgatatagatttgctttaatacatataggtgaactttgagcttctgtatttattttggcatacatttttagagattaaatttatttaaatttttaataaaacattaatgcaatttaggatttttagtacatgaagtaaaagtaagtctgcatcgaggtccccaaaaagcaactgtaatttggctgtattgatttaccaagtctaaagtaaaatttcacatttgaaaataaaggaaaggaaatgtaattttatgctatgactataaaatttctctctataggaaatcactgcatatttcaaattggacttaatcataaagagaataattaactgacagttacagctgatgttattaatattactgtaaaaagtctgggtttggccataaagtatttagcaagactaccttttggaattcaagactatgagaaccacgtcttgcttgcacactgctccatgtgaaactcagtgccaggctcatggaaatgggaccattttaggagtcttcctgtgtataaattaaagagagcagaacttacagttaaaagtggtagagcaatttgtgtttatcattgcttgctgtcatgttgctactataattacaataagagaacaaaaaggaataaactcctgtggtcaaatggaagtggaaatgaaataaccattgatggggaagaaagacgatggtggagtggctttcttatgcatctcacagattttgcaagccctctgattgaaagttgccaggattgtttgaggttggttcaggggaaagtgggagaagtttgaagctgaaaactgagagtttggttgagaatctttaaacagcacactttgactctcagagctttccccttcttcctcacctgcacaggagaacagagatttatatattttttctggaaaaactgaattccaacttgggatccttagcccagagagcatggcaaggctctgaatagacatcaggaagattaactgacaccaggaggtgccccagttcctgaagctatacctgtctgctatagcttgaagtgtcccccgaatttcatgttttggaaatttaatccccagtgcaacagtgtttggaggtggggcctaaaaataggtgattaggtcatgagagctctgctctctttcttgaatggattaatgtcattattgcagaagtgggttagttatcttgagaatggccttgttataaaagtgagtttgactctctcttgcttacttgctgtcagtgtatcctgccctttcacctttttccatgggatgatgtagcaagaaagccctcagtagatgccagtgccatgcttttggacttcccatcctccagatccttgagccaaataaatttctgttcattataaattacccagtctgtggcattctgttgcagtagcatagaatggactaagacagcctcccatcgctgatcagccaccaattaaagagtgcttttactgggagtacagtatagttacagcacgtaaattgattaccttactttgagcccaccagttggtaggtgacacccaagcctatgcattgttgagcctcattttgaaatgggaggggctgctaggagtcagcagatgtttgaaagcctccaccagtagaccttatattaacacaaacaaaaggaaggagccacttaggggaaataggaatgtggcctgtatcctcagagaagtaggaaaataattgtgtctttgaaacaagaacagaatgtgataaaaaaaaaatcagagaataagaaagagatcttggaaattaaaagtgtgatatcagaaataagatctcaagtagagattggaagagtggatataaaagtgataagtaaaaaaagtcttatagataatgtctgacttgcaatcaggaaggagtttataagcatagtatttagaaatgcataatctattgtcagaagaaacagataacagaggaaaggggatgcccaagcctgctgcattgtgttatcatcttattttattgaaaacaaacttaagtgcatttattacttggataaaaattgagaaatatataatgagatagactgtagaaatcattttattaaaacattttattgatagtacagaaaatgctgtactgttactttttttggcaatttcataaagctctgtgaataacatggtcccttagttttttttttttagtagccctcttttctcagcaccaaattcttgctgttgttaggcatagtcatcctaatattttttatactttctgccaggcctgagaagcttcatggctttagaaatcatctaaatcatcacattgtgtgtgtggctgtaaatatccaaattattttgaggcaagtttctcctctgatgtgacggccatgtattttccatattgctgatgatgatgggagtgttttctctgagacattttacacttgtggtatatttagctcactagtaatgaattacaaatgcaaggaacttggaatcctgaatgaatactaggagcgagccgactttcaagctgaaatggtctctttccaacattttctggctgatacaccacttttaatagtaagtggcttccttctgctcttctccatcacttgcaaccatggatggctgttgtggtaacacggaccctcacagaatcttagatctggtagatgctttaaggggccaaccagtccagttattttcccctatccctgaggaatcccactcaaggagggagaaaatgattttctcaagatgcacctgttcctatgagatgactaggggtccaaacttggcattctttctgcgtctctaggccacctggacctgaaggacagttctgactttccttcaaatctcatgccgttgttgatgctcgtctggtggatttgtacctgagaagggatgtttcgggagggattttaggcttctgtctgctgtgtgaagccgagggggttttgtgaatattctgtaagagatgtgacgcctgtggatgaaagcagacagatcaggccgaccttggcttggagtctaagttttagagacagaaaacagggagggggtgaaggagaggggaaatgggaggaggagaaggaggaggggtgccaggatcatttcttttcctgttacgcattttccttttggcgggagagagtgagaaagctcctgaatgtaactggagctgctgaactgaactggtcagaacctgtcctaatttgtgtaaaagaaatgctgtggtatttattcttccagagaagcccacataacgcaaccagggcctgctggctgcccttgaggttctgcagagcttggttttggtgtcttctctgagcctgttttctgctgaggcagcccctgggtgttgcccactggcctaactccctccaggctcggcctttcgcctctcatcaaagctcttttttccctggattttaatggttggctgattaaagtagttcatagtaaggtgttaattataactctttccggtggttatgtgcatatattcacagagttgttacagaagtaaggggactgggctgctcatggtggctcatgcctgtaatcccagcgctttgggaggccgagtgggtggatctcctgaggtcaggagttcgagaccagcctggccaacatggcaaaaccccgtctctactaaaaataacaaaaattagctgggcatggtggcgggtacctggaatcctagcaactcgtgaggctgaggcgggagaatcacttgaacccgggaggtggaggttgcagtgagccgagatcacaccattgcactccagcctgggcaacaagggcgaaactccgtctcaaaacacaaaacaaaacaaaacaaagcaaaacgaaacaaaaaacaacggaagttagatggggctgaatttccaactgctaggctagaactaggacaacactgtgagggaaatcggagtgtaatacattccgcaaccccacctgtctactatcgcaaccccacctgtctgctatcctccctttgcaagcccagggccttgatggttcaaggatgagtctttctagaaaaaagggagagaagtttctttccttttttttttttaaacaaaagaaaaacaaacatgtttattaagatatgcgtagtgcatacacatgggagtacccagacatgagtaattcaaagggttggttagaactgggcttatctagcatcttaacaaaggaacgataactttttagagaggtgatgaaacaaaggaaaatgactttaagcttccaggtgttaccagaagtttcatcaaatcaagaatattcttaggagtgtcaggggtgtctaatagttgagctgttaagtaactcttaaacttgttaatgtctcttgggaatttcttcttttagagttgttttgtattaaaaccaaggaaataaatatctttatttgttttaaaaatagtatcttaatttattaattttgtttattttgcaaagtctttttaaggaaatattatttccttttacaatgagtaaaaatacattcattcagaacaaaatataattgtttcttggtgcatcagatgtttatatctcatgatagtgatctgttaatagatcagggtttttattctttatcttcatccccccttcattgcccccatagactcctttggcagtttagtgaagccagacaaatttttttttgagacaaagtctcactctgttgcccagcctggagtgcagtggtgcgatcttggctccctgcaacctctgcctcccaggttcaagcgattttcctgcctcagtctcccaagtagctgggattacagttgcaagccactgtacccagctaattttttgtatttttggtagagacggagttacaccatgttggccagcctgatcttgaagtcctgacctcaggtaatccccctgcctcggcctgcaaaagtgctaggattacaggtgtgagccaccgcacctggccttttttttttttttttgagatggagtctcactctgtcacccaggctggagtgtaggggggcgatctcggctcactgcaacttctacctctcgggttcaagcgattctcctgcctcagactcccgagtagctgggactacaggcgcacgccatcatgcccagctaatttttgtatttttagtaaagacaagatttcaccatgttggccaggatggtctcgatctcttgaccttgtgatccgcctgcctcggcctcccaaagtgctgggattacagatatgaggcaccgcacccagcctgacaaatatttttaaatgcataaaatagagtacatggtattccatgcatacagttaccaaaatactgaaaaagtctgtgagagagtagtatttgctgtttcattagtgtgttcagtaagaacttctagcatctctaacctctctactcttctgaaataacaacgagccaaatggtattttcaagatacctgctagagttgtaaggtgatgtgaaaatggttatgatttttgctggtgacacagtcaaagctaccactaataatgtgttttgtgatctgccatcacaatggaaggaaatgcaaatttctgttagaggtcagtgaaaagatctaattgcttttcctgtccaagttcatggaccccctgcctggtaataacccctgataaagatgatggcttaaaatgagtatttgtttccttaaacctcagcagtggcagcagtgtgccacagagtgtttcaaaagagacaacaattttaaatggaaagtagtcttgggtgaatgccccatatggcaggcactgcactgggtgtagttgacaaaactgatgagctctatgatggcatctggcctcttgagtgtgtagactagtacgagaaccagacatcaaattgcagagcatacaaatagttgtttaactgcttagagggtagacattctgcagtgctgtcatggcaaatcactcggggacttcatagggacctggaatgagtgatagtttgagtggtcagggaaggccttcttgaggaatctattcaagtccatagttcaaggtggtggagggcactggctgaaggcagagctgtgtgcaggctctaagctggcagaacttggcccacagaaagcctgattgaggccggtgattgggagtgaagtgagcagagggctgtggattaaaattggcagaaagatgcagtctgcatttcactcagtagtatttcttatcctgattgaaggggcatggtttacctcttagtttgagggcatgtattatttagtgcattaatggatggatccctaaaagcattaggaattagtctggagtatgtaggttgaaaaataggttataaaattgatgagaacaagctctcttgcaagagttagaaacataaaaacaaatttttctaaagctaaattccttaacatttttcctcactcagatttctatttggcttgaatctaaggaaaacctgagaagagaggaagtgcttggcttctctgtataccaagcagtttcaacagtggtgtttgtagaaatgcataccttgctgttcctaggcagataagtgttgtcacacgtcttcagattttaaggcgacaggctccacacctggcagaggctcagacagagcagaccaggattgggctattcacagaggcaggaatgtgaccattctggtccgggcagttggggaggaactcatctatccacggttcccatactgtttggccctgtttttcaatttgactccatcaaagcacattctccagccgaggggtacacatccctttgtgacttcagaaatcatgcactgttggtttgggagtcttaactacatttggaggacacgctgagccgacgagaaatggaagtgagatctgaatccacaaacggagacggcagacagtcacaggcaggtaaagactcattgagaatgtggctacttaaattttgtccacctgttcattgaaaggaagccgaggcatgactctccgccaataattagtgtgaaaattactgagttaacagattctaaattattttgtcctctgggtgacctaggaagtttttaaaagacgttttttctaaataatgtcatgaaataagatagttacatgtaaagaatctaacaaggtcagtcattaaaaacattttctaaatatgatttattttgcttactaaccttgtaaatcatctaggataggaccactgtcagcctcagagcctggcacagaacttggcacttaatgcgtgtttgttgaatatgaatggattgggtccagtgtctaatgatacgctatgaaagttattccatcacttctccgtgatggaaaaagatttaccgaaaagtgtctgttgtatgaaagtcatatggggtagaaattaaactgtaaatgagttaaggagctgtaaccttggcgctattccaaatctccaacaattgagtagttaattagtgcccctgcatccatttaatttgtccatttatctcttggttcgttcactgtcatttatttctctctgctggtgccaagttacgtgataggctgctgggaggcagacaagcaagatctctgcttgcaggctttcaaacgcagcgattcagcagcgtggtaagacgtgtgctcatgatacatactatgtgctgtgggaccacaggtcaggaaggataaactcccggagttttgctcttcctcagagggtcaaggaatgtttcccagagaagtgacttgcaaagtggtagagaggaatgtggaagggaagaattccaggctgaggagaaagtgtttggaaaggcaaatattcagtgaatcatatggtgagatgccattttcaaatgtataatgcacctccttgctcactgtccatcattgccccatccagccacactggtcagctttcagctctgggaacaacctctgtttacagggtctttcctccacctggaataccggcccccagctcttggctatctccttctcctccttctgggattgggcattggatgaaattgcacctgcttagagaagcctgtcctgacacccacctgaagtagattttgtgctgttgtctccaccatccacacttgtcaccattgctcattgcttttgttcacttgtttgtttactttagtgttgataggtccccaagactgtgctctccatatgggcagggaccaaggttgtcttgttcacgattgtgtccatagtgccttgtacggtgcctgttctgtagggatgatagatccttgtgaatgaatgaatgagtgaatgaatgaatgaaaaggcggagtcacttaaaagaacaaaagcatttgtaatagacttgctattcctgtttattctttgaaatttgaggtaattcttaactagccacttaggatctccattaagaaccctagtcaagacctttgggtattacctcaaagtaaaacaaagtgggagtattttggatctttggaagttaacttgaaaaaatctaaggattctttaaattgaatatatagggaagagagaactcctactcagaatacttaagttacaaacacaagaaaaattcatagattaaaaaaattgaacaaagagtatcattaagtcaaaccgtttttaatagtaattttgtaaagttatttatgacactattttttatgtatattctcagttctctaaaacctgataattttggtgatttactcttatctgtgctttgaacactttattcttataattaatatcattatttttaacttactgaaacctttcaacttacgtaatcagtaatgttctcatgctgatattaaccttttatttatttatttatttatttatttatttatttatttatttatttgagatggagtctcattctgtcactcaggctggagtgcagtggtgcgatcttggctcactgcaacctccacttcccggattccagccaattctcctgccttagtctcccaagtagctgggattacaggctcccaccaccacacgtggctaattttcgtatttgtatttttagtagagatggggttttgtcatgttggccaggcctgtctcgaactcctgacctcaggtgatccacccacctcggcctcccaaagtgctgggattacaggtatgagccactgagctcagcctgatattaaccttttaattcaatacagtcttcccataacagaccttctcccattgatgggctcatttttattgctctttgttctctactgattctgtcagtttttagagcccataaaatagcttcatttctataccgtcttattcacattcagatttttcatatagcatgtcacacacagtataagacattttccataacatattatgagttgatgatttctgtcatgttgaagaagatcatacagcaacacttatcttgtaaattctcttataatgccaggtaaaaaaaatgttatgtgaaatggcacattgaaagaaaggaaaatctaaaggtggattgcttaaatgattgtgattgtttttcccattggatcttctgcagatgagaattccctgcatagatcacccaaggggtggcagatcgggcttctcagtttcagccaggggtggacggtttgcatctcctgatgtgttcatcaacaacatgatgaagccagtgtccttggctactgattccaaccttttgttctgttcttggagaaatggggaaaaagatacacttatatactagtgtagattttggttatctttatttgtgaagaaaattttttgtttacctctcattttattcattcgttcagtaaatatctcattttattcattcgttcagtaaatatttatccacccacctactatgtgctaggcactgtgatagtcactaggtattaaaaaagtacattgatgatcgatgctaagattattttcaaactattttaagagaggactcctaaattaaaagaaattatgtatcaacagacaaatgcccttttatttttttccctacaaaattgctgctggctagagaatgatgatgatttgcacttctgacatcattgcctaatgttgggtttctgtgcctgggctctttatgctgtggaggcaaatggtgctttgagtgtcttaatttcaccggaatgctgcacctgttgctggctattcttgcatatgaaatccagaccctagagtcacttgctttcatttccttttcctcctccctctttccggtgtgtgtttggggggggtgggggtggtgaggcagggtgggggcagcagattagtagcttctgtgaagagtaaccaccttcctgttccgtcaaggctatgattttagcgcccccgggagtggtagtgttgcgtcactctgtcatctgtcgccgaaagactcataatccgggcagcctcaagagtttgaggcgtgggtttgtgcccgagtttggggttctaggggaggggtgaagtggaacaggctttcagcagctgctgccgccacctgatacctggaaccttactgctattgaggaacatgtatttcctcttggcttcatttgctgtttggctatgactgaggaagacaggaggtattgcatagtatcatttactttcataaacataactttgacatctctaggcttcatgttggttcaggcaatgctctcgaaagccagggagctgctttgcaagatgcatgctatggctgaaggaacggctcaatagctgggagctggccctgaggtttaaatccactcacagcacgaatttggtgttttactttgtgtcctgaaacctcaataacctcatttttcaagtgagagttgaaatattgacacaacttaacttttaagaattttgaaggcatcagtgaaaataaattgaacgaactttgaagttcagagatctctaaaagtgaatacagaccaaattatatcctgatgatcaagtaggaacatccgtagttccagtactatagttcattgacaacctccagaaagttacggtagtctaacattccttatttaaaaccaactttgccatgtttaatttatttatacttttatagatagacagatttactactggacattctctggcagagaaaaatttcatggaaagtgaagtttaatgtgaaatggcacataagtggtcctgacttgcaaactcaggaatggcttgttgaccactgtcctggaataagagagcccagctttgttcttgtcttatttctggatcgccctttctcctttgtaccttctgacattgtttctgagttccctcctcccatctgccacccgctcctttgcaactctgtagagcattttaataacaggttgtttgtgcctgtcttgcctctgcagcactcactcccacctgtttcctcagcctctgacttctcctttcccctttttggcatgctctgacctgcctccgtagttgaacccgattcctgaggcaatgatatggcaggtccctcaactctccatctatagcacttgccttgcctggcctgggaaccggctctttcactgctgtactgcatggaacagagtaggcactgcttaaacctatcagctgcctggctctctcaaatgctctttccaggaactctggcactgtgaacccactgctgaatctcgtggctcataaataaactctcaagtgataattgtgacttgaattctctagttcttacctgaccacctcttaatatcatcctggaactgtctttatatcatcttggaaaccctggagctgatttgaaatacctctggtcagttcctcagcatcagttctgtctaatgaacacctatattcttcattgtctcctcactcttggctctaagttgtcacaagtagatgattatgtctcattcccaagtagagataggacacatgagagtgggtgggtgtgcccatagtttagacaggactatctttgtgtggtaccagctgcggcaggatctacagatgactcacacatgttaatacccacatcttctgagtggccaacatcctcagatttgcatgtgggcatttgcaagaggaagcacacagatgctgtgatcagggctgagatgcctacaggtgtgtctgctgggctgcggcaggtggtggccagtggaagacaggttgtaggtagggaaagtgttgcctcatggagggtgatcctgatatggtgggaacttcaatccagactccgacatcgccacgggcaagctgaatgacagtaaacaaccttcagggcttggggacgtcagcacactcacctgtggagagccagccagaagacaggcagtggcacaagttttctgaggtagagattgtgactgtaggtgaccaaggaacaaaatattatgaagaccacattggggttcataggctggtggccctgtaggacacttggacacattttttttcctgccaacaccaaagaataatttctaggtgtctcttcttcacaccttcccatgaagcttgaaagttctagagctcactagaaactagaaaaattttccttactatgacagcaagtgtgcttcgagaaaactcacttgctgacctttgttccacagcccagcaggttgccacctgatttataaaaacagattatggagacagtccagaaaaattactccctctttcttttttttttaaagtaatattttaaaattcctttctttttgaagtatttgggttgtttttatcaatttcgttcactgttgccttaaatgacaattcttgcctccctgaagaactcttggccttcattcctgccactacagtgagaagttctaagctggaagggccatcccagggatgactgctttaagcagccagtcatgtagggttgcgcctgtggccctggcagattggaccctgtttctaccaagtggtggcatcacttggcttccatgtagtgtttttctgttctcctgcagatcgctgtcagccactggaggcctcacccactgggttccagacagctgccacttctgtttagaagcaacactgccagtgagaaaccctgccacacacaacacacacagacacacacacacagactcacacacagagacacacacacacagacacacacacacagacacacacacacacaccacacacacacacacacacacacacatgtgagaggagggccaccctgggaggaaaccctgaattctcccctcttagcacactccttctatctactccttctatctcctggtagagggagaagctgtgtgcccctattactacctctctttacctcctcattaagggctttggtgcgattattgtctcccttttaatctcactacttgcatgcagctttcttgagaaaggttataatttaatcctgaaatacaacttctaggagttttctttttaattcatcattccaagtaggtgtctttgtctgtttccacattagaaaatgaaaccaatacttaaatatgatttccctgcttttattggcagctatttaagatctatgtctgaggtctggctccgtgtggtttggaatactttattgttattattattattattttgagatggagtcttgctctgtctcccaggctagagtgcagtggtgtgatctcagcccactgcaacctctgcctccctggttcaagtgattcccatgcctcaccctcctgaatagctgggattacaggcacacgccaccacgcctggctaatttttgtagttttagtagagatggagtcttaccatgttggccaggctggtctcgaactcctgacctcaggtgatccacccgcctcagcttcctaaagtgctgggattataggcatgagccattgcgcccagcctggaatattttctaagctctttgatgatggcggcttcgatttaactctctctgacttaattctgttgattataatgtcattcaatcccattagtatactcatatggaaacaaaggcatgatttcagattttatttatatcttcatgctttggaaaaacaatttcatgagaaatcactcagcccatgaagtaccatccttgacattacttttttgggtttgcttgtttttaaaacagtttttattggcttttgctttttataattttttgaaccataccaacagtcgcataatgagtatttttagacatgtgcttttaaaatcatgtgaaaattcttttaatgtcaacatgaagagttttgtttataatcattgctgtgatcaagaactgaggtagaatttcctagctggacacaaatgggttaaaaaaaaaacccgacatgctctttgattattggataagttgtattctaaacaatattactctgatgaagatattaaggggagttaattagattgtgagactcttgaggacagttgatgcctttttcatttttgcattcttcttgggtgccgtgtagttgatcagtatagtcatgggacttagttctgattgtagggagctgtgtgaactgcatgaagcagacgagactccatcctcgcatgggaaacctttaaggattttgaagctgggcaggtgcaggttaatagaaagatcactctgggctctgtaggagagtgatttggagagaagagcccctagaggcccagggaacattgcaggtggctctgccaggagaccaggtagaagatgtggtgagggtgggcgggagatggatgaaactgtggatttcgtaggtacagattcatcatccttcatctgtagctacactattgaagaagacctccgaaaaccagaaggtgttttatttgtagttcatttggcaagaaaacttgagtttgacctgaactcatttggtgttgaagcctgacttgaacagctgggactcttttaaagtccttatgtatgtcaggcatccttcataaacatatgtatttactgcagggctattaatgtgtttgattaggggaaattgccctggatcttgctgttttttgttttcactgtaatatatgacttgtgctatataacttttctcaaatgggaagagttctggttcagcagcacctctggccctagggttttggaaaagaggttgtgaaactctttgacatgtgtttacaggataaggttgatgaaactgactgataagaaatggaggcaagatctatggaagaaaagaacatttctggaaagactcaaaagttaatgatgacactgcctcattaacactgaagggaagtagaactttaggaggggtcagaaatattcattagataggcatgattcattgaaaaggatgcatcttgaatttttgaagtattgcttgtatgtgatcttggattgaattgtagaccagaaaaagggggcaattgcagaaatttgaaaaagacctatagattagttcatagatttgcatctatgtgaattgtctggttttcatcattgtactctggttatgtaagatggtaatatttgaggaagttggatgaagggaacatgagaactctgtgtactcttttcttttttttttaaccacttcttttataagtctaaaattatttcaagataaaactttgaaaaataagaaaaagaggtgtttgtcatatcagggaacagtatcattcatgatgcttttaggtagagagtatctatgagcagaagtctagttttctaggagaattcaaagtctagaagtgcaaatcgagtagaatttcagtcaggccttcaccccctcccaattttttctttttaaaaaagctgacctggtttctattgtaagattatctttttatattctgatctgagaaaaatgcttgactgtagcgtaatcatataaagaagagttctaggccaggcgtggtggctcacgcctataatcccaggactttgggaggccaaggtggacagatcgcttgaggtcaggagtttgagaccagcctgaccaacaaggtgaaagccgtctctactagaaatataaaaattagccgggcatggtggtgcccacccataatcccagctactcgggaggctgtggcaggtgaattgctggaatctgggaggcggaggttgcagtgagctgagatcacaccactgcactccagcctgggcgacataacaagactgcgactgcgtctcaagagaaaaaaaaagaagagttataaaatggagagctcatgggaagtgccataacttgtcctttgcatttagtctccctggtgttggagggtgtggtttggctctagttcttgttggtagctctgcagggcgaggtatagttgtattagttaggactgacagttataatatgatgttcaaagccaagaaggtttacagataacagggaagaatgaagaagatgtgtacccttcatggccaaggtcagcttgcctggattttgtggggctgatgctgctgggtgtatatttcctccgtggagagaggattagtttctgaattcctttgcttccctctctaacttcaacattacctcctgtagtttcagctaatttgttctgtaattctctctccactccaattctttctttccttttttgatgagagtagacctaggctggcagccagttgctattgagctataatagagctagtggtatgaacaaaatttgattactgctgtcaacactagattgaataagaaagcgcataccctagacagatacttgcaacataaatggtctattgatttcacaagaactagaaaatgaggccaccgtgtaatctagcagaagaatggatctgtgaatagagtgggtcctgacattgcacaacagttttcaaaagcgcccccctattgatctttttagaagaatcttcagataaactgattttagcttctgattttcctcaccatcaagtgtttacagaaacttcaatgaagcctttgcacttgtgtgtgttcaatggtttgcttttcctacatagaatctagtttggaagttatattggctgttacagaccttgtttgctcctgagctatcatgatatttccacttagcttaatatgaatgttttagaagtttcccactatggaaagttctatttgacatatgaaagttcaacggtcaatttcatagtcagctccacggcaagaaataaataagacaatggattacagagtatagccttgggacatgggaaattttttagaagatggatgagtcatattattaatacatgttgcaaggcccaaggccttacatcaaaaaataaggaaaaaagtttttattttttaaagttaatagccttctgatattttctttgttgtactttgtatagtttttgttctgtttagttttggggggatcaaaaaataaatcctaagatagaatgttttaggaaaaaggtaattaacatcattgtacatgaatttgctcaaacacagtaaggtctgaaaaaaaaagatctctttgatgttgatttgtttgaataattactattctcccagtactgcacttttgagagggaaggagaaattgttgctagtgtctaaattttaacttgtcttccttggctaccttcaaaatttgagatccttaatcttaaatcacatctggtctaacaattcttcctataaacagttatgactatttactgacaaaaggctgcttttattgtgcctgtttctatttcagaggaagacacataaagacaggtggaaagaactgatttgtaaagattgaaatgtcatatttacattcagaatttcatttccttaccagttttcagaagaaccctttggtagaggaagcagggccaacttctttcacagcctcttactatagatagaagtatgaaggccagcaatatttagctggtatgaacccatacagctgtaccaggaacaatgttgaaagtctttgattcctattggaaaatagccactgttaaagatggacaccttcaggacctcacttcagcattgtagccagtatccgttctgactaggtggtgcccacgcctcactggctgttctgtattttgaatatttagtcctgattctagaaatgacatttttgggctatggataaaagatgggtttcgatagccattaaggaaatgcaaatcaaaccacagtgaaatgtcacttcatacccagcaggatggcaataataaaaaagacaaataataacaaatattggtgaggatgtggagaaatgggtatccacatacactgctagtgggaatgtaaaaggatgcaactttggaaagctgtctggcagttcttccaaaggttaagcatagggttgccatatgactcagcaattctacttctgggtacacacatacacacacacacacacacacacacacacacacccgccacacccaagagacatgaaaatgtatgcccacatcaaaaacgtgtacacaaatgctcatagcagaattattgatattagctgaaagataaaaacaacccaaatgttcatgaactgataaatacataataaaatatggtctatcaatacaatggaatattttaaaaataaatgaaatacccatacataatacaacatgcatggacttcaaaagcattatgctaagtgaaataagctagtcacaaaaaaccatatactgtatgatttcttttatatgaaatgtacagaataggtaactctatagagactggaagtagattttagtggttgccttgggctaagggatgggggtcgattgtggtgatggttgtagaattctttgacaatactaaaaatcattaaattatacagtgtaaatgagctaattgtataatatatgaattatatatcaataaagtttgatgcaaaaaaagatcaatgggtattgactatgggacatcatctgtatcactgtgcttttcccggtctccctccctgtgacagtcctagaagacaggtgaagtcagcccgtccattttacagatttggagactgaggcttagagagagagagagagtattttgccagagtcatacagctactagtctaaggaaaatgcagagatgaggaggaggagcataggggaggtactgttagtttctcttttctgtatcatagtacagtagcaggatgagagacacctttgaattcaaacctgtgtgtatcctgacaaagatacatattctatgaaaagtctttgctaataagtagaagatttctatttcacaacaagcaagaaaaagaatgagagaaggactagaaagtagatgtgatcatatgaataatgattttccttgctttttgcatgtatgtggtggacacatgcagaagtgacagcaggagttcgagaccagcctgaccaacatggtgaaatcccgtctctactaaacacacacacacacacacacacacacacacacacacacacacacacaatagccgggcatggtggtgggcacctgtaatcccagctacttgggaggctgaggcacaagaatgacttgaacccaggaggcggaggttgcagtgagctgagatcatgccattgcactccagcctgggtgacgagtgaaaaaaaaataatgataataaagagagcaaggtgaccacaaaagagaataggctggaaaaatttgtctaaatggtggcctcttctcttatagctgcatatggttaagtttattttttccctagtagcgaattctaagggatgaagaagaaatccttttcagttttacttccccaaggtgtgtataactactatagtgaaataataagtccaatttattctttgaagtatagttaatatgtaacgaaactcctaaggccagttgtatacccagggcaaacgccttctaacatctttatttatctacgcagtgggtagggaggtgggtggagtgccccttcccagctgatactgtcaaaacaggaagcaaagttataatctctgtcataggaacatgaatagaggcccttagttgtgactattaaaaaaacaaaaaacctgcctaaggagttttcactgactacaaagtgtaacttcctctctggtgtttagaggaggtggggttaggtttagtcagatcctctcatgggaaaaataaaagccaccaaaaaaaaaaaaaaaaaaaacccaaaataacacaggacatcccagtgtgcagttcgaaggctgcttttgttgtccacttcctccacatctttttcctcatcatctaagcagatgtaggtgatgagcggcctggcagccaccacgtttcattggaaaaagtgcagattggatttgccagggcatgtagctctccaggcttgcaagcgattaccaggtaagtttgtcaacttgcacgactcccagccagtgaggttttcttaagaaacgtctatgaagacagggttctttcattcagttttgttaagtaacaaagcttaggaccaggctggtgacgggaacagacagcctgtctttcctgctgccacgtctgttgtggaccctcaagagtagagaccaacgctgtctgcttcacacttctcttcaggaagtgataattcaccagagttattagtttctttggaagaagccttccaggatccctatatttgtggtagcaaatatgcttcactttacctccctgtattttcaaaatagcttactctgtgctgtttactgccatctagagaagaagcctcctttgtggtgttgagtattggtagacctcatcccatattgtatttgatttactctgttggctaaaaaggcattttacttcttgaaatatttagttttgacctgagaaaggggagaataaaacgtttgtactttgggggacagtatgagtgctggggtttctgtttcagtgcaggcttgtctatgagacatgcatatgcataacttcatgcagggaaagtgtcgtgcacttttctctcgctgaagtttacttccggggtgacttagtttttctgatcagtttagatgttcatatcttgtttaatgtatacatgtgtgtactggttgtatgagcttttggaggggaaaaaccccaagtgatgtgttttattcgatcatacatatcatgcatgaatgttgtcactatgaaaaaactttgagactggttggttttctttttcaatgttttcctttcttgtggaattactctttccctcttaatgttttccttcttagcttcagtgaatgaggtggtaaggggttgtagcgttgtctctgcagagcaaattcaaaccaaaatgattggagcagcccatattttcttagtgaattgggtttcttgaacaagtggcataggagactggtgtgctacaattctcatcattaactgttacttctttcttaaataaccatgtgatcccaacacaacatcaaaatacctctcagggacctgaattaaaactccacgcgggccaggcacaatggctcatacctgtaatccaagcactttgggaggctgcggcatgaggatcacttgaggcctggagttcgagaccactctgggcaacacagggagattccatctctacaaaaaatttaaaaatcagccaggcatggtggcatgtgcctgtggtcccagctacttaggagactgaggtgggaggatagcttgaacctaggagtttgagactagtgagccacgatcatgccgctgcattccagtttggacaacagagggataccttgtctcaaaaacctgcataggggcagcaattgcaggcttgtggcctttcgaagatttcctttgattgtcactaaatcctctctctttccccaccattaagagtctctgtggtcagctagtcttcatcaaagggtcttgctacaaagggtctagggtaaccttaatgattgaaatcagaagacagctagaagaaaagtacaaacaaacctttaaataataagcaggctttggccgggggcggtggctcacgcctgtaatcccagcactttaggaggccaaggcaggcggatcacctgaggtcaggagttctagaccagcctggccaacatggtaaaaccttgtctctactaaaaatacaaaaattagtcgggcgtggtggcacgtgcctgtaatcccagctacttgggaggctgaggcaggagaatcacttgaacctgggaggtggaggttgcagtgagccaagatcacaccattgcactccagcctgggtgaaagagcaaaactctgtctcaaaaaaaaaaaaaataaaataaaaaagcaggcttttaaatgagtagctacagtgttaaatatatttaaatgctgtgctggttgagttctggttcatttagataacattctttcctgccctatgaccaatcaaaaggctttaggaaaatagcatttttaaaattaaaatgtatttcagtgcatgttattttaataaaaatagaaaaccaatgtgtacatgatttccaatttcacaagggcctagattctcctctcatcagttgctattgaactgatttttttgtgtgtgtccatagtgtaggctctttagtcatcttgttagaaataaggacattaaatttaatgttaaaaataatattttcagccaggcacaatggctcatgcttgtaatcccagcactttgggagcccgaggcgggcagatcacctgaggtcaggagttcaggccaggagcctggccaatgtggtgaaacatcgtctctactaaaaatacaaaaattagctgggtgtggtggtgggtgcctgaaatcccagctacttgggaggctgaggcaagagaatcgcttgaacccgggaggcgggggttgcagtgagctgagattgcgccactgcacttcagcccgggcatcagggcgagactctgtttaaaaaaaaaatagatctctatctctatcactatctctctgtctatctatgtatcatctatctatctatctatctatctatctatcatctatctatctatcgatctctatctttatccagctgtatcatcattttcactagatgctaacaataatataactgagataaaccaaagtttcaaaacaagcttgaaaatgtgaaatgaataatttggaggcgggactggccatttaggcatctatgaaggcccagatgactcatgtctggaaattgccactgctcaggaaaccactcctgggagccctgctcgttttgccatccttcctgctttcttgcctgctgacaggactctatgtcagctgtttcctttttagatggaagggttaaaagattcactacttgggtcccccattagaatcaccaacatgcttgtgccccacagtcagagatcgtgacttgattggactgaggccctgctctgtagcttgtcaaaagccagccaagggtgtccaatgtggagggtacaggggaatgtattcgtcccccactagactgaaagctccatgggagggagtagaggcagctttgttactgctgcctcctagcacctgaatgtgtgcctgatgtgcagaagaggctcagtagctgcttgtggaatgaatgaatgaattagttcctttgagtaacaggaagttggaagaagattggacagaggcttagttatggtctttgctgatgtaggagagtgtgctatgttaggctgaacagtggctgtcatcttggaagacactccaggaaaaggtcacaggggaacaggtggctgatctgggggaatgctgaacagacctctcagaagagacaaggctccagggcagtggtgtccttatgaggcaaggcaggttgagaactttgggaaagagaatttcatcaggggctgagtgtgtgtgtgtgaatgtggatgtgaggccagatggggacactcctgggagaatctcctgaactgtggcttattctttgttttttttttttgtttttttttttgagactaagtctcgctgtgttgcccagcctggagtgcagtgacacagtcttagctcactgtagccttgacctcccaggctcaagtgatcctcccacctcagtctcctgagtagctgggactataggtatgtgctcccatacctggctaatttttaatagtttttctgtagagatgggatctcactatgttgcccaggctggtcttgaactcctgagctcgagtgatcctccctcttggcctcccaaaatgctgggattacaggcctgagccaccatgcccagccgtgactcactcttaaaggagctcaagtcttttgtgttggaactccaggaggttgacgaccacactcatctattcagtcagcatttgctaggtacctagcacacgcccagctctggggaggtatggggatataaaaatgaaggtgatttgattcttcccccgtggaggttaggacctggaaaggatggtgtgtgaagtgaatgctaggtttgctggtggctgaaaggaaggaacgttgtcatctttgtcatatgttagggattgccagacccaccagttgactatatccaaataaaggaacacagaatttggagtgatcacagggcagtgagatttgtctgggaagatatcttaggactcgtgaattttttgcagatcttaataattatagagaaaatgagtaggtggttaggaagaccaggtaactataacttacagaggtgagagaatgagaattgttaagttgggagaaaaagagtagaaagagcgacatgtgaaagaaaagaatcggccggtgcggtggctcatgcctgtaatcccagcactttgggaggccgaggcgggcagatcacctgaagtcgggagttcaagaccagcctgaccaacatggagaaaccctgtctctattaaaaatacaaaatgagccgggcctagtggcgcatgcctgtaaacccagctactagggaggctgaggcaggagaattgcttgaacctaggaggcagaggttgtggtgagcagaggttgcgccattgcactctagcctgggcaacaagagcgaaactccatctcaaaaaaaaacaaaaacaaaagaaaagaatcttgggtggagaaaatgagaaatgggattaacatggtactgagcagttcttttttttttgttttgagacggagtctcgctctgtcgcccaggctggagcgcgtgatgggatctcggctcactgcaagctcctcctcccgggttcacgccattctcctgcctcagccttccgagtagctgggactacaggcgcccgccatcacgcccggctaattttttgtatttttagtagagacggggtttccccgtgttagccaggatggtctggatctcctgacctcgtgatccgcccgcctcagcctcccaaagtgctgggattacaggcatgagccacggcgcctggccctgagcagttctttaagggatgagacttggccctcaagatctgggtttccattacccctgccatcgtcagggtaagtcactgaacctctgagaaggggactcccaaccaggaggatcacaggatctcccaaccagggaggatgccccgggagagtgtggtcaggattcatgatgttacacattttaaagttctttgcaagctatagtaatagttccaggtaaataaatggaataataaattctgtaaaaattataaaaacctagtctgttgataatgggctcttttaggtagagtctagggtaggaaatcaaacattatattcatcatggtacttgaaatatatttaagctgaagctgtgcactccatcatgtttttgatatatttttccttggcattacttgaaaggcatgctcatgaaactggatttggatctgtttcatgttttcacttgcgttctctgacccctacttagagggcaccaggtgcttcctattctaaccgtttgcaaattcaagacttggttggagggccattcaggggactggtgtggggttagataggatctggacacagcgactccctcgctcctgctccagtattttgaccttaatttgaacagttcaatgaactggcaactgaagtcgttttttcccactgaactagacctttcattgttttgcagaggaagatgactcatagccaggttctaccattgtgctaaagtgaaattttagtctaggactaaaggaacacaggccaaactttctgtctgagctgcagagtattgaaacttagattgtgagctgggcaggaattcctgtggccctctgtgtggagttgctctcaaggaaaaggagcatttaaatacgtttttgactccaaatttaatttttagtaatatagttcaaatgtcctttaaaatatcttaagtaatcagactgttttctaaaaaaaaaaaaaatgtaatgcaaaatgaaaattctacaaagtagaaaactgtcatttccttcctctctccaaaaccattgttaatagtttcgtttcttctgctacccttgttttctatgaatgtaaaaatgtatgcctctatgggtgagcatggcttttcttttttgaaccaaaattgaaaccatcctgatttagtggcatcccacttaaaacattattaaaaactacctgtgtacatgtatcttcgcttacttgggcaattgctggggcaaatatgcttttactgttaaatcgtcatctacaacagatgacatgtagagagatgaaatgtagtctatagttgtttgaacttgcatttctttttttgtggaactgaacttctctgcatatgtttattggctctttggacaaattcgtcagtgatttggcttttcatgcattgctcattttcttttgttgcttggatccctgacttttatactcttaatgattccaagggaaattcctacaaaatggcagatttgggaggacttatttgaatttcttttgagttctaaaatggttaactgctaccttaaaagatagatattattttcagatatctaggacagaggtttgagtctttggacttagattctatagtattttctttctttttttggctgatatggaagacgtcatcatcccaaactgtgctgagactagtagttatttagatacactattttattacattttcgtatactgataaattatttccatatggatggtaagtcccagatttatttatgaaaaaaaccattttttatatattttatggaacatggagttagcagaaagatgctgtggagttaggcttaaaattaagccctaactattctgcctcctgttttggggctgttgtcagtctttaaaggtacatctttgtaaaattttttgaacataacttgacagattgcaagaaggattataataaatggtgtctgtttgtgttagagtatttcaagtcagtacaggaaaaaatacatttagatgctaagtgaagataagacattagtttaaatgaggccccgtatgcaccatcatattgaaaatttaccagtgtgtcctcgtccttcaatttagattcgttagtgatttttcacatcaaagcattgaagctgtaattctatgttgggttcatttaaccacagatccagtaaatggcaggaaatagagagctatacaggacagcaaatggcctgcagttgtgtggaggatatctttgtggcaagatgccccagatgttttgctgttttcaaagtttgctatcatttgttcagaaaggttttcattgcttgcaagcaagcaggcaagcaaaggaaaagggcacgcagccgcctcccctatgattctgtgctctttgcctttgatgccttatataaaaagctttatttagtctgcagagaggttatttctccaaatagaggtgaactgtcatagtagtctggaaacgtgatagatttcagttgaatgccgctgatccaaatactctgaaaggctgggctgtgtggcacttgtaagataggcaccttgcacagattcttccaggtcacttgcacatatcgccagtagaaatacctcatcagatagcgatccacttggcactctgagaagcaactcctatcacaccgacactgctacttttctcctggctcagccagtctcttgctgggaacctgctgccagagttagtcacttggcttctgccctggcctattttcttgttgacttctggattctgtgcctttagcttctccttggactcattggccattactctctttctggtgttagtagctcctagactgtgtttgacagaagaaatttattcccctagcaaattcactttctactgaggtaactctaacccacccatgcaatctagcatctgccaatactctgagacccactgattgttaatcagtatttattatctaactctgagtaacgagtgttatagcaggaaaagtagaatcttttttgtgtgtgtacgaatgtggtttaagggacttttggggatagaggagaaataaacaccttgaaatgaattattatattttacctttgcccatgtgaattctttaaaataattattaaattctcactttgcttatatgcattaaaaatttcatagtgatggtatttaaagagggaggttatggacattttgcaagttggttgaggcaatagttctcatttcccttttcatgtcccacgggacatgtcatatctgtctgcctccctcctatgcatttctcctgctgttgcaaggagaatcttatgttttatgatgaaaatttatttggtgactaagtgaagtgtgcactattcttttaaaaagtccttgagattgcattctgtatatttgctgaatttgttactaggccttacgctgcaacatttctgagtaatcaaatctaaataaaaataaaaggtcgttcaaggtaaatctatgtcttgattactgaaataaagtattgacatttatttcccataatttgggaagttattcagtaaataatatttgcctggtgttttataatgaatcatttttatcatattgggtttgtgttaggaagactgtcagcattgattttccagtagttttctaaattttctcatctatttatgtttcttcttcttctttttctttttttctttgagacagggtcttgctctgtcaaccaagctagagtgtaatggcatgagctaggttcactgtagcctcgatctccgggggtcaagcagtcctcccacctcagcctcctgagtagctgggattacaggcatgtgccaccacgctcagctcatttttcggattttttttttatttgggtaagagtctcgctctgttgcccaggctggagtgcagtggtgcgatctcagctcactgcaacctccccttcccaggttcaagcgattcccttacctcagcctcccgagtagctgggactacaggcgcatgctaccatgcctggctaattttttgtatttttagtagagatggggtttcaccgtgttagccaggaacgtcttgatctcctgaccttgtggtccacctgcctctgcctcccaaagtgctgggattttaggcgtgaaccaacgtgcccggcccttctgatttttttttttttttttaaatagaaacaaggtctcactattcccaggttagggtcttgaacttctgggcccaagtaatccttctgccttggcctcccaaagtgctgggataacaggcgtgagccactgtgcctggctatttatgtttcctaattactgcagtgctcatgtttctgtcagcttcaactatgccacacatgactaggaattagaaataagaaaacagtaaccagcctggccaacatggcaaaaccctgtctctactaaaaatacaaaaattagctgggtgtggtggtgagtgcctgtaatctcaactacttgggaggctgagggacgagaatcgcttgaacctgggagtcggaggttgcaatgagctgagatactgccattaaactccagcctgggcaacagagcgagactgtctaaaacaaacaaacaaacacacacaaaaacaaaaacaaaaaaaccaaggagccaaaaataaatgactcagtgaacatttattgagcaactgtggtttgctgggtgctgcggtcgttgttgtgaaggtgctgggatgttttaaagttggttttaaacttaaggattctacttactggcagcctagaaccactgcatatgccttgcagagatgatgatggacacttgtgtcctcacctgtgcagtgcaggcacatcagtgaagagccttagattctcattttgcaactgttttcacacttgggtatcggtttctagatctaaagcagtaaatgagaaaggcagtgggtgtgaatgctgctataaactgacaccctgacaataacgatatgcttgttgacaggctgattgcagaggagatgaaaaaataaagggcagaacaaaaaagtctcaaagctctgccccctgcgtcagtaggaagctgtattttgctactcaagtagactaacattggagaaataattagcaagtgaaaaagttcttccaccgaaaggacaatgcaagttaaggcaggtagtctggttttctgtgctgcagcatccaaccacgttctagaatcctgttttcatattttgttggacccaactggattaaaacaaagcccctttctctggctgggtagtggcccgagttaggcagtttccagtgctctaattggtactttggagccagtgtccagtgactttcagaagcagggtaaatgttcttggtattgagcagttctctgctggatgccgggcctgtcctcatggttcatgctgcccttagatcatcagccattcactcctatggtcggtcaaggacaccttctctaggaattctctgctgacttccaagtgtgggttgggtgcccctcttctctgctttctccttccctgcttggattaaattcagagattctaagatgtcttcatctgtcacaacattcatgatggatgttacccatcagtgtttttgaaaacgaggtctatctctgcacggtgttgaaagataggtggaacttatcttttaataatctcttcaggtggtcattgtgtatgtttgagaacctctcctttagaccatgagcctgaagaaagtcctgttcttgtctttgaatctttaaaccttccctagctcctggcacgttttttagttgctcagattttttgttgtagttcagtgaatgaggtagaattctggtaatttttttgttgttgttcggtgaatgagatataattcctgttaaaaaatgtgtggaaagcaggtatgcctatggaatccaaatccagcaatgtgatcaaaagccgcttgaaggattttcgaacatttttcatttctttcttttttttgagacagagtctctgtcaccttggctggagtgtagtggtccaatctcggctcactgcaacctgggctcaagggatcctcctacctcagcctccagagtagcagggactaaaggcatgcaccaccatgtcccactagtttttgtatttttggtagagatggggactccctatgcttctcaggttggtcttgaactcctgggctcaagtgatatacctgcctctgcttcccaaagtgctgggactataggcgttagccaccatgcctggcccattttttcttattgttttgtaaatcaacattatgtgaaacctaaaatttaatatggatatacaaaaatagcttttttattttcttgcccaagaaaataaactgtatctttattatttatatttttgccgttttgaaataagccttttattttagaataattttacatttatagaaaagttgcaaagatggtatgtaaagttccccagttaccactttttgccactgttacccagttttccccactgttaacatcttgttacccagttttccccactgttaacatcttacattactatgttacgttgatcacacttagtgaactgatatcaggattgttattattaaaggctttaagagttattgttgaagatttataaatttatagatgaaataatatttagaacataccaaattttgaattagaaatattttaaaatttgaattctttgattttaagaattaaaacttttgaattcttatatgtagtcatagttgggaatatatccacaaagcaagtagaccaattcttgtgagaatgattctgaaacaggtttttcagttgtcattagccttctggaacctcaaaagggggaaggttactttcaaaggctaacattcatttaatctatctgtagtactccatatgaatgacaatcattacttatcgacatctcaggttttgttagatatgatatttgttttaattatttatggtatattcaggcagaggtgctattcaaaatatttaacaggttggcataggcctcaaccacccagactgctgttcaagtaatcagaagggatgctggctggtgaatgtgtcagtcctattaactgacacatttctattaatgtctaaaatgtcctaaaaatgtctccagatattgccagatgtctcgtaggtggcaaaatcacttctggttgagaactcctgatataaagcagttagaacaggctggcactgctctagtaactgctttctaaatattcactattattattgttgttggtatctttcatttgttatttctgataacttttaaacatacactgcttagccccagcactttgggacgtttaggtgggtggatcacttgaggtcaggagttcgagactagcctggctaacatggtgaaaccccatttgtactaaaattacaaaaattagttgggtgtggtggcgaatgcctgtaatcccagctacttgggaggctgaggcaggagaatcacttgaatctgggaggtggaggcagaggcggaggctgcagtgagctgagattgcaccactgcattctgtcttgggcgacagagcaagactccgtctaaaatatgaataaataaataaatatatgtgtgtgtgtgtatgtgtgtgtatatatacatatgtgtgtgtatatatacacacacacatactgtttatcaagacatattaggatttctttatagttaaatcaccacatgcataaaaaataaagttacatttttttgtaagatttactcagaatttgttggagacccatagcctgttgtaggaagaaatgtaagttctatttttgagggagattttcagccttttttacttgccctcacctgccatgttcctgacactgcagcctcgagaaaggtttgagactgttggagcacatgggtgtggaatttgtagaccacttgttcttccagacttcctcacacccacccatagcctgcttttagttgatagtggctcagcaagggtaggagcctgtactttggctcataccaaattcccctcatttccgcacgatgatatgttattagtattctgatccctgttatttgttaagttaagctgtgcttcaggaatctcagaagatcacagcattttgttttcagtgacttcatttcataatatatgctctgggcaggtgagactagacttagagacattgaagcccaacaatttaatatccacaaatagtgttttatttgtagtcttcctatcctttcctcttcggtgttctagaaacagatgcttacattgtgtaaacactccttctgttactgattctatggtatccattttcctattaacaggatgaagattttgttttttcatcctcaagtctacaagaacggaatagtcagtgggatatgaggatcagataaaaatccccccactttagaatcactgatcttagtacttcctgcagaaactctgacagccttattttttttcctcctttgaatccacgtaggtgtttttgggaaacatttatttgctgatattggttggtaataataattgttatttttatttcaaataagatgctgctggtaaaattattgtgaagtctactcaacttagtaaacttatatcaaaagccaggttttacatctggtagaacagagatagtcaattccttgctgtagggagaggaagggtaggagcctgtggctccctccccgccatcttgtccccaaccattcttatacactagtttgattcaagcacttgagctttggagccagactgcctgaatttggattcagctacttttacctgggcaaactgcttaactttaaatgtctgtgctctttgctgaaaaatgtggacaatagaagcatctatcttatatggatattgtgggtattagactatatggtagtccatttaagaaacgttcagtaaatgttgctcatagtaacagcaataatgttactactcctaatatgactgctacttttgataaatttagaataacagtttaaattaccatatatattaaaactatgtgacagtctaaattatcttaacagttgaaataccataacagtgtgtatacacacacacatacatacacacacactttgtataatggagctgctaaaatgaatcaggtttagctgaattgaaatttgattctttttgcctatttgctataggtgatagtgagccatgaaataagtaaaatacagaaggaggtagatacaacatttagattttttagccttacgtgaaacagttatggcttcagaatttaaagcaccaacatttggtggggtcccatggaaatttttattcctaatttcttaatattaaccatcttcttcatattctattaactcttgtgttgtttaaaaaacattccagtattctttctttctttagttttttgagatgggggtctcactatgttacccaggaaggccttgaactcctgggctcaagtgatcctcccacttcagtctcctcagaagaagattccagtattcttatcttcattgttgagtgctttttcttttaaaaattgcaataacattttaaaaattagaaaagaaagaagcatccatttctatttctaccatattaatacaacagtaactttcatttgttattttcccatctagtctttatactcatacttaaaaataattggaattatgtaatatttctaattttagttctggtgttttcgtttgacattacttcataagcattttccatttttttctgttaggtagttataccatcatttatttaatggttttcctgtttttgtttttagtttacttctagtttcaacattatggataatagtacagcgaaaattatctttattgatctgtaaaatggagataatacaagtactccagggctgttgtaaggattatatgaggggatagatataaggcaggtttgtccaccgtgagacagttccattttgctgtggaagctgtcctgtgctttggggatgctggacagcatacctggccgcttttccccagtggtgacaaacaaaaatgtctccagacattgccaggtgtcttgcaggggcaaaaccactcccagctgagaacccctgatataagtcagtagaacagcctggcactgatctgatgagtgcagtgtaaatacttgctactattattattgttgttggcaccatccttcatttcaggtattcatttctgataaattcccagaaatagaatttatgggatgagaggttagttttagggtttctgatacgcccttcagaggactgtaacacgtttaacgtcatcagtttatacaaatatgccagtatctctgaggcccagccagtattgaattgtgagtacccaaaatactgttttgtcttcaatttctgtaattactagccatgatgagcatctattatattttttttatttgcattgccacatttgaagattctggtaaaaacctttgtctacgcatcgttttttttttttttcttttttagttactctgccattcaacagttaaagttgaaattcatccctcagtagctaagcctgtattacatttcatcgcttgatgtttaacagcctctgagtagaacattgattgagatccttttggattattgtgtttttcccagtgttgctgcataatatgaaaccttccaaaatttgaatataaggataattttgtggaaaagaattcaactttgtattcagtgatatatgtcctgtaacagaaatgattgcctctggtttcagtacccttttatttctcttttcttttcttttttcccttcccttcccttcccttcccttcccttcccttcccttcccttcccttcccttccctcccctcccctcccctccccccttccttccttccttcttttttcctttcctctcttttctctctttcctttcttttctttccttcttcctttcttcctttctttgtgtctcacttggtcacccaggctggagtgcagtggcatgatcttggctcaatgcaaccttcacctcacgggttcaagggattctcctgcctcagcctcccgagtagctgggattacaggtgcctgccaccatgcctggcgaatttttatatttttagtagaaacggggtttcaccatgttggccaggctggtctcaaactcctgacctcaagtgatccatccaccttagcctctcaaggtgctgggattacaggcttgagccactgcaccagacctggtttaagtacccttttggagataaccccaatcctagctgtagcagaggctgctattgaccccactccctgctgtcagtacttctggtgcactgggacttccagctgcccacaccggcatgcctttgcctgagggcattctctggctggaaagttcacactcagggctggcaggaagtgtcagcgcccagcaacccatagccagtgactgctgctgtagtataaattctccagctctcttgcatctcaggtcgcctacttttgagatgaacattttacactgcatctccaagttcccagttgggttgtgatcgaatggtaacttgcttgataatgacctttttattattggccacctttccttctttgtctcctttctctactccctagcagtgtttcctgggatcacttctgaaataaactacttatatttgaatccttgtctcagggtctgcttcttgggggaaggaccaaactaagatattattagccaacttttcttttgactttgattgatgaaagaagaggaaagatcagaccaggagaacagaaatattttgaagacctttctgtataaaaagtaatgaatttaacttcaccgattcaagagacaggacagtaaatattcttgttatgctgcttcccagggtgtcctaagaaagagtcttcagattgtactatgggattaaagccatggcagatggcacttaatgtccctgactaatgtgactttccacccactttctttacaccatagtttgactcaggggcttgctggatttcagaaagactagcttgtagtttgtggctaaaaagactggctgatgttaggaagggggagaaacaccttatgtgttgctctactaattttgtccttgattttgagctaattattaatgctccagggaaaaattttagcttggcaggcagggaaatattagtttcaattgtgagcttaatccagagggctatgtttgagttaaaaccatccaggagtcttccagggaagtccagaatcttccagggaagaccaggtggatctatttctggatgctaaaaggggcattgcggggctgataaggaaataagtcccttgttctttaaaaaaaaattatttatttatttatcttttttagagacagtgtctcactctgttacccaggctggagtgcaatggcatgaccatggctcatgcagcctcaaccttctgggttcaagtgatcctccctcctcagtttcccaagtagctgggaccacaggtgtctgaaaccacacctggctaattttctttctttctttcttttttttttttttgtagagatggggtctcgctatgttgcccaggctggtcttgaactcctgggcttaagtgatcctcctactttggtctcctaaaagtgctgagattacagatgtgagacacctcacccagccagaactgcctgtttcattagagagacacaagtcaattcctggaatttttttttcctttttgctgccactttcttacttaaaagaataaaaatcaaagccaaattcatcatagtaatcataataatggcaacaacaacaaaaaaaggagtaaaatagagttgtgaatgtttgctttgttattaaacatatcaactcattggagctgatttatataaagttaaatcctgctagaatagctggattccttcctacatgggtggggtgggaatgctgagatcctggtgtgggcattccatgccagggtagaaatttcctgctcaggcacttagtgaaggagccaactgagggaggataggtgatgtgcccgcccatccggtggcacccagtgacctgtgcacaccaccccccatctgcccaggacccagccatgttgttcattgtacccttttcagactgctgacctccaggagcacttgtcttaaagtcacatagctgtatttttcctctccagaaaaattttgaatgtattttctaaatagctgaggtcattgcatggtcttcagtgaacttagctacaagtgaatgtgacctggagtgacccagagtgagtgctggccagcataggtttcacattttctgtgtgaaagttcttcttttgttgtttgtgattaataactggatgggatataaagccaaatgatttcattgttgaacacagacttgaaggtcatgagaaactgcctgttcaaattacactttgccaagacatggaaaaaggtctgcatcaacacctgaatagttttagaaatacggtagagaaggaaaaaaatgacatgccacttgttatgtgatgtgaaagttgatttccacgcgatgcaatatcttgggtccttacaacatctgacctatgaggctgatgagtttgcactgagtcaggactttaaaacaaaggtgtattgaggacctactgtgtgccaggtcatttagaatgagtttttatgctaagtaatgtgttatatttatgcttattttgttaagtgctcagtttctcttaggttttgtattatgtgggtttgctattttttaaaaaaatatttttaattttttgggtatggtttgctatttgaaatatgattttgaataagtttctcagtacatagcacttttaattttatgtttttaaaagattttttaatggttatacataataattgatggacacacaatagtatttaaatctaaaaatagagaaaccatggcacacaaaacacagtatcttacagaactgtattatttgcttcttttctatgtgttttctaggcttttgagtcagatgttaggaaagagtctgtccatctttaattttctcacttcgagaagcactgaaatatttctatacatatgtccattggtatagcgacctaacacaactttaaaatcattttgaaattgacgcacagagagcttggttttccagaactggtgaggtgtaagatggttgaggactgacttggcctggtcggacctgtttctttgtagcattattactatttgtttattttccacctgggccttacatcttccctctcaagacagcgtctaggtcccaactcagttggtaggaatttgtgcagtagcaaacctgcagatgggcagagatacaaactcactcaactcacattacagtctttccctgtctaaaacaaacaagaaaacaaaacaaaaaagggagagatcatataggcgtgtatatatacaatattttgttatagataaggaacaaagtaccatatgaattcaaaaggtgagggtgggatgggtttagagctgggagagaaaccatctaaagccttcatgaaagggggtaccatttgctgtggatactgatggcaatgttggggctggaggaaaatgttccaggtagagggcacagaattaatagggggtagctataaaaagcatgctgaataccatgctaggtaggcatttagccctgtagcatatagatgtatctgaatttaaaggcagtgggtgatgttcggaggtttggagcataagatattttgtgatcagaagaaggtgaatctgtcagaggtgtttaggaagcaaatacaagggtagatagtatgggaggttattgtagtaccttgagagaatgctattgaggacctggatgttgaggttggtagcctgggaatatctgggctctgttgatgaattaaattgagttatggcaaagctctcttcgtggatttcaatatttgcgattccactgcttaaagctgagctcactcttcttttcggtgtaactgtgatggaaggaacttgcgtgtgagagtctccctcttgttgggtctgtgctattggtttgttgattaggaactcaattggtacctgcagaaattgcctctgattgggacctgcttctccccactgtctcccttatgtttccccctgagaggtaaaaggagtgatttgggtcaaatgtcctttgttttgggttggtttgtgtgggatgactcctggtgtagattttgtgtgtgggtgctaatgtacttatagccagctggggctagaagctcaggcacccacagctttgctctccccacttcgcgtttttacttctgattttctgtttcccaatttgtgattcacaggcagggatgactgactgagaagcgttgcagatgagtccgtgtatttgtttcattttgtgattgtttcaaattagcacaaatttgatggcttaaaacaacacaactttactatcttacatttctgaaggttagaagtctgacacgggtcttactgagctaaaatgaaggtgttgacagggccatgttccttctggaagctccagaggagactcctttccctggtcttttccagcctccacaggctgcccatgtttcttggctcatggctctctttagtcttcaaaaccaacagtggtgggctgagtccttctcatgtggctcgttgctcgctctgctattcaactctcttccttttccacttagaaggccccttgtgatttcactgggcacaccaggctaacccaagataaccttctatcctaaagtcagttgattagcaaacaatactttcatctgcaacctcaatttaccccttgctgtgtaacctaaggtactcacaggacatgggcctcttttgcaagtggagaggaagaagatgtattattctgcttgccacattgcgtagctcttgattttcacttcttttaaaaaagaacatctgcagaaagaattgagagtggtggataattctccaatcattcctgctttctcctgaaataaatttcatgcctttcttttagcagttgatttaataattaattttaaaaataatgttagaagaagcttttcctgttcatgtgtgtgttatgatgcatatgtttgtctgatgaaggggaaaaagggaaggaatgactcaagtactttcaactttagggccagcctaggattggaattctggagtagatcatgaggaggagatggtcaactttcttgtgacaaaagcatgtacataaaccacttaggattctccacttttcacattttattctgaaattgcatgcttcagttaatgtgatttaatggttttctctcagtgtcattggcaggattgttactaagcgacaaacattcaccacagtgttcaaatgtacttgggaagaaaatgagtagccaaactaaaagtgggatttaaataactccaattttatgaaaagtgaagaagttcagagattacttaaggtatttttttggtgatctgtggattcaatgatcatttcgttcatggaaggaagttttatttttatttttttctgagactgagtcttgctctgtcacccaggctggagtgcagtggcgtgatctcggctcactgcaacctccgcctcctgggttcaagtgattctcctgcttcggcctcctgcatagctgggactgcaggcatgtgtcatcacgcctggctaatttttgtatttttagtagagactgggtttcgccatgttggccaggctagtcttgaactcctgacctcaggtgttccacccgtctcggcctcccaaagtgctgggattacaggcgtgagccaccgcacctggcctgggaatttattttcattaacttaaaatattatggcagctgatagagatgtatgtgcatcgcattctatttctgacacaataaacagcgtaatcgtcacatgaatataaaagttgatgtgttaaagcagtacagctcatgtttattcacttgaaagccaggagagtatacccgtgggagatgttgctatcaataaatttttacctatatatattttaactttgattttaagttctggggtacgtgtgcaggtttgttatagaggtaaacttgtgtaataggggtttgttgtactgattatttcatcacccaggtactaggcctaatagccattggttatttttcctgattgtctccttcctcccatcttccagcctctggtaggtcccatgtctgttgttcccctctatgtgtccatgtgttttcatcatttagctgccacttaaatgtgagaacatgcggtatttgatttttcgttcctgtgttagcttgctaaggatgatggccttcagtttcatccatgtttctgcaaataacatgatctcattctattttatggctgcacatattctgtggtgtatatgtaacacattttctttatccagtctaccattgatgggcatttaggttgactccatgtctttactgttgtgaatagtgctgtagtgaacatacacatgcatgtgtcatcatgatggaatgatttatattcctttgggtttatacccagtaatggcatttctgggttgaatggtctttctgttgttaggtctttgaggaattgccacactgcttttcacaatggttggactaatttacactcctaccaacagtgtgtatgtgttgctttttctctgccacttcgccagtgcctattattttttgactttttgataatagccattctgagtgatgtgagatggtatctctacttgcattttttttttgtctctttgttttttgtttagatggactctcgctctgtcatccagactggagtgcagtagcgcaatcttggctcactgcaacctccatctcccgggttcaagtgattctcctgcctcagtgtccagagtagctgggactacaggcgcgtgccatcacacccggctaattttttgtatttttagtagagatggggtttcaccatgttggccaggatggtcttgaactcctgacctcaagtgatctgcctgcctctgcctcccaaagtgctgggattacaggtgtgagccactgtgcccggcccctctacctgcgtttttaataaaggattatacatgagtcaaggatttgttaaaaaaaaaaaaaaatccttccaagataattatacatacattactcagaactgtcactttttttggttaattttacagatgtgaattttattttatagatatgttctttttatgactttcctcaattattatatagacaatgcagttgttgaataatatctaaattatttagaataatagaatattttctattatgcatttctgaaaaactcaagttactgttagaattaagtaaggattttgtcgtagacaaacagatgtagcgatagcatagtaacctactaggttagatactgcctgaatcttttgttcttatatggataaattctacgagcttttatttttcaaggagaaacttatcttcaagaagacagtaatttgttggcggggggcgaccaggagaaaaatcctaagaatgtgaaaacccctatataaggagaagtttctgtttctttctctttttttgagatggagtttcactcttttgcccaggctggagtgcagtagtgcgatctcggctcactccaacctctgccttctggtttcaagtgattctcatgcctcagccttccgagtagctgggattacaggcacccgccaccacgcctggctgatttttgtatttttagtatagatggggtttcaccatgttggccaggccggtatcaaactcctgacctcatgatctgcctgccttggccttctgaagtgctgggattacagccgtgagccactgcaccccgccttctgtttcctttattactgataatccttagtgatctaaagactgagatcctataagcttgttgctactttcccttttcatgtctcataaaaagccatggtacaggctgttgggaattatcacgtggacattgaagataacctaattctggccattgatttcttcagtttctttatcctgcagtgtgtagaagaaagaaaactgtgacatatatcaaaccagaaagacatatgacattaaaggaataacaagcctggcacagagtagatgctcaataaatattttttaaagcaatggaccaaataatttgttggtatatgttaatttgttaatttttatatgctagattccttgttttttggccttaggaaagagaaacatatctttaccattaaggaatatacatgataagcatggctgggtggctcaggcctgtaatcccagcgctttgggaggccgaggtaggcggattgcctgagatcaggagttttagatcagcctgaccaacatgatgaaaccccatctctactttaaaaatgcaaaaattagctgggtgtggtggtgcacgcctgtagtcccagctactcaggaggctgaggcaggagagtcgcttgaacctgggaggaggaggttgcagtgagcccaaatcatgcccttgcactccagcctgggcaactccgtcgcaaaaaaagaaaaaaaaaggattataaatgaataaatgataaggttttttaaagttagggtccgtttagtggcagtttggaaattacagatcaggatctaagagagctctaatgacagttcttttgtgacttacaaggtgtctttttactgtgtttgacttaagggattttgttttgtttggtttatcttttaatttctgttttgacctttcataaaatgagaccttatagaattctcttaagatagtgttcataaactttttttggattgagaggtctttaaaaaaattgatgtggaggttatagaatttctgcctgtgctcaaattcacatatgtgaggacatgcattatttttctcataactttaagaagtttgggaagtcactaaaacttacccagatctgttcattcgttcatttgattcatatttgtttattcatttctatggcttataaggtttgtaggaccatctgacagagtgctacccttagttgttttctttctttttaaatacaatattgtgtagttgtattttaaaagtcaaacatttcatcacataaaaattataacctgggctgggcatggtggctcacgcctgtaatcccagcactttgggaggctgaagtgggcagatcacgaggtcaagagatcgagaccatcctggccaacatggtaaaaccccgtctttactaaaaatacaaaaattagctgattgtggtggcgcgtgcctctagtcccagctactgggaggttgaggcaggagaatcgcttgaacctaggaggttgaggttgcagtgagctgagatcgtgccactgcactccagcctggcaacagagcgagactctgtctcaaaaaagaaaacaaaacagaaaacaaattacaccctactcctagtggggaaccctctgatatggtttggttgtgtccccacacaaatctcatcttgaattgtatctcccataattcccacatgttgtgggaggaaactggtgggaggtaattgaattatgagggcaggtttttcccgtgctattcttgtgatattgaagtctcatgagatctaatggttttataaagggcagttcccctgcacatggtctcttgcctgccaccatgtaagacatgcctttgctcctccttcaccttctgccatgattgcaaggcctccccagccatgtggaactgtgagtccattaaacctctttttctttataaattacccagtcttgggtatttcttcacagcagtatgaaaatggactaatgcaagaaatttgtactggtagagttgggtactgctaattaagatacctgacaatgtggaagtgactttggaactgggtaacaggcagagctttgaagaacttggagggcttcccaggaagatgttaatccccaagacagtggggaaaatggctccagggcatgtcagaggtcttcacggcagcccctcccatcccaagccaggaggtctaggagggaaaaatggtttagtgggccaggcccagggccctgctgctttgtgcagtcctgggacttggtgccctgtgtcccagccatggctacaaggggccaacgtatagctcaggccgttgattcaaagggtgcaagccccaaccctgggaggcttatgcatggtgttggacctgtaggtgcacagaagtcaagaattgaggtttgggaacctccacttagatttcagaggatgtatggaaatgcctggatgtccaggcagaggtgtgttgcaggggcagagccctaatggagaacctctgctagggcagcgtggaagggacacgtgaggtgggagcccccgcacagaattcccactggggaactgcctaatggagctgtgagaagagggccatcatccttcagaccccagaatggtagatccactgacagctaacatcgtgcacctggaaaagccacagacaatgccagcccgtgaaagcagccaggagggtctgtaccctgcaaaaccacagggtcggagctgcccaagaccatgggaacccacctcttgcatcagcattacctggatttgagacatggagtcaaaggagatcattttggagctttatgatttgactgtcctcctggatttcagacttacatggggcctgtattcgtactgaaaatcaagatcaagtgagcttttgcccttttgctccatgggatgtttctgtcctccctgagctcaccttaagacacctgcattactgtttgacaggtgtactgccccagtcaaactccccacctagcactgtccccagtcccctgactcatccctgcaagggggcctcccacttattctacacctctcatgtctcttcactgtgccagaatagagtcaagttcaacagggtcttctctccccactgactttttttgtttatgtgcatttactaacgtgagtattaaaatatgaatttatattgcctatttttaataaatacaagatgatattatttatattgtttacaggttttgtttttccttagctaaatatactgaattcctttccatgccagtattagtagatctagcatgcttttttaaatccccctattacccattatttaccatgaacctaattctacagacatactaaagttctttgcagattaacttttatttattttatttatgtgcttatgtttttgagacggagtttcacttttgttgcccaggctggagtgcaatggcgcaatctcggctcaccgcaacctccgcctcccaggttcaagcaattctcctgcctcagcctcccgagtagctgggattacaggcacgcaccaccacacctggctaattttgtatttttagtagagatggggtttctccatgttgaggctggtcttgaactcctgacctcaggtgatctgccgtcctcggcctcccaaagcgctgggattacaggcatgagccactgcgcctggccgcagattaacttttatatttcacatagctggtggcagaaataagggtagaagaaggagtgacagattggagtgatatcttagttgctaaaactctgctttgttcatcatctcagagagtgggtgcgtagggctggggaggcatacattctgaaaagagggggttgttgactaagaaataggcctccacctaacaaaacacccactgtgactatttacaatgtttgcatctcagcaaaaataccatttgtattctgaattcctttgtttcaactacataactcaataagaaagaaagtttcctacaattgaaaagaatagacagtgtttaaaggccaagttttgccttccttttaaggctgaatgtgctttattttaagccactcttcctcctcaagttaagaagggccttctggtatttctgtgcaaagcaccagtaatactgtttctttttaagttaatcatttttaatcctgcttattttatttagtgcctattgctatagcatctaatgagctcagcgcttctgacagtatgtcctatggatgcctgggggcagattgcctgggttggactctgctccagttcttattagttgtgtatgtcagctctgttttcccatctgttaaatgggatagtaatagccacaataatacctcatggctgttgtgaggattaaaataagaaaatgcaagtgaaagacagtccagaggatgggagaaaatatttgcaaattaggtatctgctaaaggtctagtatccgcaatagataaagaagtctttttattttttattttatttttttttgagatggagtcttgctttgtcacccagactggagtgcagtggtgtgatctcggctcactgcaacctctgcctcccaggttcaagcgattctcctccctcaacctcccaagtagctggtattacaggcatgcaccaccatgcctggctaattttggctaatttttctatttttgtagagacgtgtttcagcatgttggcccggctggtcttgaactctggacctcaggtgatatgctcaccttagcctcttaaagtgctgagattataggcgtgagtcatcatgtccagccaagaattcttataactcaacaatctaaagacaacccaattgaaaaatgagcaaaggaatagatatttctccagaaaagataaacaattggctaataattattgcccatgaaaagatggtcaacatcattagtcacttagggaaatgcaaatcaaaaccatagcgaaatttttctactttgtgcccactggtatggctgtaataaaaatggaaagaaatacgtgttggcaaggatgtgggaaaattagaaccttatattgcttgtgaaaatgtaaaatagtgtagcagttttggaaaatattttggcagttctacaaaaagttaagctttgagttatcatataactcagtaatttctctctaagttttctgcccaagaaaactgaaaacatatgttcacacaaaaacttgtacatggatattcataacagcattattcataataggcaaaaagtggaaacaaccaaaatgcccatcagccgacgaatggatcaacaaaatatggtcatttcatataatggagtattattcagccatacaggaaatacaggactgatacaagctgcaacatgcatgggccttgaaaacataatgctaagtgaaagacgtctggcacaaaaggtgacatatcctatgattccatttatatgaaatgtctgccactggaaaatccataaagagagaaagtaggctagtggtttattagggctcagaggctggcagggaatgggggagtaactgctaatgggtttctttctggggtgatgaaagtgtctggaattaagattggatgattgtcgcacaactttgtgcatacagtaaaaaaccacagaatcgtacatccgttaaatccggatggattttatggcgtgtgaattacatcccaatgacaaaaaataggataatagctgggaggtggtaccatgcccctaacatggtaagcactctatgtgttagttatttctgctgctgctgtcatcattttcattgttactacaaaatcaattccattcattattcctaaaaatatcaatttcttatggttatattatttctagttcttttcttcaaattacacaaatattagccactcagtgcttgcagaatattttcaaaggtctgcatttgtgaacaggtcctgggatggagagcctttgaattaccgtgggtgtatgtgttatccatttgcttacactgcatcttcttactataaaataaagtacttcttggcagatcatatggcatttatagatttttcttcttactttcttttatttgatttatataattgggtactctcaactcccgtgatggagagaaagcaaagaaaccaagaataggataacgctatggaatgcctcaatcttcttttagttttttatttttggttgaataattttagtttagttcatggaataaggtaaatattttacatttgttaataactccatactttgttctaggttcagtggcttacaaaaatatgtataacaaaacaaaattaaaaaatgaatcagtagagacaaaaagagcatggatgttaaaatgtaactaaaagatgccctgcacggtggctcactcctgtaatcccagcactttgggaggccaaggcgggcggataacttgaggtcaggagtttgagaccagcctggccaatatggtgaaaccccatctctactaaaaacacaattttttttttttttaggtggagtctcactctgtcaccaggctggagtgcagtggcgtgatctcggctcattgcaacctccgcctcccgggctcaagtgattctcttgcctcagctcccagagtagctgggactgcaggcacgtgccaccacacccagctaatttttgtatttttagtagagatgaggtttcaccatgttggtcaggctggtcttaatctcctgacctcgggatccgcccgcccctgcctcccaaagtgctgggattacagttgtgagctaccgcgcccagccttaaaaatacaaaaattaactgggtgtggtggcctgcgcctgtaatcccaggtacttgggtgactgaggcaggagaatcacttgaacctgggaggcggaggttgcagtgagctgagattgtgcctctgcactccagcctgggtgacagagtgagactccatctcaaaaaaaaaaaaaaaaaaagtaactaaaaggaaatacttaaaaaatactggaattcctcaatcttgatgaactatcctttccatgttttctcccatagttaaacaaggagtttttacttcttttgggcagtagctacatagtatgagacttctagtagtgcactatgctaacatcatcacacttgaatgttttttgaaaatattttacgtaaaatacatgtcccagatggactctattctttagttggttatctagaattaacatttggattatgtttgctaaatgcgtcagccatatcctaagcgctgtgatccttttagaactattaacagatgagactggggggcattttatggttataagagctaaatgatatttatgcaagtgtgtaaacattaataactcagcgtttataagcatgttagaatatttgattatggctagggaaatgcatattagctatctagcacagatctaaaagtgatctgggctatacctttcatttctggatttctttccttaagcttaaagggtgttctaatttcattattatcaatctcaagatcatttcacagtttcctggtggttgggtgtcatggtgactttttgttttccaggctctttgtttggatatgtggccttgtttgagttgtctttgattgctatatatctgtacccttgtttgcttttgcctggctactgattctcagtgtttcactttgacctttgataaagctgtgactctgattcatttttaggggggattcacctcgttggtggaatctagccttgccctgccaggcggctgcctgggtgttgcttgctggttggaatgtatccattgaaggccttagatgttggagtccttgcttcctagctccacctctttgtttcagggcaccactcttctggtctagtgcacagcctggtctctgtcaatcagcacgttctgcctggcgttttatggcatgttttcttcccccccacatagggtagcagcctttttataagttgtaatgggtttttgatacccactgtcatttttcttttcttttttttgagacagggtttcactctgtcacccaggctgaatgcagtggcacgatcacagcttcctgcagtcttgaactctgggactcaggcagtcctcccacctcatcctcccaagtagctgggactacaggtgtgcaccactattcccagttgctttttttaaaaaagttttttgggtcgggccgggtggctcacgcctgtaatcccagcactttgggaggccgaggtgggtagatcacgaggtcaggagttcgataccagcctggccaacatggtgaaacctggtgtctactaaaaatataacaattagctgggtgtggtggcgtgtgcctgtaatcccagctactcaggaggctgaggcaggagaatcgcttgaactcgggaggcgtgagttgcagtgaactgagatcatgccactgcactccagcctggtgacagagcgacactctgtctcaaaaaaaaaaaaaaagttttttgtagagacagaggcctcactatgttgcccaggctgatcttgaactcctggactcaagcaatccgccctcctcggcctcccaaagtgctgggattataggtgtgagctaccatgcccaggcttcccagtgtcattctgatttgaatttttctagaaagatttctagaatttttctagaatgattattgtatcctaaacatttatagcattatgttctttactttttattgcttagaaaaaaatagtttagttactactggtaatttgcaaattaaagaattatgtataaaattgctataggtgcctgtggttaaattcttttaccaagatttcacttctagagaactgaagaatttaccaaagtaaaaatggtctaactttattacttggtttatagaaatgaataaatcatagttaatagtacagtatattaataatactgtgctctaagctacagattagaaaaatatgcaccctgtttgtcacaataaatggagtgaccaaagctatagtatttcaaatctgtgactattatatatttttctataccaagtcacttctttttttgtttgtttgtttttgggacagagtcttgctctgtcacccaggctggagtgcaatggtgtgatctcagctcactgcaacctctaccttctgggttcaagtgattctcgtgcctcagcctccccagtagctgagattacaagcgtgcaccaccacacctggctaatttttgtatttcaatagagaaagggtttcatcatgttggccaggctggtcttgacctcctggcctcaagtgatctacctgcctcagcctcccaaagtgctgggattacaggtgtgagccacggtgcccggcctgtaccaagtaacatttctttctgtgtgcaggaatatacatgtgcttgttacagagttgagtttatcatattctatcaccatgtatttcccataaatctattaagttaaaatctgtgccacttatcaaagtttggagtgattacatatatatacataaccctatatgatctttgaattcagagccttgatgctagcctgagagtctgtgtgtatgaatgcaggtggcaagagtgaggcatggattgttgctattttttctaccggagtgccattattaacagtttcttttctgtatagtcactgtgaacactgttgtggggctgctccctgtgtgtggctctgcctcagaacccacagagtcggctggctcccagacctactctgtctctggttacaagtcagtgtcttatttactggaagttaaaagacagggcactgttgatttacactgtgcttcagcatgcccttattagtatttcttggttcttccatcagtgagtctctgatttcttcaccaaaaaataatcttgcagagagtcatgatcaaccctgtttttataaaacactgagctttggaaagggaaatgattactcatcacaactctaaacactaggataaaatgttcccatttagatcaatcaggggccaatttaattttctaatgaactttagaattgcttttgtggtctgcctttagggactattattataccagcttttcttctttttaatgtttctagaagtcaattttcatctttgccaagaattaaaggatccttaaacatgtggaaaagatgagaaaaacagtcagtggatcatcttgatgatgatggtcttgcaattttgcagaaggttgaaaaggcaatacatataacagattcatgttctttctattgaaatggacaagttagaggtctagattgaatacactctgtgtttagacttaataaacactttcaataagcttattcaatattttttaaattgacaacctgtattgggaactgcatatactatagagatcaaagttgacatttcttgccctcttgggcttacccaaaacaatatgtaatcaaattaagataagtactgggtgcacaaggaaggaaaacaggttgcctttagagactggaggagtcgtccagaagtccgctctgaagagaagatgtttaaaattaaacctgcaatgttcgtctgaattaagcaggttgagaacagggtgaaggaggcaggcatagcagcatgaaccaatatcccgaggcaggaaagggctgggtttgtcagagtaacatgaaggtcagtgtgctggagcaaactgaggagggtgagtgtttcaagacaaggcttggcataggagtggtcagatgattcagggccatatgaaccatgttaatttagttgttccaaagttcagagagttgattagaaggaataagaagagaatttaggagacagtgtcagaaggttattggctttaggctggaggcaagagatgacagtagcttggactgggggttgacagtggaactgaagagatgtggatggactcaagctgtatttaggaattagaaccaacaaaagttgatagaagggttagattgtggtattagaagaaaggattcatttcagcatcctggcatgaaccagtgaatggatgaaagtgcttttccgtagttgggaaagactagaggcagaatagatttgagagagaagcaacagttcagttttttgatgggttaaggttgaaatgagtctgtgagctatctcagtggagatgtcaagtaggtggttagttacatagtatgtgtttatctcttgctgcataataaattattatgaaacttagcagcaaatctatattagttatctattgctctgtaacaagtcaccccaacattggtgctttaaaacagcaaatatttattatctcatgcagtttccttggccaggaattttgaagtggtttagctaggtgattccagtccagggtctgtcatgagattgcactcaagatgctggccagggttgccatcatctgaagcttgaccgaggctagaggatctgattccaagatggcttatgtacatggcttttggcagaaggtctcagttccctgctggttctcggtcgaaggccacagtttctcgccacgtgggcctctctctagggtgcttgagtgtcttcatgacatggctgtgagcttctcttagagtgagagagatatgaaagaatgcaaaggggaagctgtaatacttttagtctcaaaagtccgactcatcacttctgccatattctattcagtagaagtgagtcaccaatttcagcccatactcagtgggtggggaattaagccccccgcttgaatagacagccaccaaataatttctgaatgtattttaaaaccaccacacatgattttgtaattgagaagaaaggtttgggctggaaataagacattaggagttttgcacatagatgctgtggagtgagtagatgcgtgaccacttagtaaaagtgtgaagaggtccaagactgatcctttaggaaatctaacttgtagaggatctgctgtggaggagtggaggagaaggaagaaatggaatctgggaagatgagaagaatttttcaggcagggagtgttctattctgtggaagcctactggaatgtgtatttgactttcatttttaagaatttattctctgaatgaatgaagaatgaataaataaatgtcatgtatatgttcaaaattttaattctaagtatgattgttattgaaatgcttataaaattaagaatggaaatcagcattaggaatgcataataacagagtgggagatattggtaaaaaattatttaatgtccagacaataaaatacctatgaagctttaaaatgacattattaaagaatgtgcactgtaataaaaacagatttataaagtattttaaataaatataaaatactatgtaaggaagaagcagacaaaaatgtctaggaggatgtatataaacctgttaatactggttatctctgggcagagggaaaatgggtggtttaagtttccttcctttggtttgtctaaatcttccttaataaatggaaattgcttttgtaataaaatgtttgaaaatatcccctcccaaaataaagaaaaataatgaaaataatgatagttgaaactcaattgaggggcccggcatattggctcatgcctgcaatcccagcaccttgagaggctgaggtgggaggattgcttgaggtcaggagtttgagatcagcctgggcaacacagcaagactccatctctaaaataatttttttaaaatattagctgggcttggtggctcatgcctgtagtctgaaccactcaggaggctgaggtgggaggattacttgagcacaagtcaaagctacagtgagctatgattgtgccattgcactccagcctgaagcctcaaaaaagaaaaaaaaacttgattgagaaaaattaaagtacaacatttggctctgaacttcctggcagccaagacaaaatgatacaaagaagatctctgatctttgtcaagacaccctgctttatgcctggtccccaaagtgagcagaagtgaggcaccttgccctctaaagcaattcctttctttttttctttctttttttttttcatttgaaggatttcttttttaaacttttattttaagttaaggggtacatgtgtaggtttgtttcatgggtaaatgtgtgtcacaggatgggggtttgtttacggattatttcatcatccaggtattaagcctagtatccattagttatttttcgtgatcgtttccctccccccaacctccaccctccaatagaccccagtgtatattgttccctgctatatatccatgtgttgtcatcatttagctcccacttaaaagtgagaaatgtggtatttggctttctgttcatatgttaatttgctaaggataatggcctccagctccatccatgtccctgcaaacaacatgatctcattccattttatggctgcatagtattccatagtgtgtatatgccacattttctttatccaatccaccactaatgggcatttaggttgattcaaagtctttgttactgtgctgcaatgtctttgtaacagagcaatttatattcctttgggtgtataccctgatatggcttgtctgtgtctccacccaaatctcatcttgaattcccaggtattatgggagggacccagtgggagtaattgaatcatggaggcaagtctttcccatgctgttcttgtgatagtgaataagtctcacgagaactgatggttttataaagaggcgtttccctgcacaagctctctctttgcctgctgccatccatgtaagatgtgacttgctcctccttgccttccaccatgattgtgaggcttccccagccacatggaactgtaagtccattaaatctctttctttggtaaattgcccagtcttgggtatatgtttatcagcagtgtgaaagcagactaatacatactcagtaatgggattgctgggtcaaatagtatttctgtctttaggtctttgaggaattgctatgttgtcttccacagtgtttgaactaatttacactcccaccaacagtgtgtaagtgttcctttttttcttcaacctcgctagcatcttttattttttgcctttttaataatagccattctgactggtgtgaaatttatatcattgtgtttttggttggcatttctctaatgatagtgatgttgagctttttttaatatgcttggccacatgtatgtcttcttttatttaaagcaatttcacataagctacagcgatgttcttaagtcttgggaaaacagagggcatactttaaaatgtaggttctgtgaaggcagttgtgcaggcacagggtagattcctatatgtggcttaggtaagctttgtgatgatttggtataacaaagtggtaaagtttttattatcttgagaatacagcagttggtattcccttagaccagattccttcacatctctggatgactgggctgcacctgattccttaagcctggctggagtcaaggagtctgtattctaagacaattctccaggggattctgatgttttgctacatctgggaatttgtgcagtgtactattctttttgaccatgatgacagttgggttttattgagaattaaccatgtggctcttgccgcatgctgattattatctttaattctcataacaattgtttaagggttgcatttttaccctctttgtatataggagaaaaataaattgttcaagacataaagcagtcaaaaagcagttccataaagtagttgggagctgagttttaccttataaggctgttgggatcaaatgagataatgtgtacaaagtggttagccctgtgtctggcacatagaaagtgtttaataaatgtcagttttattatgagaaaacatgattcatggatggagactctgatagcatccttagtgcatgcatctccctattccagtcatctgtccttcagtgttacgttttagatcagagttataggacatgtcaggcttattttatcttattttcttttatgagacaggttctcactctgtctcccaggctaaagtgcagtggtgtgatcatggctcactgcagcctcgaactcttgggttcaagtgatcctcccaccccaccctcccaagtagctgggaccacaggcatatgccaccacacccagctaatttttgtactttttgtagagacagggttttaccattttgcccaggctggtctcgaactcctgggctcaagtgatccactcgccttagcctcccaaagtgttgggattacagacatgagtcattgcgcccaggccatttcagcctgtttaacattccttttgcagagctggaacatccaactccaacttgtagaccagaaatactcctgaatttctttcctcagacttatctcagtggcaccagattgagttaggattgagtttagctgcaagtaagagaaacccttttacgatagattaactaagaaagaactcatttttctcaagtaagcttcagtctgtaggtaggcaacccagggctggttacctgctcagggaaactggcagcttctgtcttcctggaggaagcagaaaggcccagggcaagatgttcatgccagccaagtctgttaatttttatcagggaaataatagttctcctgggtcttccacccaatatacttctcccctcctctgggcggaattgagccaaatggttatctctagttgcaaggcaaggtgaatattttaactggccaccttgctacagggaaaaaaaatgggattaatcttgtaagtgagaaggagagaaaggatgcttgagtaggcaactagcagtgtgtaccatagtgagttccagcaaatagttctatcttaaataccatgtctagaggcatgatcagagtgaaaacaattctgattctagaattcaggttacctgtaattatattctgaaagaatgataggttgaaaatatgagtattaaaagacaaaattggaaccaagtacaatttctccatttgtcttataggggaatatatgaaaagttgagataaattaatctcttttcttcaaaaaaataacactgtgaaatgaacatgaaaaatgtttattgcatctggtttttttcctctatgttttatttcagtaaaatacagataacataaaatttattattttagccatttgaaatgtacatacatcttgttatataaccatcactaccatcgttctcctgaattcttttcttgttgaaaaactgaaaatatatacccattaaaccaggggtccccaagccctgggccacaggtcgctactagtctgttgcctgttaggaggcgagtcacacagcagggggtgagcggtgggtaatcgagcattacctcctgagctctgcctcctgtcagatcagcagcggcattcgattctcataggagcacgaaccctattgtggactgtgcatgtgagggatgtaggtcgtacactccttattagaatctaactaatgcctgatgatctgtggtgaaacagtttcatcccgaaaccactcccccactgcctcccccactgccccgcccatggaaaaattgtctttcacaaaaccggttcctttttggtgccaaaaaggttagggaccgccacattaaacaacaactcctcactcctctctcctcctagcccttggcaaccaccattttactttcactattctaggtacctcatgtaagtggaatcataccatagttttctttatgtgactggctgtgtcacttagcacactgtcctccatgttcatccatgttgtagcatgtgtctgaatttcctttctcttcaaggctggttattattccattttatgtaaatatcacattttgctaattaattgatctgtttgtggacacttgggttgcttccatcttttagcttttgtgaatagcgttcctattaacatggatgtacaaatatctctgagattctgctttcagttcttctggttatatcattgcatatgctttttactcagatcccgtttctccttgacataaccctaggtaatggtagttagcttactcttatcttgagggaaatgctaaagttttgaggaaagatcattcatccaaatctttttgtttgattgactcttgctaacctccaagaaaaatttgtgatcacgagttatattttatacagtccataggttcagggaagggagtaattctagtgttcctaaaagatgccattgcagtgctgtaatgcagaaaaacgctaggttttggggtgtccttaggaaggagacaagaaagaaaacagagaacgttatccttcctttgcaaagccatgttgactgtgcacatggattacgatctgagattctggtctcctacttaaatgatttaacagtggaaggtattctagtgaaggaaacccaagtcccggagcgaatgcatttgttacttttgtaaaactgactaaggtgatcagtactcttcagtctaaaaatatgaaagtggaaagaagacatacttaccagctataagcttatttcagaaaagcaaacataaacttattcttctaaccttcaacagttatctggactttttgatgcttaaaagaccagcaaatgttcaagacaaatgagaggaagagctattttacactgaagatataattagcaagtttgcagtacccagtgatagtatagactgaatttacaaattttttcttttaaaggcaataaatgtcagactcacagtagactattaaataaagacagtgctgccagaactctatttttttttttttttcttttgagacggagtcttgctctttcgctcaggcttgagtgcagaggtgcgatctcggctcagtgcaacctccgcctcttaagttcaagtgattctcctgcctcaacctcctgagtagctgggattacaagcgcacaccaccacacctggctaatttttgtatttttagtagagacaaggtttcatcatgttgaccaggctggtcttgaacttttgacttcagatgatccacctgcctcagcctcccaaagtgctgggattataggcatgagccactgtccccggcccagaaccctaatttttaacagtgacaagaagttaacatgaaggaagtcattaggaaagtgagtggcctgtaaatgaagtttcttgcgcttttgctcaggcaatggattttatctgtccccctcatccaaccctacctgaatgagctttttaattaaaaaattcattagtaaggctgggagcagtggttcatgcttgttatcccagcactttgtgtggtgtaggcgggcggactgcttgagccccggagttcgagaccagccagggcaacatggcgaaacctcgtgtctacagaaaaatacaaaaattagccaggcatgttggcacatgccctccaggtacctgggaggcagaggtgggagaatcgcttgagcctcggaagttgaaggctgcagtgagccgtgatcatactactgcactcaagcctaggtgacagagtgagactctgtctcaaacaaacaaacaaaaagtattagtagtttatgtgaaccttttcatagttatgaaaattaaaaataagaatatgtatttttcaatatgagactaaacctttcaattattttatttattaacttccaatttatacccttttaggcaaagagttctgtgatttatgggccaatttttaaactgtgatgtccatgggaagaaatttttagccctgagttttgaaggggaatgcagtgttcctttctgacttgtttttcctgcttattataaatatttatcttggacaaaggattgcattttagcggatgtgcaattttacaaatttaattattaaaatgactcttcttcctttttttatgatcttacattttgtttttaacttgtcatggcggatattaaaacactccaaataaagacaaaaaaactcaatataaaaaaaaaccaaaaaccacttccgaaatactccattttttcttatttaaaaaaatgctatttatagtagtagttggcatttcatcaaagtacataagcaaaggacagatactcctcattttttcccaggtttctattctttttctgaaagtgagtaaaatattaggctttggagaaagtctaggtagtttggtgtgatctgttggtagcattttgttttgccttaatcttctatttttttcttcccattttatttatttatttttttgagatggaggctcattcactttgtcgcccaggctggagtgcagcggcgcgatcttggctcactgcaacctccgcctcctgggttcaagagattctcatgtctcagcctcctgagtagtggaaattacaggtacgtgccaccatgcctggctaatttttgtatttttagtagagatggtgtttcaccatattgtccacttcttgaactcctgaccttaagtgatcctcctgccttggcctcccaaagtgctgagattacaggcatgagccaccatgcccggccttcttcccattttaataactaatgattttgccttaaaatacttgaatttattgcaaaaggtgtattttaaatgattcagctccctcttccacggtgtttctgtagtgaatagactggaagctgggaagaaagtgacctccataaacacagttattttacattatttctctctctgaagagagaattagcactctttttcacttccaagtggaaaacccactggacaggcaggtgcaaataaagcaatgtaaaccggcaagtttcatttttagaaatatgtgggctttatccagtttaggagcttagctcccgatacatttctgtctcccatcctttgggatttgggagctttttttgtttttggttgagtgttggcatctacagtatctcccttcctcctagatccttcctgtctgcatgtaaatacagatatgcagaagtctcccttattcttaccatcctccaccaaagcagacagacccgcagacagacagaccttgtgtcagcccagtttattttttagctgacaaattctcttcctttcctacttgtcctcattaaagtggagaaaaatacaccttttacaagatgggtgcattaaagaaaaaatgttacagaaggtattacgtatttattacaaacttagaaaatatggctaacaaataatagaatataagagtcactcagaatcttctaacgtacagatacagtgctaacattttggctcttggctttctgtcatacgtacacttacgtataagtgaagcactgtgtatattctttaatgacctgctttattaccccttaatacattgtgaaaatccttccatgtctttccatattcattatatgtatctgaatatcatttttttaaccttttgtgtttttttttagagacagggtcttactttgttgtcccactggagtacagtggcacaaccatagcttactccagcctcaaactcctgggttcaagcgattgtcccaccctagcctccagagtagctgggactacaggtgtggaccattctgcctggctaatattatttatttatttatttatttatttatttatttatttgagacaggatctcactcacccaaactggagtgcagtggtgtgatcacggctcactgcagcctccacctccccagattcaggtgatcttcccacctcagccacctgagtagctgggaccatggcgtgtgctaccatgccatgtgctaccacacctggctaagttttgtatcattttgtagagatgaggttttgccatgttgcccaggctggtggctcaagcagtccacccacttgggcctcccaaagtgctgggattacatgcatgagccaccttgccctacccgctagtatcctttttaatgcatgaaaatatacttttaaacagttctcatggatggacactgggaaagctagatgcctgtgagagtttgagctcctcagtgtgaagaccctctcctgtctgctctaatgttgcattttcctggtatgaaccctgaatatctgacagaggtctcagttaatttagaaagtttattttgctaagattgagagtgtgtgcctgtgacacagcctcaggaggtcctgatgatatgttcccaaggtggtcagagcacagtttggttttatacattttagggagacatgagacatcaatcaacatatgtaagatgaacattggcttggtctggaaaggcaggacaactcgaagtggggacggggcttccaggtcataggttaataagagacaaatggttgcattcttttgaatatctgattagcctctccgaaggaggcaatcagatatgcatttatctcagcgagcagaggggtgactgaataaaacgggaggcgggtttgccctaagcagttcccagcttgacttttccctttagcttagtgatttttggggccccaccgtttattttcctttcacactgggcttgcttgataagtttacctgagtatgctgctaatctctcacattttttggtgcaaagaggaatttctttccttaatcaatttctttctgtgcttaaaaaaattttttttgcactttttattttttaatggagagacaccattctttaagttaccaaagtctgagaagtttttgcacatccctttctccttcattactcttttttttttccccccctgagacggggtctggctgtgttgcccaggctggagtgcagtggcatgatctcggctcactgcaacctctgtctcccaggttcaagcgattctcccgcctcagcctcctgagtagctgggattgcaggcgtctgccaccacgcacagctaatttttgtatttttgctagagacagggttttaccatgttggccaggctggtcttgaactcctgacctcagatgatccgcccatcctggcctcccaaagtgctgggattacaggtgtgagccactgtgcccagcctttccttcattactcttataataattcagtagtccagtcccagcatgggggtgggggacttggagtaatattggtcaaagaatatagtttgacaggaggaataacttcaagagatctattgtacaaggtgatgattatagttaataacaatttggtgtatacttgaaaatagcatagagagcagattttaagtcttctcatcacaaataaatggtaaatatgtgaggcaaaagcactaataaataaaattttgtctcttaagagccatagagtctaattgagaatagaacgggagacacgctgtataataatgatcatgcccatccacctcaccacgtcccagcagcaaccttctctcttcaattcaatacctattgcatccacctccccctttcttgtctcattacttctctactctttcaggctcgctgatgtctagcacgggcaattctaataagcctcaaactggcttactttcttccggcctccctccccatgagtccatttttcatgttaatctcactaaagcacccttctgatcatgtcacgctcttgctcaggaaaagccaatggcccacattacctgctcatttaaccccttgctgtggccttcaaagtcctctgcaatttaactgcagcctgttccaaaattcagtggcatcacagctctgataaaaaaccacccagccaaaggaacctcttcacagttgtgtctgcatcatgtttttaggactttgctgcagctgttctctcttctacaaatgcctttctaaccatttttacgtgccccaaacatagtaattcaagatctagctcaaatgcaacctgttcctcaaatctttccgtgatccccttttcatccccatcaagacatatttgtctatgaatttatgaatgtatctgtacctgatatattagttataattttctgttgtcttagtcccttccccactcatcccaggccactggaccacagcttccttgaaagcaacatctggatctcttttgggactgacacatagtagatgctctgtaaatgttactatttctttgtacagtgtttttcacaaaatagttgtacaactaattgttatatttaataacaattagtcatttagactagaaaatataaaacttaagacaacaaacataacaaagagttggaaatattcccagttcttttttttttttgacacaaggtcttgctcagtcacctaggctggaatgcagtggtgcattcacaattccctgcagcctcaaactcctgggctcaagcaatccttccacctcagcctcttgaataagtggtactacaggcatgtaccaccatacccagacacttttttgattttttgtagggacagagtctccctgtgttacccaggctgatcttgaactcctgagctcaagagatccttcctggaggccacccaaagggctgagattacagatgtgagccacttgcctggtccccagttcttattatgtcagtttatttgactagaagtcttacaaaatgacctaagccaatttgattatgcgtaattataaattatggcttttttttgattggtaatgttggctcccaatgccactgtcttcctataagggtcataataaaggcaagtttcagaccaaatcctgccattaacattggcattcattaagcaatcattattcgcaagtaggctcgaaaaacagttcatacagcttgcatgtaaagttggtaagctgcagctctgtgtcatttttgttttttttgagacagagtctctctctgccgcccaggctagagtgcagtggtgcaatctcggctcactgcaagctccgcctccggggttcacaccattcttctgcctcagcctccccagtagctgggactataggcatgcaccaccacacccatctaatttttgtatttttacaaaaatacagggtttcacctgttagccatgatggtctcgatctcctgacctcgtgatctgccctccttggcctcccaaagtgctgggattacaggcgtgagccactgtgcccgacagctctgtgtccttttgaaggtcatagttaaagtaaatgcagcaatattctagagctgtataatttggtgcattgggtgctgagttcctgaactgtagctagtctgaattgaaataatgctgtaaatgtaatatacacacaggatttcaaaggcttagtaagaaaaaaagactataaaatatattttcaagatgttttaaaatattgagtatatgttgaaatgataatgttttggagatattgggttaaatagtacatattactaaaaattcattttacctgttttttaatgcggcttttaaaattatgtatgtgactttcattatctttttattagacaatgttgtcttagggagaggatttagtcttataatcagcagcagataactaaaatcctccagccaatggctgaacataggacctttagggatctagcctcccagactcactagatttttatattctgtttaatcagtggtggggcatgtctagaaaatattttgaccaatccttgttcattgaataacactaaaatcaacagtgggagaatatttctaacattctaattatgccaattattaagccacagtaaaagcacatttctcatattcattaattaacaaagtctctggtgttgatgaaaataaagataactgatgcctttgtagtggtccactctggagtttagcctttctaattaaattatagctgaacttctctggaatgttatactggcttggcacaaatgtgagcctctagtgtggtttgcacactggaatatgtgtgtcttactgtgatcttggcaagcttttgtagtggttaaggcacccaagatagcatcctacctgtctcttttcttagcgttcctttcataattcttctttttgactttataaaagaaagtcatacctctcactctcctcaaattttactgtgctgcattgctgtgaggcatcaaacaagaggacaatttaagaatgcaaaacaaagagcaatcctttacaaattttttaaatggctggtgcttgttgcatccagggcaaggctttgtgtccagctgccatccatccatccatccatccatccatccatccatccatccatccatccattcatccatccatccatccctttatcttagaaagagaattctgaagtgagatgttatttggaaacacctataacatggtttttaaatccaaaaccaagtcagactcctcttgtcagaaaataaatctgctttggctgattagtttgacagtgaggactagttttgccaattaggtaccagaggaggcattttctattaattgaatgagctaaatttgcaactccttaacaacatgctagaaattacatctttttcacgatttaaatttatgataaatatcagttctcaactttaaaatgtgcatggaaattcttttggaagttcacgaacaagagtgtttgaagcttctgacttaaactagtttaacacaagcatattacactttgtatgttgaaatcttctaaagtatattatagacattatataggaagttttaagaagaaaaagaaacgatggaaaaaggcaatccagaagagaaatggtagaaagagactgacccacatggtgcagggagcccagactggtacagcaggatggctctgtggctgagaattccaagatggcggcctgtgtcatgacacgtcagagaagggtgttgaaaaagaatattcagtgacgcaggatggagggaggtttgaatgttcaaaaaagtagaacaggcagaaggaggtgggttctgaaaatgaagaggagagaaagagggggagagtctttgctccaatgattctccaaatgatggggtgtagtaaagaaggcttggcagatttgtttgaggggatgttcattgtggcccttaaggttatgtaaacttttgtagatgtctaatcctgacgagctggagacactttctctttgacccatgagttttttgaggttgcattgttctttgatgctacctggagactctcctgtctggaagaatggaaagatcagtgctttaatgtatgtggattgctgttgtctgggtcttgtctatctcaaggtgttgtatgggctctgacacacagaggactaaattgaagtaaggaagcaagccaaactgtattattgctggtccattttatccattggagttgttggcttcagaatgtcatcattggcttttacaatgctcattcactgcttgatgcttttcaatttattattgaattatcatatatatgtgtattagtctcttcttatgctgctaataaagatatgctggagactaggtaatttataaagaaaaagaggtataacggactcatagttccacgtggcaaagggacgtctctcatggcagcaggcaagagagaatgagagccaaaggaaaggggaaaccccttataaaaccatcagctctcatgagacttattcattaccacaagaacagtatggggtaaaccacctccatgatttatcttctaccaggttcctcccataacccatgggaattatgggagctataattcaaaatgagatttgtgtgaggacacagacaaaccatatcaatatgtattctctcacaatatattttttatttgactatgatgacccggtgtcatgatcttagaagacacatggcatacagtgaaaggtttcctacattagctctatagaaaacatagcattcctatatatgcatctggagagatatttgggtaaagtattgttctctttttctttggatattttatacatttttttgtttgaaaattgctgtttcttggatattatattgttttattctgtgaatttatgaggaagatccctcataacatgaggaaaataatgaaataaataaagtaattaaaatgagaaaaatattatttgaataattagcagtcttacaaggacatatttttgctgctattttgacaagtagaacttgtcatgagaaagtctgaaggtcaaatcactggaatggtttttacattcaaaatgttttccccattttttttccaggcttatacatctagaattatatgttaatgagatagttgctttttcttgagatttctgcagacagtttgtagaacataatagatgtttatttgataataataaagtgaggaatttaatttcatagaaattttctttcataagtttagccttttgtcaatcaataaaaaaatgttttctgttggcttttcatgacagtgactcatatcattatgactaattcactgtgtcctaaataatccctccttgttctatgacatttctagcaattttaatgaaaatcttcactccaggacaaaaattcaaagtgaagtgtttgtatgtaaggtttacaatctctaccaccataaatggagtctgtttttctgcatttgcaacacatataatatggttgatagaaaagatgttgagtttttttttttttttttgcaaaatatatttctagaggaaaagtttcaaacagtgtcggatgcctgtaaatcttagaaacattctttcagtttaagtttaggcgctctagaaagtgcaagtagaaaaacattatctcctatattcctatgcattgtttaaaaaaacttgagtttgttgaaaagaaaacaggttaagaagtaaataaactaaaattagaagatggaattaatggttacatttaattctgaaaataactattttgagagtaaatcaatcatttggcaatatggtgtggattaaatgtgaaaaagcaatttctgaatcccagctacttcaggttagcatgctgttaaacttgaactcattcagaaagtcttcaggaggtgtctaagtttgggggttttgttaggtagtttctgtgttttcaaagtcagtcttacactaggatggctatacatttttttttaaaggaaaataacaaatattagtgaggatatggagaaattggaactctcatgcattatggtgaaaatgtaaaatgatgcagccactatgggaaatagtttgctggttcctcaaaaatctaaacatagaattactgtatattaacctagcaatttcactcctgcatctacacccaaaggaactgaaatcgggaactcagatacttgtacaccagtgttcattgtgacattgttcataatagccaaaaagtggtcaactagtgctcatctttagacaaatggataaagaaactgtagtttatacacacaatggaatattttttacccttataaaagaatgaagttctgatacaagctacaacatggatgaaaccttgaaaacattatgctaaatgaaataagccagacccaaaaggacaaatattgtatgattccacttacatgacatatcttaaataggcaaatgcatagaaacggacagtagattagctattaccaggggctggtgggtatggggacttattgcttaatgacagcagagtttatgttcagtgtgatgaaaaagttttgggactagatagtggttatggttgtataacactgtaggtgtaactaatgccactgaattgtatgattaaaaatgactgaaatcacaaatattgttatgtattttaccacaattaaaaaaaatctattaatatgccaaaaacgattgaattgtaaactttaattgggtgaattatatagtaggtgaatttaaatgggtaaattgtatggtaggtgagttctatggtaggtgtgtggatgaattgtatggtaggtgaattttatacctccataaaacaggtttttaaaaagaggcagtcttgtgagtaggaggagagctaggtaaggagacatgaatcttgatttgatttatggcaccatccaactgcatgtcatgaggggtaagtccttgacctctctggtcacaggatggaatcccatcaggcaccctcttatatacttcctactcctgtcctctgtggctccgtgatagtaaggtggatagttttggtgggttaggttggttctcagctggaacaaatatgttcctctggccaggcacagtggctcatgcctgtaatcccagcactttgagaggccaaggtgggtggatcacgaggtcaggagttcgagacaagcctggccaagatggtgaaaccccgtctctactaaaaatacaaaaattagccaggcttggtggcacacgcctataatcctagctacttgggaggctgagggaggagaaccgcttcaacctgggaggcagaggttgcagtgagccaagatcacaccattgcactccagcctgggcaataagagcgaaactcggtcttaaaaaaaaaaaatgttcctctgatgctgaacatgatataaattctaaatgcagtccagatgtggctgtagacattctaggatcccaaggctccataattgccttcagttttgggcagagtggatgggtcattgggtcatgctagcagagcatgtgcttgcttaaggaggttgatttttttcagataatctcgattttattacaagaacatttttaaagcatatattttaactccatacccttcttctcttttatgggcatatacagttttcaggattgaaaacttctgaaatttggattgtcttagccttattttgacatcattagatgttatagccctctgtgttttcttgtagataccaaaattatattaaacatgttcttttttgtgaggtattgagtctgaggctgaaatgaagaggtattgactaggcttattctatctagaatgtccttcccatctttgcatgaaccatacttcatctatttttcaagatatattttaaagccttctttccattaaattatctttaacctcctcctacatggaagtgcattgaacacaggctccacagtcagttagacctggttctctctgtggcccagcatttgctgggtgggtgatgctggacaattcatttaacttctgcctcagccttctcctttgacaagtggagttgttttcctttcccttctcacttccaccatttccacctctccttgccttagggcagagaggagttaccagcagaaagactggcagcattgcctgctgtctcctgctcaccattgctgatgattggcatttgtatttcaatatggcgtccgtgctctggaaaggaataatctggaaagatgactgggaagtagatggtttgcctgtgtcatcaccacgttttccctgttccctggggtggtgtacctgctcttgcaatattctctaatttctggatgaacctggctttggaaggtactgtgctgtaggtttttccaggagttttgtttgctttggagtttcttaacaaccatcattgccttggaggctttgtcaacattttgggcttccttgtcctcaatagatttgcttgttgggccacacttgtgccttttcacttattctcaccagggacttccttcactgggcatctggctgggattcttcttgcattaatgcacactcaagggcctctgaagaacatcatggaagcatgtgctggcatttttttccctccaattattggttatccaggacagtgatattacttcaattgttcaggctagtctggatatcaggatcattatctttatggcaggccaggttattatgaagaagcacccaggagctatgatacatacacagcagtacggagagaaaaagaacagcttgtgagagcatgaagagccagcccctgggatcaagaaaataccaggaatagctcactgccctgcgggcttcttctctcagaagaaatgagactataatggcttcacaggtttgatagccagtgaggtgacacagcatcttgggaagacatggtccacttgtgttattattgcccatcggattcattccccaagcaactagttcattgtaaactaaagcaaaacatatcgttaaaaaaaaaaaatcaacttgtatttagctttttacagagtgaagtgaaactctgttttaaatgcggtttttagctttaataacgtcaaggtttaaatgtggcaaactcacaaaaatatcatttgaaatgttaattatctaaacttcttgtacacttaggtagttttgacaattctgaaaactacatttttaattttggcttttttaaggtcctctgaggatgtcggattttgaaagaaactcagggaggttaaacatttctgtttgagagcagtctgtatcctgttggctttgtttctttgtctacatacatatttataatattttacagattattatataatatttattattcccatttgacattttaataaatattgtttgaataaatgaattagtgtttgggtgtgattgggtgtgatgaaacaagagagcataatggcataactaagtgtgagtggcagaattatattgggagtgattcacatgtagggcccacaaaaagaagaaatgagaatatgatctgaaatgcttttgttacttccaaaataataatctttgctaacgagagattggctttctagggtgtgttaagttttgcatttgtgaaagaggccttaataaaatcaatccaagtttaaaatcatccaataagagatttctttcttggctaaaggtctaggtgctactttcctgaataataagctgcactttagggaactcatgttatgttagtgtcagccaactggacactcttaaattgcttcaaatggtgtactagaggataatgctttctctctaataacagtagagttttagaggtgatttgtgtgctttcataggggaaacaactcctaatttctctgccacatttccagtttaggatttaaattgatatatgttgctacgttctgctaaaacaattttccatacccatttgagctggtgaagtgaaaacattttgaaaccagtttccttgaagatttatcaagcagttttgttgatgtgtcttgctatacttcttttacctatcacagaaataaaatcccaggctaggcagcagtgaaggcctttggatctgtgtgagcatgtcaaaagcattttaagaagagcaaaatatttagaggaagaatttgggaaagcagccttaagggatttaacacatttttcttcttctaattcagtctcgtgttcatccctctaatggagaaaggtcattaatggataagatttgctaagccagcaaaggcttttagaaacaaaatggttttcaaaaatccaagcctaaggaaaacagggtttgaatttgggagcttgaaagaatacatttagagaaggtgtatatgcagtgtaaattatattcattcacttaatattatacatatatatttataatcaagttatagtatgtttgttgcattcttacacatttttgttttggagaagttaaaataacgaattggcttgataatgaagattgaaataatttcagactgtggaagttctgtataaatttctaggcagacaaaatggctgatcagaatagcatgacggagttttagttgtcctgttactcgtctgctatttttacgtgcccgagatctgggccaagattgtttaccttaattgttgtgatgtggaggttagtaagtgtgtgaaatttgttacatttcaatctcataattgaaaagccacaggcaaattcttgttcttttactgaattcctgtctagtagaaaataagaagtatgtgtgtttgtatgtgtgtgtgtgtctgaaaaaaggaaaatgcaaactagtctttgaaatatgtactcccttttccccatttttaactgtatcaagagaatgaatgcggaagtgtgtttataaactttgaagtatttttgaaacatttggatgttagaaaatgtatcgtttacaggcaaataatttgtctgttacttagacttatattctgacattgacttgacccataaaataaagactattgttgaaatattatcttactcatttttacaaacataagaatgggaatccataaattttatttcatttcatatgtgataaaatggaaagattattatcattgatagggtaatagtgctcatttctttgcccactttatatctggggagaaacctacatagtattagatattttaatatgtttttgaaataagaaagttaaatgctccggaaacaggttaagaaaatgtaaaatgtagtaagatttctctcttagaattttttccatttttatggccccaaattcttaagttgtgtgaatgttatcaaattaagataatttaatacttatttatgacctttctatatttttttattcatgggattaaatgaaactgcatataacaagatttatgaaaataaatcctttttaaggtagtgggacaaataattggattttccaaatgccctaaacactgatttttaatattaaattcattttggtgaggctggtatatccccccttcaggttgatgtgtggtggtagccttatattctgagtataatctctactgtgtccctctttgatatgaagatggtaaagggtcattcactgtgtaagcaagttctcttggttaataaatggcttatgtggccttgatcagataatataaagcttgaaatagggatcgttgctgtctttgctgtcctttcttgaaggaaggtcacctctgagcaccattaatatcaaggagtttcttaaacagcagttttgttttctataccacttgctcccttagtgtcttggagttggtctccaattacctttatggatttgtaaaagtgcatttttttttttctgaagctgctgctatatttattctgggaatgaccttttaattacaaactctccttccacaagggggtaaggaccgaagaccacaaactgggtgaagtggtaggcgaacctctaatgatcctagcagaggttcgtgagcaggtctgtatttaatgtggaactgacactggagggccaagcacacctgggcttcctccattattattttgctgctctgatgtgggaggcagcccagcagtataaaaggtggcaaaggaggcaggacacacatatggatggagccacacctttctgcactgtcgcagatacgccttggacagctttctgaacaactgatagagattgtgaaaatgctgttttgtaggatttaagccaacaatgactcttttactggctttaatagaaaatcgtggagtgatggaagagtatgatttgaagaggtccaatgaatatttatttatctaccttgcttacacttttactgtaatcattataacaacgagctgaacaccagctcttcgtcaagtgcttttcatttatattcactaacctttacaatactcttgcaagctaggtattatttatccccattttacagatgagaactgtgaggaaaagcgatgttataatgacccaaggtcacacaataaatggattgggacaccgtctatttggttctaaagagaaagtccttttctctttttgttagccacatggactccttgtatgtaaccaaatccttctacccatatttcaaaagttcagggtggtcagtcttttaaagtaacttttcttttttttatggctcagaaaatgaatttgtaatcaaaaccaaaacggataatggttttaaattcttctgatttttctacctgtaaaagttcgtatagatcaagatcattaaaacctcatgccaatcttactacaggaaaatgggttacaagattgaccataaaccttatactgtcattctagagggtgtaggaccagtatgaagagggaggaagtcacgaattcctgagtttttattggataactttaatttttgtttttagcatgctgacattttgattatgctgaaattttacttgcacaaaatgtagcagaaagtgctacgggtactagctggaaagtagggctctgatttgatccgataaacctggatttggtcactgatggcaggactccggggtttagggtgagacaacctggtcccttgggaaaggtgcccgagcctccctctgttgtaggcagtgttgggctccataagtgtaccgggcagtcatcacattctgcattagctccgcctcattgtgctcaaggagctcgactaataggactattttaaactctccaggatagagataaccttatttggtgctttactaaaggtacagactctcatactttttccttctctttctttttccattccacagatgaacacaatgacgtacagaagaaaacctttaccaaatggataaatgctcgattttcaaaggtaactgagactttcaaaaacttcgatggttcagatgccgcattctgattgaaggagtttggttggaagtgcagtgaattttccccaggaaatgtcacctagccgaagtcttctgagtatgcagatacatttgttgttcctttattctgtcctaaaatatgtttaaacggaaattctcatgcacatagtttatgggacgctattgacttttacctggccttctccagatatctaaggcagcagttagctgctttcgattctgtgaatcctgggtacatcttggaaaagaatatatcattgggaaaatttttgagttctcttggttaagaggatgatgatttcattttgcctggttaaaaccaaatgttataattcaggcagtctttctaccctgtcagaaatatttatggatttttattcttgtggatgtggctaataatatttatctgccttgtgggttgttttttcttgtgtacttccttaattcctcccccaccccaaagatctactcttagcatttctaaccatttagaacataatcaatgctttgagcaatattttttcataggggcagagcatgctgaagagaggaattgtcagtgctattttcaaatctgttctaatatgattatctattagttattggtgttggaattttgtgcactaagcctgaggtaggaggagagttttcaggataacagattgtttaggactcttctacaacaagatgaaaaatagaagtttctcagagaaacactgttgtggtcttttaaatagtataaaagctattttaatgaagagttgcttttcaaaatttttggttgcttttcaaaagttgtaaaggtcagagagacaaacattggtatttcttgaggaaaaatgaggatatcttaaggttactttgagtagcagcatagtttaaaaaatgctccacgtcccaatatttatagttggttatttgatttcactgctttttgggctttgcgagtttatcttgaggggtattttatcttgcctgtgagtatgtaaggaacatgaaaaccaactttgacagagggttaaaaatacagagaattagaacataaaggtgcttgcataattggcagttatatgtgtaggattattccaaatcacatgcaggtgtgttttggtaaattttagtttgttttattccagagacacaggtaacatatgtgcatctcgggcttgacatgaataaaaacttttgaactattcatctgcatgtgaccattttccagagaatgtagttttagcaactgggagtctggatatgaggtgttttattccagtggtcttatgattgctcataaaagtaagattatttttcctggttattcacgaggataacacagtaattgtttagatagaacaagtgaagcagtttttagcagcttaatttagtctttggggaagaattgccttagaactaattttgaagattgttttgaaagcattaaacttggtagacctaagtttagagagcatttgaaactgggtaaattactttttacctatttatgaaaatggagagaaataggtagtaaaataggacatggaaagggtttgtagaggaagagagatgacaactgagacagaataattgaaaagaaatttctcaatatttatggtgggtcattgacacctttaaaaagacctcaaagaaaacaaaatctggtagtaccagactagtttattaaatgaacttgatatttaaatttgtgcatttataatgtctattattttgcaattaaatggggctttaagtcccatgtaaattgtttgccctggaatatttgtatttcttaccaagatactggaaaagacttggtaatttttatcatttttagtaaaagttatagttagttttagctaaaagcttctctattagtgtttggagatggtagtttctaagctcagcttctgtgttagtgtttggagatggtgtttggagaaaaactaccaaacgtgggatgactctgaaaacttttattttcatctagcaagaaatcaaaacctagaaggaatttatctgagaaattatgaatatttggagatgggaagctcatggcagtgacactaaacatccacattattttttctttcttctggctgtcttaagaccataagttggattgcttccaattggggatagtgaaagagggagtaacacatttctagactgggagatttccatagactcccatgtggcttaactcttgctgagctggggaaagaccgtattcatgcctggtattactaggtaatgcgaggatagaacaagaaaaaaaaataaatcccgttgaagggaacgaattttttttttcatttttaaaaatccatgtcctttggtacattgtggtgggttttacaatataatttttcagtgggtccactacttccctacagtgtgggttcctaaacagagcaacaggacctctgtgctgagaaatccaaacagacactgatggcaccttctgccatttaggaatttgttttaaaacagacatttgtctagatatttcctttgtggcctcctccccatcaaaagtcaatcaaacatcgagccttgttaattccaatacctacatatattcaaaattgtccacttactctatgtagagtgacacgtctcttttccaaggcattgttatttgtattagaaaaaatggtgagagactttacaatgggcaaaaaactagtgggtgtcctgttagctcaggcatctgaattatctctgcctttaattacttttgagctactttacgactaggtaagttgtggaaaataggtatgcaaatgattcttatccataaaaatgaaaattatttgtaaagcagttaattattactccttggatagaccagtttttgcatctattgcaaatctatttcagttttcatttttcttgtgtaaaacatgtgtttttaaaaattttcccctgaactggttgtaacagcttactgggtccctcattaattaatgagttaaataaatctttgacagacattattatcacattggtttgagagttatgactttaccttgttggaaaattatccttgaatacatggaccactgtgataatctgctaattggttcttccattccatgctccaccttctccatctccctttcctttttttttcttttctttttttttttttttttttttgagacacagtctagctctgttgcccagtctggagtgcagtggtgcaatcttggctcattgcagcctgcagcctctgcctcccaggttgcagcgattctcctgcctcagcctccctagtagctgggattatgggcgcatgtcaccatgcccagctaatttttgtatttttagtagagatggggtttcaccatgttggctaggctggtttcaaactcctgacctcaagtgatccgcctgcctcgacctcccaaagtgctgggattacaggcgtgagccaccacgcccggcctccccttccattttcaagagagtatctacggtgcttctaaagggtaaacctgaatacctttttctcttctgtaagctctttcgttgggtgcccattttcctttttttaaaaaacacaattaaaaattgaaattgtataatttttggtatatagtgtgatgttttggtcttacttggttcttaaagctctaaatagctgcctcccaatttactcctaattttattttactttcctctcgctccctcattttgctccagccacacggcctttgcttaccatcccggtgggccctccctggcctttgcacacagtcctttctctatctcttcctggccagctcctaccccttcctgcttgtctgagcttaaatgttgcttcctgaaggatctcttttctgagctcccagactagggtagataagctgtatactctcaaagtgttatgatttgaagcacttaccatactgtaatttaaatagttgccagccttttttcctaggttagacataaactctgtgggtgcagggactttctatttgcttattggcatatcttttggcatttagtaggtatccagtaaactatttgtaggcttaataaataaatgaatgacaatgacatagacatacattgaatatgcctaattctatatgttcataagccacttggggatggttgcattggagagacaggagtagagtttaggactgagtgcaacatggcatgaattgtgctaagtcctggatatgaatacaatgcatcaggacttttgctgcattattgacaaaaataaacaaatccagctatccaaactttccctatttacctgatttcttggagttgtgctgcagtgattgttaaataaccacttggacttaatgcatattattgttttatttacccaatacaattcttcacatagggtctaactattaaattcactgtgaagaaaaataagacttaaaacttaaagccagaacaattcttttcttgataagggatttggtaaagaacttgagaataatatcagtctaaaaccatcttttaatttgtaactgtaaatgaatatacagtaaccaagacagtgctcactcaaaatatgtattctttttgctgcaaatccttgtgaacatatcatggagtatacagtgctttggaattcaggatcctgagaagtcatagtgtagagtaaattatggctcttggatttttaaaagttatgaagagctcagaaaaagtgattatctaaaaaaagctaaaaattaggaaattaaacacttatttctggatatcctgctcatttatttatgacctcaggcaaattattagtcaattttttcagatcacctggtctacatttccatagccataagacgcaatcgatcattattaccttccttatatcgtgaagaaatattgaggcattgctgagaagtgtataggagatgataattacttaggaatgcaaaataaaaaccctatcatatacctcgaatctgtgatagtcctgatctgtggatccgtgccacacgtaaacagaaaagggaaaaagcactggctcattaagcccgcgttcttccattgtatggtgtgtatgacttgagtgttttgccccttctaaatttcagagcctctggcttgttagccggccggtctcccaagggaggcagcaaaggcctcattgctttgctttgggaaatttgctctgactttgagcctgcattttctttggctgactttcagagctgctcatctggcagagctgaaaacatacaaattgcagaagttcttttatccatttggtgagatggttctctaaagaggcttcacaaataaaggttaggtagaaaatatgcaaaattaaaaatgctgaacttgagtttgtgcaaatccctgcttttctcttttctaagacacagatgagccaagttttcatgtaagttacaattccaaccttgaaattcaaattgacagaacgtaagagaggaaagccatgaagcattttttatggattccaatatggagagctattaagatgttttcctttaggagacagtgagacattgcttttagattgttttcctacttttttcatgttggaagttaataatcactaaaataagggtgggaaaagatgtggagggagatttgtacaggaggtgcaataaaaggagcccaaacccttttccacctctagatattcagtcttctctttagtactgtaaagaggctgacaggcttcctgtgtgaagataaatcccatctatagtagaggcttgagcttgaagagttacacattgggtctgccattggtttatttcatgagtatgcatatggcaactcaactgattgttttaggagccatacacattcaagtggttccttaaaaagaaatgtgaatttgtgtctattcactaatacctctaaaaagaaaacaataaaatgtactccatattcttaaacaccagcttccagatactttggctatacttatgcaagctttgttgttgttgctgtttgttttgttttcattcaatttgaatttttaaaatttgatttttgtctcaaaattgtttgtaaaatgaacttcaccttggttaaaactaaaaacaaatgattaaaattaaaactgtcaagtattatttaatatgctatgctttgatgagtacttaatacagggttttgattcagcctattggtattcataattgtgaagcaaatttggtagtctttgtaattgacgatcagtttagaaattgatcaactgggaggaaatgacttttcacccttcacttaggaaggagtgagcaggaccaccttccttgtgctttcccattcagcctcttgtggccccaccatctctagcttcagagatgggctctggtggtgcagggaagggtgggcttatgccagggtgggaagtaaggtatcaagaggggattgctgagaggtagtggttgaggggagagaatctctacctattacacagagcaaggagacactggacccatttccagctgtatctggcctgggaagcttttagctgcaattgccacaggtaaccatccaccagccatgaggggagtcacacttagggggaagctgacatttatttttgttattatttgttggagaaataaaaaaccctgccaacactggtacctctggttaccaacatagaatacagagaaaacacaatttacaattaagtgtgcatgtatggttaagtgcatgcaggcagttggctaaagacgtcaaagtctggacagaatttcacacaaatattcagtaaagtgggagaaagaacaatgaacacttgtctctgtgagagacaactagatgtgccttgttgtgatagtctcttgtccaccttctcaacaactcctgtgtttaacttagcttgaaaaactggagactggatttatctatttcctgaccaaaaaaattgggtctattttgttttaaggagacaccctaagggaagggaaggagcagtgtacctgcctctcctttatatatattgaacaaaggaactttgattttatttacctttacactatcataatcagtgctattaccagtgcctcaccctagtctcatggaagcctatcttttgaaggactgccttcttcaaacatttctactgtattgccagttgtgtatacatggaataagctatattgtttcctgagtttgcctacagaccttgcctggtatgcataaagagtcagagctttttatttatttatttatgttgttttatttccataggttttggggggaacaggtggtgtttggttacatgagtaagttctttaacggtgatttggtgaggttttgatgcacccatcacccgagcagtatacactgtacccgatttgtaaaattttatccctcacccccactcccacctgcaccccccgcccaggtccccaaagtccattgtatcattcttatacctttggatcctcacagcttagctcccacttatgagtcagaacatatgatgtttggttgcccattcctgagttacttcacttagaataatggtctccagtttcatccaggttgctgcagataccattatttcattcctttttgatggctgaatagtattccatggtgtgtatatgtgtgtgtgtgtgtgtgtgtgtgtatatacacaccacaatttctttattcactcattgatcgatgggcatttgggctggttccatatttttgtaattgcaaattgtgctgctataaacatgcatgtgcaagcatctttttggtataatggctccttttccaaatgcctacctctgatgggcatttgggctggttccatgtttttgcaattgtgaattgtgctgctataaacatgagtgtgcaagcatcttttttgtataatgacttcttttcctctgggttgatacccagtaatgggattgctggatcaaatggtagttctacttttagttctttaaggaatctccacactgtattccatagtggttgtactagtttacatttccagcagcgttcccttttcactgcatcctcgccaacatctattggtttttgattttttgattacagccattcatgcaggagtgaagtggtatggcattgtggttttgatttgcatttccctgatcattagttatgttgagcattttttcatattcttgttgcccatttgtatatctgcttttgagaattgtccattcatgtccttagcccattttcttttttacttgctaatttggagtcagagcttattcagcctccagccctcacctgattgtccgtggagtatgctagtggcccctgcctctggccgccaggtatctgagccccacagtggtttcttatcatcccagattttatcatcactataccggtaacttaccaaaatcgaggtaaacattctgttacatgtctgtatgacttgtgattccctgaaagatattacttggtttggcatgtgttttacagtattttatagttctgaaggtaggtgcacatttactgattcggagtgttctctgcacatttacagtaaacactgtaaatcattgctctgtagttaatgaggcatactctgtgatgaccagcaccatctgtttctcttgtctttctctcttcctcttcttctctccctccctccttccaagcaagcttctaaatggaatctttttcaattcttagcaacttatgctgaccacccagaattcttaaagaggacggctgagagatctgcagtcactaattgtttaagtgactggagcacattttgctggttttctgttgtcgaggtgtggaaggaactcattaggcattattgcagtgccctcattttactttcagtcttctctgtggaaagcaatgctgtgtttgttcttttaccacagagttgaatcataaaagtaaatactacatatcatacagtcttcatttcgttgattcaactacacattttataattgagatgaacctaattttatcattttgcttaatcttgactagagacagcattctttttaaaacatctattatttgttttatgcagtaatacataaactttgtaaaaattagataaatcaataaatccaaagaaaattgttcaaactacttttaattccactaccaagagaaaaagtgtagcattttgttgtataatggtttaaaaatgtattatcatataaatatattatcattaactaagatgatgtacatagtgcttactgatgcattattgattattaagaaattgaaaaattacaagaatgtaaaagatgctacatttgtgtcagtgttgaaattggggttcatgagttaaagattctaatttgaaaaggtttagaaatgttgcattaaattatttctttttgaatttttaaattaaccaacttcttgcaaaaaacagatgaggagggagagagagagaccataaaatttacaatgttatcagatgcttgggcatcattttgaactatcaggggcatcagattaatctcaaattaatctgaggagagtgtgaatatattatggtatatacactatatatgtttgtgtgtgtgtgtgtgtatatatatatatatacacacaccatacacacacacacacacacacacacacacagtaaacaatgggactggtaattgaattaactagagtgtctcaaatcctgttttgaaaatagggtgtaaataaataatagaataatcagtgtcgaagggctcaaatttgttattcgtttgtaagatgacactcatcagacatgttacttttgaaagcatttaaaatctgttatcttccaactgtttttattatatgcagttataacttgattgctgataatgggtttaggtaagtcataggacagattctgtctccctgctgtatctgtttctttgtacaattttggcagcaccaagctagatttgcaaattcaccttaacgtgtttgccatattatgttagtactgttttttgtttaaatctacagtcatgtgtcacataaggatgttttactcattgatggaccacatatatgatcgtggtcccagaagatgataatgaagctgaaaaattcccatagcttagtgatgctgtaactgttataagggcatagcacaatgccatttactcgagtgtattagtctgttcttatgctgctactaaagacatactccagactgggtaatttataaaggaaagaggtttaattgacccacagttccacatggctgggaggccatggtgagaagcaaaggaggagcaaagtcacgtcttgcatggcgtcaggcaagagagagagcatgtgcagggaactaaccataagatctcatgagacttgttcactatcatgagaacagcacaggaaagacccacccccatgattcacttatctcccactgggcacctcccatgacacgtgggaattataggagctacaattcgagagttgggtggggacacagccaaactgtgtcatcaggtatttgtggtgatgctgttgtaaacaaacctactgtgctttcagttgtagaaatgtctagcacatacacttatgtacagtacataatacttggtagtgataaccaacaactgtgttactggcttatgtatttattataaatttatcattatttaattaatttatttattttgatatggagtcttgctctgttgcccaggctgaagtgcagagatacaattatggctcactgcaacctctacctcccctgttcaagcgattcttctgcctcagcttcctgagtagctgggattacaggcatgtgccaccacgactggctaatttttgtatttttagtagagacgggatttcaccatattggcaggctggtctcgaactcctgatctcatgatctgcccgccttggcctcccaaagtgctgggattgcaggtgtgagccactgtgtctggtccattattttagagggtactcctactcattaaaaaaaaaaaaagttaactacaaaacagcctcaggcagttccttcaggaggtgtcccagaagaaggcatcggtatcataggagatgacagctccatgtatgttattgcccctgaagaccttccagtgggacaagatctggaggtggaagacagtgatattattgatcctcaccctgtgtaggcctaggctaatgtgtatgtttgtgtcttagtttttgacaaaaaagtttgaaaactaaaaaaatacagttttaaaaattgaaaaagccttgtagaataaggacaaaatgaaacagaatattcttgcacagatgtgtgatgtgtttgtgttttaagctgttattataaaagtcaaaaaattaaagaaattgaaaaatttataaagtaatctaaggtttattattgaagaaagaaaaatattttaaaaataaatttagtgtagcctaagtgtacagtgtttataaggtcaacagtagtatacagtaatgtcctaggccttcacattcatttaccactcacccagagcaatttctagtcctgtacgcaccattcatgttaagtgtcctatacaggtgtactatatcttttttttttttttcgtttgagacagcgtatctctctgttgcccaggctggagtgcagtggcgcagtcttggttcactgcaacctccgcctcccaggttcaagcgattctcctgcctcagcctcctgcgtagctgggattacaagtgtgcaccaccacaaccagctaatttttatgttttaggagagatgggtttcaccacgttagccaggatggtctccaactcccaacctcaggtgatccacccgccttggcctcccaaagtgctgggattacaggcatgagccactgtatccagcctaaaatcttttatatcatattttgactgtaccttttctgtgtttagatacataaatacttaccatgtgttacagttgcctgcattattcagtacagtagcatgctctataggtttgtagcctaggagtgatatgctataccatctagcctaggtatattgtaggctattccatctcggtttgtgtaaatatactctatgatgtttgcacaatgatgaaatcacctaaggatgcatttctctgaatgtatccctgtccttaagtgactcatgactgtatttggaatctgagtgccgtgaagtcaagagctgctttcaccagccttgattttcgcatactgtatgacagaaagtaggcactgatctatctctctactggaaaatccaaggcccaattctgcatctgatttgttattgatacaaagaattagaatttcactcttttaagaaatccaaactgcactttctaaatcttactttcttattcaattttttgtagatttttttctattactactactattgctgaaaaacatgatctgtggtagaaatattaataattgtgctttgagagtattgaagtagggtaagaataatacagtatcagatcagagagagggtgggaccagatctcacaagatttttatttggagtttggattggatttgcctgtaatggatgcccattagggtaaatcagggaaattgacacaatgtggtctgcacattaaaattggaattattctggctcttacgtagaagcaaagagatcagttggctggagctggagttcaggcaatagataatggcggtttgggctagagttgacacaatgaccatggtaagaagtggtcatgtttgggatgtgtttttggaagtggaaggacagggctggtgggtaggttagaggtggagaagaagtgaaaggaaatgaatcaggaatgactcctttgtttttggcctgagcaagagtcattatttcttgatatgtgatgtatttgcaattaatcatattctgtagtccgtggatgtgtgtgtgtgtatgtgtgtgtgtgtgtgtgtgggtgtgtgcatatttgtgtgtggcctttctccagagttgaccagttccttaaggcattcctctttgattaatcctatatttcacctatatgtggtcatgctctatgcagaaattgctcatcggtcaccctatgacctggtgtgcctgtagacaagatctatttgtttagcacagtgttttaggaaattacagttaccaggaggttatacatataaattcagatttccaccttctttttaaaaatgagaagttctgcccacagtgaacctgaattcccatatggccacccttagctagaactgagcaggagctgccacttgagcctgcagagccagctgattctccagatgtgcctggggctcatcaggtttgcttccctcacatgtgtcatcactgcagttgtttgcagcccttgctccccgctagacccccctggcttctccccttgcattgtgctgaccgttcgcctttgtgctctaacattttaaaatccagcagcagtagtgtcccagccgcaagcatgagtgctggtctcacttgtcaaaatggtgatggtagagggagatgagacttggggacagccaaagctggccacgccagggctgtagtatctgtcatctagagttgtgtcatgtggttgtttactttttttaaagttaaatgtgacccaaggcttatatacccttcaagttcaagactgttcatttataccattttgtatttattggaaaactatggaaactctcttgagaataaggagaatgacctgaacttggcatttctgcagggccaagcacaaaggaggtattcactaaatatttgtccaaatgcattattcaactgtattctctttgtcagagaagtctctgcaaatgagtctttgcaaagatttcaaaattgaaataagaggttaactgtcaggatgaatcagtttttatttttattcatagatgacttctgacatttccaagctgtttcacagagtggatcccaagtttacagcttgtgataccaaagcaccagacacgctttaaagtggtgtactagaaaaaaaaatagtctgcattttgaattcatcaaaatgtagtatatatcttgttgctctctttggggggccactaaatatatcccacccactccagtgattaaatatttttttccctacatatcccagtccagtgatgaaatattttcttccctatctgtcctagtcctgtgtcttcataattttagtagcagtatagcacagatgttgaaaacatagatttagagccagattttgtggtatcagatcctggttctgcctctcatttgttaagtcacctccacatcagtttcttcgcctgtagaatgaagaagatgatgctgtttttctcgaaatactattataaggaaataaataatacatctaaataatacaactaaatctttataagtctcttagaacatatgatacatagtaaatgcttgctatcattatgtctaagaacatttcatatttctactgcctgtttccgtatggcctatgagctgagaatggtttttacagctttaggtggttgcaaaaaaatcaaaagaagagtaatattttgtgacatgtgggaattatgtgaaattcaaattttagtgtctataaataaagtttcattggaagatagtcattccaattggtttatttgtttatgtattctctatggctgctttcactttacaacaaaaggtagttaattgtttttgaatgagatatgttcctgcaggtcatcatatgacatattaatgaaacctgagacttgtgagatctttctctgtgaattgacactaccatgttctcatgttcagggcctgcttttgccttcctgcttgagatgaagaagtgcttagttgttgtctcagtcctttcagatattgttgatattttattacacttttctgccaatagaaaacactaaagttatgcttgtgatatagtcacatcaaccatttaatgaacatctgtcatcttagtttaacaggtaaacaaatagatgcagaaaggccaagtaacttgcccaaaattctatggccaataagaggcttcttgtttacagatgaggtcattaatggacatccataattatttataatatgaataaatatttatatttctttttttttttttgagatggagtctcgctctgtcacccaggctggagtgcagtggcgtgatcttggctcactgcaagctctgcctcccaggttcatgccattctcctgcctcagcctcccgagtagctgggactacaggcgcccgccaccacgcccggctaattttttttttttttttgtatttttagtagagacgggatttcactgtgttagccaggatggtctcgatctcctgacctcgtggtccgcccgcctcggcctcctaaagtgctgggattacaggcgtgagccatcgtgccaggcctgtatttcttttatataatgctgtttttgttgttgttgtttgtttgtttgtttgtttttttgagacagagtcttgctgtgttgcctaggttgtagtgcagtggcatgcagtctccatctcctctgggttcaagcaattttcctgcctcagtctcccaagtagctgggattacaggtgtgcaccaccacacccagccaatttttgtatttttagtagagatggggttttgccacattggccaggctggtctcgaattcctgctcaagtgatcctctcgcctcggcctcccaaagtgctgagattacagacatgagccaccgtgcccagccagttgttttatattatactattttttggaaagtggagagtggatttgagaagggtttcaggctgcccaggtgttatattagctgcccttgccatcatcagtattttctaagatcctttctatgcctatataaccccatttgtttctcccatgcgctttacctatataatatatttttgctatgcctaagacctgaaagtgaattcggttatttgttggctattttgcagaattgtacttctggttgggtgggggagggggattagacgtaggcaggtgacgaaggccacttctgcccattgcttttactgacagtgggtagcaagtcctcaggggactttcccctcaaggggaaattaccccttacccggcttcctgaagttctgcctctggaaagtggcccctgcatcttgcacatctctgtgttattttgattgatggagaaaatctctttgtccctgaatctatcgctgcctgtgaaaaaggcagctgggaacagaaaagcagctttgtttcagatatgaataagtaacagtgtattctttactgattctgtggtgaaaatttactgcactttccctcatctgaagtatatgaatgatgaaaaaggcacatgctaaaaattatgagttggctatacctaatacctgtttaaaaacagatagagggaggggaacaagggttgaaaaactacctactgggtactgtgttcactacttgggcaatggggtcattcgagacccaaacctcagtgtcacacaacatacccatgtaacaaacctgcatatgaactccctgaatctgaatgttttaaaagataattaaattatgccttgtaaaaaactaaataaagtctagttcaagggtcagctcctgtctgaagcctttgcccactccctggcttgcagtggtcttggggtctctctctcctctgtgcttctatagcactggcacacttttctattccagaccttacacatcgcactgtaattgttattttctaaaaaagagtatcacttccactgaatggtaagctgttgagtgtgcagaaatatggaatctttattcatctttgtaattcaggtctcttcaggtacacacacttgtgcgcacacagacacagacacacacacacacacacacacacaataaaaacagataaggaatcacgagggaaggaaggaaggaataatgccaaattttaggaaacttcagaatggctccttcttccccctcctccatttcaaactcagagtaaagttttgcttcatatgaatgatatgtatatattttttaaagtgagaaatgaagaagataaaagaagtattggttaaaaaatatctattattgacaggaagtgggactgttcatctctgtggagattttattatataaggcagtaattcgatacaagataatacaacatttattaaatattacattgtattctgtagttctcagggcattttcttataatattctattatttgatctttacagtgacttttgatttaaaaggttaggtagctgagccaggttcaccaggtagttaaaggtcaaactggacttaaagccgaggcttcctgattttctatgcggtgatcaccccattgcataataattcattgtatcacagacaggcaaggatctaccaaacttacagtgaatggagtgggattttctggcatcagacactagagcaggattatctgtgggagttgatgctatttatcaggaaaaagagtttagaaattctataagctttgtcagttaaaatcttggactggtactagttttaagcacaaaaagtatttaattgttaagcccaaagtgccttaagtgttaagaaattaataaccagaaatacagactgaacacctcagccctgaaattgatgaccaaatcacgtactcccataatggaaaggctggaagacattgtcacactgtgatgtgagacgcagtgatgaagtgacagtccttatacttttagttggcctctgcacccggatgttgtaggctcatttacatttttaatgcgtctcgttatcattgctttctcaggaacatatgccatactcaaggcctattattttgtcgtttattgttctttcttccactttactgtatatttgtgtgaaattatgtccagactttgtagtgtttttgttttttgagatggagtcttgccatgttgcccaggctggagtgcagtggcacgatcttggctcactgcaaccttcacctcctgggttcaagcaactctcctgcctcagcctcccgagtagttgggattgcaggtgcctaccgccatgcccggctaatttttgtatttttactagagatgaggtttcaccatattggccaggctggtctcaaacttctgagcttgcctcggcctcccaagtgctggaattacaggcatgaaccacgatgcccaacagcttgatttgctttctttgtaaggaaaaatgcaatttatttcagcttaaaatattctttatgggatttaaaaatttctgtatttgtacttgttctttctataaaagacaaatttgggccgggtgcagtggctcacgcctgtaatcccagcactttgggaggccgaggtgggcggatcatgaggtcaggagatcgagaccatcctggctaacatggtgaaaccccatctctactaaaaatataaaaaattagctgggcgtggtggcgggcgcctgtagtcccagctactcgggaggctgaggcaggagaatggcgtgaaccctggaggcggaggttgcagtgagctgagatcactccactgcactccagcctgggcgacagagtgagactctgtctaaaaaaaaaattaattaattaaaataaataaataaataaaaacccccaaaagacaaatttggatagtctgcagatcatccacaacattttaattgagcaaaaaatgaagccactcatttatttgcccaggtatatatggagtttctgctgttggcataccccatattttatttgtgtttttcttttacagagtgggaaaccacccatcaatgatatgttcacagacctcaaagatggaaggaagctattggatcttctagaaggcctcacaggaacatcactggtgagcaagtcatctttgtaaacaacggagtctccggtcattgctgatacttgatgacccagtgtgggtacccattaaagtgaaagtatccattttactttacgttcaaatgtaaaggctgaaattcggaacatttttaacaaagcattttaatgagtgctttgatacaacaacattttggctcttctgagggctctgtttttattgaagataaaattaccttaaatgtttattgctctgagacagcccaggatgagagaattacaaaaaagaatggatttatagagaggacacaatgttttgaacagtagagtctggagacaaacacatttaagagttaaatattttttaaaacagttgttaaggctgggcgcggtagctcacgcctgtaatcctagcactttgggaagccaaggtgggcggattgcctgagctcagcagttcgagaccagcctgagcaacatggtgaaaccccatctctactaaaatacaaaaaattagctgggtgtggcggcatgtgcctgtaatcccaggtactcaggaggctgaggccaggagaattgcttgaacacaggaggtggaggttgcagtgagccgagattgcgccactgcactccagcctgggcaacagagtgagactccgtctcaaaaaaaaaaaaaagttgttaaaaactatgacatctattttttattcagattttcaggattatattttgttgatttattttttaaatacaactctattattttatgtgtggggtactccaaactcatgcagataaaactgccaataaagaggatgcatgtatgggtacaaatgttaactctagaggtagaattactatcacagtacagagagatgcactcctgaagatgaatttctttcttgcagaagtgtgggatgtcattctctctctttgccctccaggtagtgggtagacaactgttagacaggctgattcctctctcagataaggttctggccagtgaagtagaaagaagctgcataggttatctttccccagatgggaattccctgccttccgagggctcttgcaatgctacctggagcctgggatggtgcctctgaatcctccttgctctgttcacatctgtgcagaataaagaggacacaatttctctaaaatccttctgcagccagaccaattaagagaaaggaagctttgttcatagagcactggtttccaaacttgtctgcacattagaactacaggcaatcttttaaaaatcccaagtccagaccacaccctagacccattaagccacactctttgggggtggggttggacagaggtattggtgtttttatgaagctgcctaggagatttcaacgtgcatgcaagttagggaactggtatcttaagatgttgttagttgagggattttcatactgtgaacaccagcttccagggtggtaacctgagacctcagccagatctcctgcctctgaggggccctgtacgctgagcttcacttctgtgtgtatctcagtgctagtgttagtcaggcatatggagggacaatcagttttacttgcttttttgttttattttccagccaaaggaacgtggttccacaagggtacatgccttaaataacgtcaacagagtgctgcaggttttacatcagaacaatgtaagtgtgtaatgtgagttctgggggtctgtgctgccatcagcattatttattgtgaaactcaccaactgcttgatgcattggcatccactgattcttgcaaacattttttcttatgagaaatactgaactttttctgtgagtgaagaaacagtcatgtgctttttctgatggctgtattgatctgtagtataaataatacatttttgagatttaagcttacctgattctctaaaatgaaatttctcttatctctcacttatactgctgtccaaatgtgctaaaataaaaacctggagttctgtgaagaaattgtcttaaaagcgtttttgtttttgttttttgttttgtcttaataggtggaattagtgaatatagggggaactgacattgtggatggaaatcacaaactgactttggggttactttggagcatcattttgcactggcaggtggggaaatttccaatcactttttaatagagatggaaaatgtgttgtttgtcttttagtttcttaaggctgccgtaaccaagtaccacaagctgcttggcttgaacaacagaaatttgttgtctcccagttctggaggccagaagtccaagatcaaggcatcagcagggttggtttttcctgagggctctgagggagactctgatccaggccttgcccccaaattctggtggtttgtctgcaatttttgcagttccttggcctgtgataacatagctccagtgttgacgtggtgttctccctgtgtgcatatctgtcaaatttcctctttttgtaaggacatcagtcatattggatttagggcccacattactcctgtatgacctcattctaactagtgacatctgcaatgaccttatttccaaatagagcccctctctgaagtactgagggttaggacttcaacatattaattttagagaacataattcaactcataacaattttcaatggaagaggctgacaaaatgccctattttcctggcatagggaaaaaagtacctacctttcttatgttaaattttaaaaagggacataatttcacatctagaaaagttgcaggaatagttcaaagaattcccaagtacctttcactcacatttcctaaatgttaccagttgtctatatttcatttgtactctctctcagtctgcctaaaatatttagtgtgtattttctaacgccatggcattctcctaaaaacaagaactctcttatgtaaacacaatagcatattggtataataatatgagatgtaaaatattgatatttaaaatgccaattattgattattaaatatgaaaacttagtatataattattaaaatcaagaaaataacattgaaataatacaattatgtaatctacagatcttaagattttgtcagttgtcccaataatatccttagtagcaaaagaaaatctgagatcatgcattacatttatttttcatgtctctttagtcctctttaatctggaagtttttgagtctttgtatttcatgatattgatatttttgaagagtgctggctagttattttgtagaatgtctctctcagtgggcttgggcttggctgagctttccttatgattaagttcaggttgttcacttttggcagggacgtcacaaaagtgacgtgagttcttcttagtgcatcatatcggggataggtgatatctgttctttttctggcagtgttaactttgattgtttggctaaggtggtatttaccaagtttcttccctgtaaattgactaccctttgttattaaaagtatcgggtggggatatactttgagactgtataaatatttagtttttatcaaacttttagcacccgttcataatttttgcctggaccagctattattatgatgcttgatagataatgattttctaatttcattaatccttctacattagttggtgttctacttgtaaagaagagcttccccttgtttcttgtttctctatcttatctctctctccattcatttattcatttatgtatcagtatagattcatggacatttgcataggtttatgatcttttactagtactcatttcagtgttcaagtcatcctagatttggccagtgtgagccccttaaattggctcctgtgtcccttagatagatctatgtcattctttgagcactttcttaaaacatatttactaatttagaataatactataaaatgttagttctagagtataatcgtgattgcagtcaggaaagatactttattttgtagtcactcaaaagtttttcctttctcatttttgtagaaaataaaatttaattgaaaaggtctttgtaaacacatagagttaaatatgactttctatgactgtgaaagttatgttcattgtaaccaaacatagtacaagtattgcttaagatatagaaaacacagtaatgtataaaagtgaggtaaaaatcacctcaaattctagtcccccaaaataatcactgttaaaatgtattgctctagtgtctacagaaaaatctgaagtaaaatgaatgccagttacctgatccataatggttaattagtgcaatattgctttttcaaggacttcattgaagtaagttgaagtaaattactgaagtattagttatggacaggcctggtttctcttacataggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataagtgagacattactctatctagaagtgggctttacaaattcatgtctcctctctgtccctttgctgccaccactactccctgaagccccttctccagtgccactgctctcctttctgcacatgttctaccaaaaccttaagaaaagaaatatcatggaagaaaactacccatcaggtttttatttccttaggacttaaatgctgcaatacaaggtccatagtttctcctgcatatttatgaatttaaaaaatatgaaataattcacaaagttcaaccccactcattcagcactaactgataatgtatacaaaaaattgtgttagcttttcttctcaaactgaaagtaaaactctgtaaattcaatgcattcccaattaaaaatagccaaattgtctttaatgaaacttgtgaacagattctaattatataaaagacgaggcccaagaatagccagtagacttctgaggaagaatcaggctgaaatactttccaaaaagaaaccaaaactatgaagctatattaattaagactatgcagtactatcaatatacacaccaatataagctgaaccatatgaaattgccgacatgtgagtgtttttgctatataagaatggtgttttcatatggttcaacctaataaaattaagaactcagaaattgctccattacacaggaaaatctgatatacgcttgagctgacattgcagattaatagatgatttggacaattgattacccatatataaataaatgtattggatctttacttcaccacactaaaaaaaaaataataatttctacatggatcagggatttaaatgccaaaggcaaaatttgttatattttattgttgtaaatgattacttttctcaaatttcacttcctctatgtttttttgctggtatataaaagtgcaatagacttttctacgtcttatatctggaaacttaatcagttcttacaaattttagtaagtttgtctctagattgtaggtttcttggaggaggagggattagaatgtcctagaattatgatccttttatttcttctgttttcttttttgttctctattgtgccttgtccttcaatgcaatgttgatttgaattggtgatagtgggcagaatttttgttgttgataataaaaggagtgcttttagtgttttaccataagaatgatagtttttgtagcttttttggtacactttttatgaggttaaaggaggttgccctaggtttttagttggttaagggattttatcaagaaactgtagaattttagccaatataccattccatttattaattaattgattcaacaaatacgtgtggggtgccttttatgtgctagacacagggtatacagcagagaacaaaacaggcaaaaatcttagttctcgtggagcttatgttccaacagagggagacaagacaataataaagttgtgtagtatatagaaatgtacacacactgaaggaaaatacatcagacaagagcagaggaggcacttggcatcggagagggcagtggctgcagtgacctgagtggggggagtaatgggagatgaattcagggagggaagtgggggaagtgcatcccagaaggtgggtgggtctaacatgcaagaacagacacagaataaagaaaatgattaacttttggataagtcaaagcaacaataatgtccaatttgtgagattaaaagaaaatcaagatagaaatgaaatacagtcctagacaatatagtagtagcatggaagcaggggattggagggaaactcttccaaggcttttgttttaggaatatcctgagaacagattagagctagattttgtgttctgctaatcttgatcttttaattgaagaatttagtccattaacattgattatgattatttatatatttaggttcatttttaccgcatagtgtgagctgctcatttttcttattttttctgtggttttttttttttttactttcttatctctttttgtatcggtaggtttccctttacccccttttcttcttctactctttgggaaacattatatactacttctagtcttaatggttaccacagaaaatagcagtcctatttagctaatacaagacccttggaaagtattatctgttattttcatatttgtgaattaatttcaagtatgtatttgacaagcctttgggatataaaaataaactcaaaaaaacctcacaaataaaaataatctaaaactaaaatgtattagattataacaatgcctactttgtttccacatatttcatcttcattgcattttatttgcatggttttcagacctgatctcttcagctgggataaagttgtcaaaatgtcaccaattgagagacttgaacatgccttcagcaaggctcaaacttatttgggaattgaaaagctgttagatcctgaaggtattgtccagtatttaatttccaccttgattttgctttacagttttgcattcttgaaaagcagtgtttctttgtccttttaaaaatgaattatgagacttgaagaaccttttcctttttggagtataggtgcgagtcattttattactgacacttattaatacttttgtacttagcagtttgtgggatcttttaggtagaaatttaactacagcactggacaatagttaatctaaattaagtaagagttaaagttttaagaaaatgtaattattagataaattcagtatctggttagtccaataaaatgcatttttatgtgagcatcttgcatgtgatgtaaagactttagttataaatgttgcaggattgaattctagacttattttcatagtatgaataaagtctgtatctttatcttaaatggtaacatatggtagcttatctttgaccattttggggaggcttttagggaagactttaaaaaatgagatactgaacaaaaataagtaatcccttttgcctttgtctcatatattatgaagtggcaatttactggtattgcaaagattatatattaggtattgtttatgggtactaaggagagttattttatatctaatattgagcaattcacatattttggacacctaatttaagctggttcttatattcttccacttttagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacaggtacaggtaacattttattaagatgtttggcttgccgtatttgttttctcctaggtactagataaaaacacttttagagggtttttttcttgactgagaacatcttggtttctcagcttacatttgcataagaagttcagcttagcagttagcattctgtcacatgtgtgtaatagaacaccataactcaatggactttattaagaaggaaaatactttatttcacccagcaaaactgggctgttgctcatgctgctgcatgacatgctgggaatctatgttttcacatcatctggttgccagcttttatttctgtcatgtgctaaagatggtttttctcatatcagcctagttttttttctaagtactaattgtctttctttttttgccattgagaaaagattttttttccattatatatctcacaagggctatcaaaatgtaagccttattttccctttcctttaggaggagtaatgtatggtaaactacttggtgagcttttcatgaagggattacgatgatttcattcatcaggatataaatgaatttttaaagagagaaataaaatcataatttattttcttccttagttctactgtttgaatcaatccatatttaatctcattctgttttagtctagccagtccttgtaattcataagatgagagaatcttaagaattggaccttagaagtcacttggttcaacattctagtgaccaagcaaccaagacatacatgtagatttcaaaattataagaactacatttcagagagaaagaaagcttctctggatggaccttaaattcatcctgttgctacttgttttgggttgttacttaaactctcaatcacagttttgtctgcaaaatgtggttaaaaccaccaacttcataaagataatgaattcaaagtatctaaaatgacattaataaacactcaacaagcaacagctatcattattatcatttttcttcttgatttgttttggcattctcatttaacagatttctttaaaaaatattatttaattcccatattatgatactagtcttgaattgacatagcatcttttttttccatcctctgagattcagagaatttacttattcttttaaattttctttgggtaatatgtacccatccttttatttcccccgtttcaaaaatagtgtgatttatagaaaaagaaaaaaatttactgaaaagaaaggattgagaaatgaggcctgattgtgaacccagggctctcttttgtagtgaatatcaaatgatgctgaggaaaattcctaacttactataattgaaaaaaatgctaggaagtatttgcctctaaaagtatagttattattctacattaatgatgcacctttttagttggctcagatgatcttctgagtttgttacagggttttagattcatttccttattgcattttgttagaaggaggagatattttatttagttcttatagttaagggccttctctcttaaaaaggaaggagacttcatttacttttcatgatgtgtagataaaataatcacttctgtttagggctcagcgtggcatgataagaacttcagaaaacatttgctatttgattaagtgcaagtgtattaacacctcttcatttgcaagctttcattagtgtcttagaggctgaattacgttaattgaaaactaaaatgtgatcaagttttaatcatctctctgacatagcttgccatctgctactctcctaatagtcagacttcttctgccctgttctttctacaaacatacgctggtggtcaatgaataattcctgcatttctctttaaatatccgtcagttgaaagtttcctcatgtgttcgaattaataccgtctgaacatttgtgtttagatagtgccttccttctcgacctcatggatgctggtgcctatctcagtgacctttggctggtcactaactttcctggttcttagaaattctcattatagtatagaggtttggagctaaatgatctccaggggttattttagctctacagttttaggattttttgtccataacttaactcatttttctttctctgtctttggcaccatctgtcttttaattatccactgtttcgactctgtgctgattggttcatttcttaactcatatattcagtttcctggattcttcaagccttcctccaaaatgtcttttgtgtgtgttttcattttattgcagccttcatactcatttttattttatttttttagtattatactttaagttttagggtacatgtgcacaacatgaaggtttgttacatatgtatacatgtgccacgggtggtgtgctgcacccattaactcgtcctttagcattaggtatatctcctaatgctatttaaagacttcattttctcctatagtttacaagctgtggcctacctctgctactctgccctgcagttagagtggacttttcccccaagactcttgttcatgcaggttcccctctgttaaatgcttctgcacccaccattatatggcagcctgcacatttttcctcagtttaaatggagccttttcagagaagtcttttctgattaatctatcaaaatacaactctctgtctctctctctctttctgtcactctatcttggtttcttactatcacagtatttttgtaaactgtgttaagaattttaaattgtatcttaagagcattgggaaagccagtgaaaggttttcagcaggtacgtcttatgatggcattacatttttgaaagatcattctggctgctgtgtgagaaatggactgtggattgtgaaggtgagagtgttgggtgggggaaaacaggaaagtaaagacacttgttagcaggtattccagttcagaagatggatgtgtgtggttgtggaaatggaaaggtctggatggatttgagataagtcttttttttttttaatatatattttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtccttgagattagggagtggtgatgactcttaacgagcatgctgccttctagcatctgtttaacaaagcacatcttgcaccgcccttaatccatttaaccctgagtggacacagcacatgtttcagagagcacagggttgggggcaaggtcacagatcaacaggatcccaaggcagaagaatttttcttagtacagaacaaaatgaaaagtctcccatgtctccttctttctacacagacacggcaaccatccgatttctcaatcttttccccacctttcccccctttctattccacaaaaccgccattgtcatcatggcccgttctcaatgagctgttgggtacacctcccagacggggtggtggccgggcagaggggctcctcacttcccagtaggggcggccaggcagaggcgcccctcacctcccggacggggcggctggccgggtggggggctgaaccccccacctccctcccggacggggcggctggcctggcgggggctgacccccacctccctcccggacggggtggctgccgggcggagacgctcctcacttcccagacggggtggctgccgggcggaggggctcctcacttctcagacggggcggttgccaggcagagggtctcctcacttcccagacggggtggctgccgggcagaggggctcctcacttctcagatggggcggctgccgggcggaggggctcctcccttctcagatggggcggttgccaggcagagggtctcctcacttctcagacggggcggccgggcagagacgctcctcacctcccagacggggtcgcggccgggcagaggcactcctcacatcccagatggggtggcggggcagaggcgctccccacatctcagaagatgggcagtcgggcagagatgctcctcacttcctagatgggatggcggccgggaagaggtgctcctcacttcctagatgggatggcggccgggcagagacgctcctcactttccagactgggcagccaggcagaggggctcctcacatcccagacgatgggcggccaggcagagacgctcctcacttcccagacggggtggcagccgggcagaggctgcagtctcggcactttgggaggccaaggcaggcggctgggatgtggaggttgtagcgagccgagatcacgccactgcactccagcctgggcaccattgagcgctgagtgaactagactccgtctgcaatcccggcacctcgggaggccgaggctggcggatcactcgcggtcaggagctggagaccagcccggccaacacagcgaaaccccgtctccaccaaaaaaatacgaaaaccagtcaggcgtggtggcgcgcacctgcaattgcaggcactcggcaggctgaggcaggagaatcaggcagggaggttgcagtgagccgagatggcagcagtacagtccagcttcggctcggcatcagagggagaccgtggaaagaggggagggggagggggagggagagggagcgaagttttgaaggaaggtcagaattacttatgtattaaatgtggaagatgaaggagagagaagctggggctggctcccaggtttgtagctggagtacctagttgcagggaggagccatctactgagttggagaagtctgaggaggaacaagctttggaagaaagtaaaggttttgaatatggacatggtttaatatgcctaggaggcgctgaagtagagatgtgaaaatagtgggatatgagagtttggaatccagactcctaggtggttctagatgttctttaaatccaataggagtagatgagattactcagacacagtatacagtggggagaaaaaagagcctagaacttaattttgaggagattcattacttatgagtcagcagctgctgttgaaccagcaggaaaccagggcagtgtcacagaagcagggaaacaagcttctgaaagctcaagttgctcagccttgaggagtgctaccaaggtctgaagcaaggaacgtgggtggccagctctccgggcttacttgggacagttctggtttggatttgttgtttgagcacagttatcatcaaaaatactctagtttgttggttaattatatggtcaccctgaagatgatgctagaaaggtccgtttggcaatgggaaggttattgatgacattggtaaaagccttttcagttgagtcatggggcaaatagcaagttgaagttaaagggaatgttaacaaaccatagctgttaaatacttgagcattttttgtattgttctctatacgtttctgtacatttgaaatattgtacttaaaaatcatgcatgagagttgataaagtagagacagaatgtaggcaagtcttcaagaaatcttgctctgaaagggaacaaaagaactagggagagtcaatttggttataagctcttaaagtatatatggaaatactcagttatttagaaagaggttgatagaaatttattccatgagccctaaaaggccatcagataaaccagagggcaactgcctaagaaaaatacaatcagtacagcagcctgtgtggctgtcttttagtgtctaaaatgcaatgctaaaatgcagttcagcaaaagcaatttacctaagggtcaaggcagaattctcacctttctttttctttaaattacagaaaaggcctaacacgttccagctcctctacgaaactttcctgttttagcctttgttgaactcaaatatcatgccttgttgggaccatggcatttacttttctaatagctgttcttcaatttctgttcagaagtgattcatgtgggttctctgtccctaactatattagaatctccttgagtacagaattcatgagtgcatgctgcttttatactctttgctaccctagtgcacttactcaatgcttctaactcattcatggcagtgcccatttggctcctgagaattggattagtgcctaagacagagtggtgggtactttgggttcgccatacagtgtgagtttgctgaacacctcttgctttgatgattagtgtgggtttttcttggctttgtttttacagagtacagcgcctgaggaggagcatgagagtccccgagctgaaactcccagcactgtcactgaggttgacatggatctggacagctatcagattgcgttggaggaagtgctgacctggttgctttctgctgaggacactttccaggagcaggatgatatttctgatgatgttgaagaagtcaaagaccagtttgcaacccatgaagtaaatatctgtagtttcttagcagggtgtgtcccccacgggacctgagccttaatcagggactctactctcctatttgttatctactgaattctgttctttggaaaggtcaatggtttatttcaggaactgtgatatttaaatagtgctttgtcacaaaattggtatgggtgattaaactgtgcctcagaattagattttagattttagtctccttgtgtgttttggagagccactgatgaaaatcattgcatagtactgctcagttctgaagtgcattgttatatttcaaaagcaaacgagtgaaccaatacaccaaatctttaagatttgagtgttccctaggaaatgattattctttttaattgcatgattaagcaaatgtcatacccagggttcctgtattttttcatatcataaaagtttcctgctcctttgaggacatactatattgcagcatagtgaatttcactatatggagatttcttttggttaaatttttcttttgtatagttatgtgaattgacagatcttatttgttgttttggatagaaaataatataagtggtaatatctcttaaacagttcctcttgggtgagtatggtattttattttatatatatatttatatatataataaataaatatatatttatatataaatatatataaataaaaataaatatatattttattttatatataaataaaatatataaataaatatatataaataaaatatataaatatttttatatataatctatttatatattatatatgtatatgtatatgtgtgtgtatatatatatatttataatttttttttttttaacagagtcttactctgtcacccaggctggagtgcagtggcacaatcttggctcactgcaacttctacctcctggcttcaagtgattctcctgcatcagcctcccaagtagctgggactgcaaacatgtgccaccacgcccggctaattttttgtgtttttagttagagacggggtttcaccttgttgtccaggctggtcttgaactcctggcctaggtgatccacctgcctcagcctcccaaaatgctgggattataggtgtgagccaccacacccagccttttattttatttatttagaattccatgttcatgatctatgagtagcatagtcagcatttactttaaaatagctggtattatcagatgcatcattgcttgctttgagctatttctcttttaacttatggcaggtgtttattcctattttcagagattaaaaaatgtggtcaatgtctattttatttgcgctctactaggctacctttttctgcatcactgacatttaggttaggcattagcaatttgttcagtcttccttttttttttttgcactgagtagctcacaaattataacaatgtccctttctaggcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggtgagtggaaagccaagaaatgcacttaattccacaggctgctttgcacagttgagctctagtagatgtctgcatgtctgtgaaagcgagatgattacagaacttgccttggaaaagtaagactcttttctacgggtaatattgctggaattctgcatgatctttgtttcccctttgatgtgttagccacaccaaaagataaaagttggaatacagaatttaacaaaaaggaaaaagaggataggcatggtggctcatgcctgtaatcccagcacttgggaggccaacgcggatggatcacttgaggccaggagtttgagaccagcctgggcgacatggcgaaactccgtctctactaaaaatacaaaaattagctgggcatggtgggccatgcctgtaatcctagctacttgggaggttgaggtatgaggatcgcttgaactcaggagacagagattgcagtgagctgagattcagccactgcactccagcctgggtaacaaagtgagactgtctccaaaaaaaggaaaagacatttcataggggcagttacttatttgcaatgttaagattagctaaacattaacttggtgtgaagacaggactatggagtattgatctacttttccattttgtgacttttattttaaagctttctcatggtttattttatttcatgtattgtgtcttaaggagcaaactgcattcattgccacttccacctatttaataagcaggaattcctgattgaagaaacaatgattctgatatgaatacagggtgctgctttttgcattctttgtctgcatttaatgaactccatttaggacaaaataaaagtttactttcctggcttctatatttaaagactaaatgctaccttgaatgtttagacaagggtgtcttcccttgccctgtatctccggtgcccagaatgtatatttgactttgcaaagggaaaaggcttgtaggaataatgctgtgttccccacggacaggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaagtaaatctgtctcatatttcttcgataccttatcaaatatgaaagagcagcacttagcatctcagaggctgatgacatctatcgttaacatgaagttgggacacttcttcagggttgtcttcatttagcagctcacagggtggaattgatagagatgagacttttctgagccagggataaaagggcacggtaaaattttatatgtgatgtgcagttttcttttgaaagtacatagctttcatacaactggagaagggttcttttggccctctaagtggctaagaacccaagcatgttggcgttcacatggtgtgtgggtgaagagcaaattcttcgtctatgattcaggaaagcgtcaggcattaagttaggaaccaaaattgggtgggcaatttaatttggtcacaagtctaggagataaacttttcatagtcaagataaggaaagatagaataaaatatgctctctgtaaattgaagacttttattgatcagtgaaacattgaggtaactaatatgtaaaactttaggaatacattaaacacaactctgagaagcatttgagaacactattgatagtatttaaataaattttctttctttctttcttttttttgagatggagtcttgctctgtcacccaggctggagggcaatggcaaaatctcagctcactgcaccctctgcctcctgggttcaagtgattctcccacctcagtctcccaagtagctgggactacaggcgtgtgccaccacacccagctaattttttgtattttttgtatttttagtaaagtcagggtttcaccatgttggccaggctggtcttgaactcctgacctcaagtgatccgcctgccttgggttcccaaagtgctgggattacaggtgtgagccaccatgcccagcctataaattttctatacacatgtatccaatgactatgctcttcccatggaaaaggcgagagaatctaaggtgtccatacttctttaactgctttattgggtagctaatcagagtaacttttgactatcgtgtagcattctacttatctctttatactgtcctacactagataaaatgatctctgacttggtttatttaagctctggacttttttgctttaccacttctacatttttgtattaattcctagtatggacactcaactcctttatgctataaattctgagggagggccagaacttgaataaaagtggtgatatctccatttgcagtctgttataacactgcatcctcaaactgcctttgttgataatggaatgtaaagatgtataataggattagtttcattagtagaacagttagggtaatgattggaaatttaaatatgatgcctcattaactgtccttaattactattgacaactgagtgcgttttaaataggtaaatgtgaaagtagaaataatggtttatcttaatttttttctctagagtttgcaaagtgatcttgaggctgaacaggtgaaagtaaattcactaactcacatggtggtcattgttgatgaaaacagtggtgagagtgctacagctatcctagaagaccagttacaggtaagagtgctgtaaagttggataatcctgagggacctgtggtctgagacccaattacatattgcccttgttcttcatgtcctttctcattctttatccagaagggtagaaaaacctacctttgattgtacttctcagttggggttctacagtgtgtgggctacaggagtacccaggtattgattcctttacttcagctcttggggtgaatggatggggctggttgcagtccccagcttccttgtgcataatgacaagatttggaagcacagtgtattagtccgttttcacactgctgataaagacatacctgagactgggaagaaaaagaggtttaagggacttacagttccatgtggctggggagacctcacaatcatggtggaagggaaggaggagcaagccacattttatatggatggtggcaggcaaagagagggagcttgtgcagggaaactcctttttttaaaaccatcagacctcgtgagacttactcactatcacaagaacagcaagagagagacctgcgcccatgaatcaattacctcccactgggttcctcacttaaaatgtgggaattgtgggagttacaattcaagatgagacttggatggggacacaagcaaaccatatcattccacccctggcctctcccaaatcttatgtcctcacatttcacaaccaatcatgctttcccaacagtacccccaaagtcttaactcatttcagcattaactcaaaagtccacagtccaaagtctcatctgagacaaggcaagtcccttccgcctatgagcctgcaaagtcaaaagcaagttagttacttcctagctacaatgggggcacaggcaaagagtaaatacatctgttccaaatgggagaaactggccaaaacaaaagggctacagtccccattcaagtatggaatacggtggggtagtcaaatcttaaagcttcaaaatgatctcctttgacttcatgtttcacatccaggtcacgcctatgcaagaggtaggttcccatggtcttgggcagtgctgcctctgtggctttgcgggaaatagccccctcctggctgctttcatgggtcagtgttgagtgtctgcggcttttccaggtgcatagtgcaagctgtcagtggatctaccaccctggggtctggaggacagtggccgtcttctcacagctccactaggtggtgccacagtagggactctgtttgggccacatttcccttctgcactgccctagcagaggttctccatgagagccccacctctgcagcaaacttctgcctggacatccacgtgtttccatacatcctctgaaatctaggtggatgttcccaaacctcaattcttgacttctgtgtacccgcaggctcaacaccacatggaagctgccaaggcttgtggcttgcacctttgccatggcctgagctgtacctttgccccttttagtcatggctggagcagctgggatgcagggcaccaagtacctagccacaaggcacggggaccctgagcccagcccacaaaaccattttttcctcctaggcctctgggcttgtgatgggaggggctgatgtgaagacctctgacatgcctggagatgttttccgcattgtcttggtgattaacttttgcctctttgttacttatgcaaatttctgcagccagcttgaatttctcctcagaaaatgagattttcttttctattgcattgtcaggctgcaaatttctcaaacttttatgatctgtttcctttataaaactgaatgcctttaacagcacccaagtcatctcctgaatgctttgctgcttagaaatttcttccacaggtaccctaaattttcccacatttttctgtcttcttctgagctctccaaatgtttccaacctctgcctgttaccgagttccaaagtcacttctacattttagggtatcttttcaacagcaccccactctactggtaccgatttactatattagtccattttcatgctgctgataaaaacatacctgagactgggaagaaaaagaggtttaatggacttacagttccacatcgttggggaggcctcacaatcatggcagaagggaaggaggagcaagtcacgatttacatgcatggtggcaggcaaagagagagagcttgtgcagggaaactcccttttgtaaaaccatcagatctcgtgagacttattcactataatgagaacagcatgggaaagatctgcccccatgcttcaattacctcccaccaagttcctctcaaaaaatgtgagaactgtggtagttataatgcaagatgagatttggatggagacacaggcaaaccatatcacacaggagctgatcttattaagtgatccactgacttcttctcagaagcacttgaggagcttgttaaaatgtagattcctaggctctacccactacctaaatctaggtgagggagggatgcagtgaatttgcaatgtaagaaaaatcatgtgcatagtaaagtttgagaatttcacctagtaggattcaatatctcagtgttttcggtagattaatatgtgaatttcaacaacagttttggaaacctcccaaaattgcttctttttgcacaaaggcaatagtgtatctttacaagtctttaacagataaatttattggtatttcatttgaacaatacttggattttctggtaagacgttgccaatttatttaaatatgatgcctcattaagtgaggcaatccaaactgtaatttcatcacgtgaggtccttttgcttttgtgatatttaaagtcagccagaggttctaagacttgtatgcagtagttagttattataacctgagagctaagtattcatgccttgactatttagcagtaaggaatctgagattcagagaggttaagtagtcctcctgagatttaaatagacaatgagttatcatgctgagactggaaatctatcttctggctcttaagttttctccccctttgtactatgaaaagcttattctcatattaagtatcaaaatagtataatatgaattaaataattcttgttcacatgtatatagtacaaaaataaattttaacatttgttaatcattatttgtaaaattgtaataaaatgattttgggagaaaataatcatgaagagtgattttttataattaataaaatttatttagtattgctgatactagtaagattctattgctaatttatgtaacttatggggaatttttttatggatcacataatgtaaacagaacaaatcatttgatttttttattgtctcataaaaattctcttattcaaaacaggttttataagttaaacatttttcataattttggtaccacagatgaaaattttcttggcatgtaaaagagagttaaggaatataacagacatgctggtttttttagctaaaaatttgaaaaatttgaagcacaaaaagtagatatgtttgttttattttttaataatatgtaaaaatgtcatattctcataaaaaccacaatgaaatagaaagagcaggtttggagtcaaagattcagaggatacagttctattatgttagtttctagctatgtgaaatcatttgttcaattctatggaaattagtttttctgattcatacatttctaggcctagtctgttattttaaagcaatttttataaaaatactttttataagttgttattctataataaagaacaatggaaatcatgaatttcttcaaggattgtgataactctctcttaaggctgtgttgacaaaggatggtttctcctttttctagaaacttggtgagcgctggacagcagtatgccgttggactgaagaacgctggaataggttacaagaaatcaatatattgtggcaggaattattggaagaacaggtatgaaactgttttccataaggggcaaaataaatggtgaaaagtaacccatcttttattgtgactttagaataaagttgccttgtttacttttctttgaaaggaaaatatataaataattattttaaagatcaaatttctatccagtttataactgatcatgaagcttattcacagagattgtgtcatttggctccattaatttgacctgttttcattacttggaatgttagtacttagaagatatgctattttcatgatttgtttgacatcatagttattagtggatttgtgttgggtgatgtatttgaatttgtatcaacacaatgcctagcatataatttgtgctcagtaaataatgagtaatgaatccactcaacacactgtgaactttaattccctagattttttcttgatttttaacaagtattgaaattaatgagaaaatattatttagtcacacctttgatttaacactggattaattgcatattttttccactaagtgttatcacagcaaatgaatctgttgtacaaagctgccaccttaatttttcaataggactggtggctctttgcctgttctctgtctttccagaaaagcaaccattgaaacaaaatacaaataaacaaaacttttctccccaaatgccaaacagttgtggtttaaaaaataagtagatactggccgggcagggtggctcacgcctgtaatcccagcactttgggaggctgaggcaggtggatcacttgaagtcaggagttcaagactagcccggccaacatagtgaaaccccgtctccactaaaaatataaaaataagccaggtgtggcggtgggtgcctgtaatcccagctactcaggaggctgaggcaggagaattgctggaacccaggaggcagaggttgcagtgagccgagactgtgccactgcactccagcctgggagacaagagcgagactccctctcaaaaaaaaaaaaaaaaaagcaaatactctattcccacatctctcagtgtccattttgattcttttaaatgcatttcatttccatctataagaagcaactatattctcttcaggggaaaaaactcaagtgtgtgatgttttgtggcttactaaatatggtggcagatagttgcagaatttgtccaaatataaattgttaatgactacttccccccccgccctcaatctgtggtcagatttttcttattaggaatcacaaaagggacctgattctgatttatgaaatgtttacatttcatgttacaaatatttacatttcactttataaatatttatgtttattgtgaaccttgtatttaggccaaaaagtctcagaatagttaaaattttacttcaataatgacagtagaaaggctgggcgcggtggatcacgcttgtaatcccagcactttgggaggccgaggcgggcagatcacttgaggtcagaccaacatgttgaaacctgtctctactaaaaatgcaaaaaattagccaggcctgcagtgggcacctgtaatcccagccactcaggaggctatggaggcaggagaattgcttgaacccaggaagcagaggttgcagtgatccgagatggcaccactgcactccagtctgggtgacagagtgagactctgtctcaaaaaataaaaataatagtaatagtaataattgcagtagaagacatcgattgctagagaaaaccattgtgttactcttctatccagtaaagtaattgcaaatttggaaataattttaatttgatgataaaaaacagtttaaaaatagagtgctagtatttcagtcacttgtaccactttaggttttaaactgacctttcatcgtgttctataatgatctgacattttaactataccttttgtgtgtgtgtgtgtactgtctacatgttctgtctgatggcatcattatttatgtgcatatcttaccagcctcactagactgaggacagtatccattggggggtgaaatatagaggcaaggaatagttgttaaatatttaattcataaataaaattgctgagaaagaattgattccgttgcaaatacagaaccaagttgttttcctccctactaaatagaaaagggtttccaccctaaatgctacattttgggagaaattatcacaatgtagctacggttgttttccatcccttcttcaggattatctctctacatgactgaatatcctctgcttagaaaacacacattgttgtccaatgaagttgaaaaatctttatatgggctttgggtgctcttcagactccctcctttaatcataattgctgttgaaccttgaatgctagtgtggatttcctacatgatgccatggaaaacactggttttggggtgtggaccctggacccagctctgccattaactatccaagtgatctgggacatgtaacttgacttctctttccttcctttctaaaatgaggggctgggacaagacaatctccgagcttacttctgcctctaggaagttgtaatgtaattcctttggagacttgcatagttggattttcccttttccctccacctatctccttgagaattaggtttagttccctaggtatgaggctaatgtctgattgttctgttacaaatctgagaaggataatattttaaagaaaggtatctttctgggtcatttgtgcctcagacttaggtgtttgaaggccttcttatccccatgtaagggtgaagcctctaataaaataaaagttagaaatttggatgcatgatttaattgaattaccaaatgattttgcagataaagttcaacttttgttattacttgtagtgcttgttgaaagcttggttaaccgaaaaagaagaggctttaaataaagtccagacaagcaacttcaaagaccaaaaggaactaagtgtcagtgttcgacgtctggctgtaagtgatggggttgtcagcatctgtgttgtaagcctatgatatcttaatgttttatagctaatggttagtagaatttagtgaatgcagattacagctcattacctagcattagactgctgccctgtaacaatctggaaccacgagtcttaccttttagcatagtgaactgcaaagcatgtacattttactataaaagatacatgtttaaaatttttggctggggaacagaaagacaaagtcctgttaaaaagagtcatctaataaatatctgaaatactagattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtactttttgatttggatcatatgttgtgccatgaagtaaacatttaaaatttaaatgttcaggttagttttaatttgtatgaaataaactaaaaagttgtttccttacacctgatgaaaaattgacatgtgaaaatcaccttcagttttctaaagtaagttttaatagattatcttaatatcctataatttaatttatagtaactgattatacttagccaataaataatcttaacatcttaaatcttaagtaatcttattaatcttaaaaatattttaatgaattagtcaaacataaaacattggtttgtagacagatattcttagcagcattatttataatagccaaaaagtggaacaactcaaatatccatacacagatgaatggataaacaaaatgtggtgtatgcatacaatattatctgataatacaaaagaacgaagtattgacacatgctacaacatagatgaaccttgaaaacactatgctaagtataagaagccaatcgcaagattatatacgctatgattccattcataggaaatgtccacaaggggaaaatccacagagatagaaagtaaatgcatggttgccactggtgggagtggggaatggggagtgttggtttatggctatgggatttctttttggggtgataaaatgttctggagacagactgtgaggatgattatacaactgtataaatgtgctaataaccattaaattgtgtatttcaaagaaagaattttatagcatgtgaattacatctcaatgaagctgttataaacattgaaattttggatggcttttatttcaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtgagaagagatagagaaattgttcaaatccaatattgcacatactatattttctacttggtgcctattttgtactaatcattaatcataggcaaatctagacataataagtattattattatgaaaagtcaactactgaaccactcactgcccctgtcttctgaatattctacttggcactagctaagcatccaaattttcttggatgattttatttatcctgtgttcaattgggagaactttgtgatcgaagctttctttcttcctttcccattattctccttggaaggatatgattgtccatgactgtctttttattctttctttcactgtcacaactcgacagtgacctcctcagtctttgaatatagcttccccagtttttattgtcagaaagtgcaggggatccttaaccattcctattaacatggtttccagacccttttatatcttctgtctgctctagaaaccactattggtttgccttaaaatggactaccccaataatcgagggccttaaatgactgcttaatgcagtgcctagtttaaaatatatgcttaaaaaatggcagctcatttccacttctcttcccctggtgctgctgtggtggtggtttttaccagctcgcggtacagtggacagtcatttcctagaatgtagacacctgttcctgtgacctgcgatcattgcatcactcttgcccatattgagagcagatgctgactgagtctccaaggtcattggaaacgtgcgatttttagatggccgtctcttctctgaaatattaaatagaaagctgctgttaagatgacaggaggaacatatccctgtttgagcaataccttgaccccagatatttatctagagcatcacaaaatccctcacattttacagggaaaatctaccttgatgaaaagataaaatattcatagttcaccagaaacactttaagcaaagtttctcacaagaatcagcaataacgacttgtgccactgcttaatgtatcgagaagctctgtggggagggtactagttaagaagacagtcttggtttgaatcccagcctcaccctttgttagctttgtgacatgggacagttactgaaaacctctgtgagctcagtaccttcatctctaaaggggataataatagtgtatactttttagggtgctggtgaggattccttgagttaataatagacataaaacacttagaaaggggccgggtagaaggccagcaatcagtgatcgtgactcctcttgttcctccttgctgtggttttgaccaaccttctcaacacctctcaaacctgtcctttcgtcttccttcccactgttactatcttagttgtgactcccgttgctttcacagcctgttctcgactcgtctctctttaatgccttctcctcagtgaacactaaaggataaatagaatcatgtcagttccatgcatagaactctcccttggctctcaactgcctttgggttaagtccaaactccttaatatgtcctgcagggccttcttgtagctggtccatgtgattcttggccacatcgtcaattgtccctcccttgtgagttcagtactcattattccagacacgcctaactaatacttgcagtttgcaaaatgtgatcttccctttctctgctttcccttggcaagggaaactcctcagtgtaatgctgttgttctcctttaggaagccatccatgccccaattggattagaagccactcctgtgaattcctggaattagcacctagcaaattcttttgttattgcctgttactttccattgcttactagactagaagctccttgggagctgagatttgtatctggttcactttcatatcaagagcccagcccagtgcctgacatttagtaaggctcaatcattacatattgaacaaaagaagatgttaactttagtaatgtctgtacttgttctttgctgattatctaaccaactctggtttttattatctataagcatttataaaaatacaagtgattccttataaaggtgaaaattgttttaatatgtaaagttttaaaaatttttatttaaggccaggcatggtgggtcatgactgtaatcacagcactttgggaggccaaggcgggccgatcatgaggtcagcctggccaacatggtgaaactctgtctctactaaaaatacaaaaattagctgggtgtggtggtgggcacctataatcctagctactcgggaggctgaggcaggagaatcctttgaatctggaggcggaggttgcagtgagccgagatcgtgccattgcactcaagcctgggtgacagggcgagactccatctcgaaacaacaacaacaacaacaaattatttaattattttcttcaattgtttattaaccctataatattattactcttttcatacttttagttgtaaatatatgatctcattttgcatggttaccctatttctgggttgctgtttttgggggagtgataaaaagacatattcctgatgagcatttgagttgctctttctggagtcaagtaaaacagtagaaggaaacatgacaaatggtcacctctgaatcttcaaacaggtttgatgctataagtgcagagctgttgaactggattttgaaatggaaaactgccattcagaccacagagataaaagagtatatgaagatgcaagacacttccgaaatgaaaaagaagttgaaggtaaaaaacataaaccacatatatcctagtgcataaaatagttcatcatgctggattttctgctggcataaagacattatggaattcaaaagcctcctgtaaaataaatgtaggcagaaggtagcttttagtacattgtagtgaattttgaatccattcatgctagctgtcatcagatccctatttggaggacgttttttttttttcatctttgtcagtcactgagatgtacagtgaggaatacttcttatggtgatccagttagtggtactactttttagttagtttagatcacccttaatctggtatctaataatttatgactctatattaacattatgctgaagatgttttgccttcggaatacaacaaactattttaaatcaaaaagtgtattcaatatattttctttagagttgtaaaaaataaatacaattaaaaggtgtgggatcttagccctgccgctttccatgcttatgtgtgtttctgaagagtgtgatgggaacttgcagagcttttttgtcctgggtgctcatacgtctcctacacattactgcattaactatttgggcacctgggtagagaatctatagtctagtctcctgccatcttaagaggtagcaaaaaatcaacttgtaaaaagtagataattgcctttttctccagttcgatggtgacttttacattgatctttagttagacaaaataaacggtgtttcttagagtctcttactaatattccttgatctttgactataagaaggttgttctacctagtcacagtaaactttgtgaaaatcaaagtaggatagctgaatttatttgatagcacttacatgtaaacaatttagaattgggattcttctctggattgtctggttgaagtaatatgggttgctcagaagttgtgattgtgttatgatggatactatttgaatagtatataaatatgaataatatataaatatcagttggggatggaggaatgagagaaaattcaaataccgagttgtgtgcacatatagttgtgtttttgtgtgtatacatgattttacttgcttcattcttactagttctggaaagaattttgtcttgggagtatcaaactatagagataaaaaaaataatgaaattaggagccattcctcaacataaagaacaaaatgtgggttgggcttgccatggctcacgcttataattccagcacaaggcaggaggattgcttgagcccaggagtttgagaccagcctgggcaccatagggagacccccgtctctacaaaaagtaaaaaaaaaaaaaaatttgtggggcgtgagcttgcacttgtaactccaactactcgggaggctgagataggaggatcctttgagcccaggaggttgaggctgcagtgagccatgattgtgccactgcaccccagcctgggtgacagagtgacaacctgcctcaaagaaaaaaaaaaaaaaaaggaacaaaatgctttggtttgggttctaaagcatatttactattttcattatttaaaaattatgtatgaaatatgattgtgcttgaagtttgcattgaaccctagacttaatataacccaaacaaataatactgagcctcaaaatatttctatccattttttctgttttctttcttttgagatgggagttttgctctgttgcccaggctggagtgcagtggtgcaatctcggctccctgcaacctctgcctcccgggttcaagcaattctcatgcctaagcctcctgagcagctgggattataggcacacgccaccacgcttggctaatttttgtatttttagtagagttggggtttcaccatgttggccagactggtctcaaactcctgacctctagtgatccacccccctcagccttccaaagtgttgggattacaggtgtgagccaccatgcccagcctatccttttttcttgttagttaatttttgttcaacaacttctgtcataacacattcaattcttttgactcaaaccattatttttatggcatggcgtactcagggtatgtatgtgaatagatatcctggatctaaaacataattttaattatttccttctaataggagcttataattatgaggtacattttttttcttacaaaagaaaccaatgctttttagttgctatgattacgtttgaatttaccttttcagatttaaaaagaatgtaggagggccattcaacttaaacatttaaaacagcaacattatattgagaagaaagtttgcaatattcttatgttgggacttcatttgcaggcattagaaaaagaacagagagaaagaatccccagagcagatgaattaaaccaaactggacaaatccttgtggagcaaatgggaaaaggtaagatccttgatttttttcccctatatttttcagatggtggcatcgaataatattacagtttgccctattaaatattttgctttaatactcgaatcctcttttggctagataaatggttttcaaaaatgtttttaggcagcagaatctttaaaaatgaaattttattctgaagctgattgtaaaaaagcagataaaagcaaagttgttctgattttatatggggtcggggctggataccctgattagcagaacagttaaaacccactagcatagtatattttaaaactgtatcctttgggtttatatattgggaatttgtttgcagggtggtagcaaaagaaaactttacttggcaacatttgggaaacgaagttacgttaaattcattaagggtatttgatttttgataacttttaatgcattatatttatttactacagtatttttatagttaagtttgataaggtgttacttatatatgaaatttttaaatgctcccaagacttttttttttgctgtagctcccagtgactcagaataagctaaagattaatattcttgatgtgcagttttgcatatgaatctctctttgttctagagaaatgttgaaagacatttcttgcactccatgtacgttggtctaataatggtaagcactttggaaggctgctgtagctctccttgacacctgtacagatacctatacagaattaggaatattagtttgacaagaatcttaaaagcagtagcatttaattttttattgtttgactttttgttatggaaaatataactgtataaaagcaaatagaatactataatgaacttccttgtatcagttacctagtttagtaattgacaatattctgccattcttgaattatctatacctttactcgttcctcagcctctcaattattactatttttacagttttcttggaagtaaaatttacttacattgaaatacatgacttagctgtgctgttttgacaaatagatatacctgtgtaacctacacacacacatcactgtagaaaatttccatctttccagaaatttctcttttgggttagtcaccttcctccctccagaaaacaactgttcatgttgttttgaccttagattattttgcctccagcctttaacaaatatgtttatttatttagtatgtatactggatatgtgtatacacacacacacacaaacacacagaaacatatatacacacacaaacatatatagatatatacacatacacacaaaatatggaatgtataccatgtggacagtgtatgtccatttattttgaaattatgcaaatgtattatcaatccatttattattaataaatgttaatttctttctttaaataaattaaatagaatagtatttaatattttctttcaaaatccattctagcagattgtcttagttgtccttcctgtgggcatcccacttggaggttactctttccagtatttacttgaagagatccagagacacaaacagatgataacttcccttgagattcattcaataattataatgcattggatgttgaatttatttcctttacaagcatagattttttacttctacctcagcattgtacctggtgactctgactttatctgatgtgaatatgggataatttcttgaatctgtgtactgaatttactcccatttctgtcaggttttcagcagtgtggcagaattatgaagatgggggagacttgatgtagatgagaagttggtgcgaggtgatgttatagtgagaataacagtgattgggggaatgggcaaacttggattctcctgtccttttctagtttcttatccttgggaaagtcttggaacccttgtttctttgccttggtgtctggaaaatgagggagtttattagctgactcttagctgttagtttatcaggtgactattagtttattagctgactataggctttggtccataaaattctaccataaatgggtcctaaatagacacattctggacattgagttcacatgaaagtgctacttgcaaaaggccaaaggcaacactggagaatagttgacatggggcttttgtcacctaatgtatacttgcccaatttcataggaaaccttttatagtttgtattatcatgttttttcaagcattggtggaattagaaatgcattcattagaggaccctaattcttttttgttttaaagatgcatctattaaaaaattttttttaggacaacagtgggaagctgagaaatgggggagctgaactggataaagtctgtgtgttccagttcagttagggaggcatgtcaaattcttcagtaaaacccatatttgaataatcacgtcactgtttttctgaaaccagttccatcaaaaagcccaccatagccaattctgataggtctttcctgcctaatgcattttacataagttttgaggtatctcatagagcatagaaacaattttagaaaataaaatagcgtgaggctgggcgcagtggctcacacctgtaatcccagaactttgggaggccgaggtgggtgggtcacgaggtcaggagatcaacaccatcctgggcaacatggtgaaacctcgtctctactaaaaatacaaaaattagctgggcatggtggcacatgcctgtaatctcagttactcaggaggctgaggcaggagaatcgcttgaaccagggagtcggaggttgcagtgagctgagattgcaccactacactccagcctggtgacagagcaagactctgtctcaaaataataataataataataataataataataataataataataaataaaatagtgtgtttcatttgactttcatagctgatatacttggttttcttcgtttagcttatcttgttcctagagctcttcatctagtaaaatacagtagagtagttgggcatctggataatgtggctttatgaatcaatgcccattgtggttgcctaagcatataagcccaggaagtttggtgaaggtcctatgttttgtaaacgtttcccttgattccaatagtgatagactgagaagtgtaaagtcaagtgagactgagtggcaggaatgtgttctatgttctcccttttagacaattaataaagtgatcttctgttgattttgccttttgactagtcaccttctaagaactctgtgttttatagaaatagaaaattttaaactctggatctctgggagtaaaacaactatttttaaagacaatgtgcagttttccttttataagatgtaaattgtgtttgaatcattaccgggcatcactgtaaccagcaatatctcaggattagagaaagggagattcagatgtttaaaattggtttaaagaggcaaaatgaatggcttgtaagacattgtcagtgaaaaaataactgaagttgttttaaccgcccttgttcttgaagtgagcacctctttccagttttctagatgagtagtggtaattttccatctcagaaattttatttacctacttaattttcttccttgattagtatgaattgtccaacataaagatgatgtggctggtgttactattcctttgcctgcctagaatagaaatgatggggcaggggcatgacccatatctccattgttcatattgttaggaaaatggtgatttgttttgtatactctccccattaacaggggtaatgcagcatggcttgtggtgtgaatgctttgcttatgtctcatattctcttacctgagagatggtggtgaacagtgaacttctgcaattgacataggtgacacattcaaatgacagcatgatatgccctcatttatgattttcagtagacacagtgtattataaaaattttcaaagttgcattgtctgtggatcatacatgactttttgtttttatgcctttgttttttagttcaagctctcattatcctggattttgatcatatatgtttataaagcaggattgttttattgctttcctactcaataaaaatgtgaagccatccttttggtatgcatgttttcctccgaatagaaagattcctttgaagatttcccatactttttcatagtcattttagaggatttgaaggtattttagattaagggaaggactatgataaaacctattattatatatgactttattatttttaggaacattctctacttttcaaaaatatcggacaaataaaatgataagatttcagtaataaaaatggtggcattgttttccctgatgtgtttctaaagtagatcatcttattgctgcctcagtcttttggtatttgcttatttatgtgcaaggtctccagtgggcttgctgatgcttctagagcctggctgctggcttaatattcctgcactcaccaggttgcttcccagcataaggcatcctcgccattcattttttaatttatatgacactgtgctttggtcaccaagacctgagctgcctcctagtttttctagccagctttctttttttcttaggacaaagggtcttctttctgaagtcgggcctagacagatcaaggtagttgatcttatttcactggttcaggtgataaactagcagagtagaagcatggcatggatggaaacatatattatctagaaaaggcagtggctgaagttctactgatgtgcctgaatcgttattttaaaatgtctttcttctttgttcaaggaattgaaataaacatcattatttttaagtgcatcattataaatttttgttgttgtattaaaagggacttaagaaagtgatcattatgtgtgacattgcctcactattctgagtgttagaatgttcagaataaattcaagacacattttgtaatatatagactgtttgcttgtttttcatgtctgcatagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcaggtaaggagccaacggtctggaaagtggaggaattctatgtgcagttccagagttaaggagggcttctcgtatcatgaactttaagttaatgctgccctgattaacttcctgtgaggatgttcatcttcagtgagttgtgtgaccgtattttctcttccttagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatggtaaacccaacaattttaaaatctcctgtctcagtttgccttaatgtaaacatgactcccaacatttagaacttgagtacacttgcttgctttgcaccaaccttctccattttcctttgtgcctgtattgttcaaagtcttaaagtcttctgtattcagattcttttccagattcacacctttttgtaaacatacaagcaagtttcacattctctaaaattgtgtcagtaggatataataataatttttttttttgtagctacaggatctcactctgtcacccaggctggagagcagtggtgcaatcatagctgcagtcttgacctcctgggtttcagtggtccttctgcctcagcctactgagtagctgggactacaggcatgcaccaccatgcctggctggttttttatttttagtagagccagggtctagctatgttgcccacgctggtctagaactcctgggctcaagtgatcttcccacctcagcctcccaaaataacaggtgtaagccattataacaggtgatataacagcctcccaaaataacaggtgttaggcaaaataacagatgttagcctcccaaaataccagggataacaggtgtcagccattgtacctgacctggatataatgatttttaaagattttttttttttttttttttgagaaacaggtgcaatttcttcctttggttgaggaggccacttaatatcattgctaggaggatcaaaatgaatgatcccttacttctgtttcctcaaaatagttaaagttttggcagtctcatactgtcttttaaaagaaatcatattccactgtcagattcagaaaaattttagagttcttacttttggaatacacttggttttggaaggttcactgttaaagattttgaaagctcatccctcctacgttacactatttacttcctagctgccatttgagttaggaactgtgttgcattgtgcattattttgtgaaatgcattgagcattgtgtgaaatgctccacatgtaacccagcctaacttcagcaattgtagattgtgtgatgactggaagtgtctgtatgtgtgcatgctaggcaaatgtgtcgtattgcctttcttctgaaagtgcatctggacagcatgtctttgttccttgaattcagttatgtgaaatatgtctttgagggtacctctttctccacttattggtacaagctgtgctttcacttttgacaaggatcagtaggcagtttaacttttgctgctagttggtttcacctctttgtgcttcaagagaactcacttcctttccacgcaagtgttacttctgtgatatttttacattagtgactgaggtagacactgttccagctggctgttcagtcattatttctcagggtacctgggcagcatggtggcagtatttccatataatctcctccactctggacctgggtttgtctacacggtggagcttacagcaagactggttgaagggatctttgttttcttttattctttgtgtagctgttaaggaagaggagattatatggaacaaaagggacattgttgttccatcttcagagagacatttcatcatgaagaaatgaagaaaaattatagtgggttagttaatatttcaaacgtcaacatccgcaggaatgaagtcactgtctgactctcagaaatgccaatggaatgatctatgttgttaattaacagagacccttttacattttaatcatggggtctcctttgccatgtattggaattcatttaggataatggtctatgtaataatattggttcctaatatgattttttcaaactaaatatttttaaataaacagaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaaggtaacatatatcttccatgttagaactctagcgcttcttctaatatctcctcttacatattttgaaatgttttttcagagattaaaaaaaaagttggtcagttttgttcatcattggtgcaaaaatgtgtttatgatttgagggttagtttgacctcacataaaagaaagtacagttattaaaaattttttcatagaagaaaagcatattttctccttctgctgtgattagcttaaaattctcaacctgttcataaaatctgctaaaatatctttatgaaatgaggactatcagttgacgtgttgatgtatacttttttctgcatcgaataggaatgtttccgaggtcatttagttgagtagccttatggctctgtgctattagatgaaaaggagagcagccattgagcactgcacacttggcccacactgggtttgctgttcccttggtttttagggttgagaatacactgtattgcccacacacaactcatgaagaaaaagctttaatttttatgattatgcctatttttttcatgagtttttcatgttttgttttgttttgttttttgatttccaacttttattttaagttcaggggtacttgtgcaggatgtgcaggtttgttaaatgggtaaacgtgtgtcatggtagtttgctgcactacgtattaagcccagcatccattagctcttcttcctgatgctttccctcccaccatgccccaccctccaacagaccccagtgtgtgtttttccccaccatgtgtccgtatgttctcattattcagctcccacttataagtgagaatatgcggtatttttttttgttgtttctgaattagtttgccgaggataatggcttccagctccatccatatacctgcaaaggacatgatcttgttcctttttatggctgcatagtattccatggttgatatgtaccacattttctttaagtagtctatcattgatgggcatttgggttgattccttgtccttgctattgtgaattgtgctgcaatgaacatagtgtgcatatatctttataacagaatgatttgtattcctttgggtatatacccagtgagattgctgggtcaaatggcatttctggttttaggtctttgaggaatcaccacactgtcttccacagtggttgaactaattcacactcccacccactgttctttttagataaaaatgctttctaatgcattttaaagtgacttttgactttatatagcccattttactatatctgtgcagacacatttttgtgcatatttttaatcttttaaaactttttccagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggtaaatccagaggccactgggagtttaagtttattacggggtaaatagtaattatcttataagattcacgtatttattatttaaatattttacattctttctagatccccatttattatgtatttaagttgggacttatcaaagatgtacttttaatgtgctagagagcacatttatttccttttgcctggaagcaaagtcaaaagtagagtaaactggaccttgaagataagagaaaattgcttaaaaatggtcaaaataatgtttcaggcatggagggcctgtgtgaaatacagactgttgattagattatagtagtaacttggttggggtggtagaaatagcccaggtagtagtaaattgctgaatacatgaaactactttttgcaggtttttgacatttgaagtcaaaagtcagagataggccattgacagtgtcagagtgggaaggcaaatcgttccagggacatgaaaattcagaaacaggatccttcactacacctgaaaatgttgacagatgcagcagtgataaagtttaagaggaaaggataaatgtgaggatgtataaggagagagtcaatgtcaatagaagtcagtgtcagattttaacattctgcctgtgagaaagatggagaagcagagtttccaggtcacctggtattttaataggaaagttctgggtggagaatgaaccaatcacactctctccctgcaaggcttcctatcctccagtgactccttaccttggtctttttttttttttttccccatcagtcagggatctttgtcttttttaaatttcttattcaccgatgtatgccaagatgtactcataactagagcaatgcctggcacagagaaggcatccaatcaatatttttcaacgaatgaaatgaaattagcaataggagatttagatttggatatatctctgtatatctatctatctatatatatagatagatagattctcttggaagctaaatccaaatatgtgtagatatatatctatatatatagggagatgtctctgtatatatgcatatacatctttatttatatagagagaatctaaatccgaatctatatatatttagatgtagatccaaatatatgtagatacaatatatatatctacatatatttggatctacatctaaatattatatctacatatatttggatctagatctaaatatatatagatttggatttagatgctaagcaaatttgcataaggaatattgcccccaaaaagtgaaaagattgaaagcgaagacaaaaattaatgaaaatgtatgttttgaaaatcaaagtcagagaacacgtggtagaagaggagctggaagacctcacagattagtgtggaagggatccagccagattctctgagtggaccactgaatttggaggggcgttctttgactcaggaactaatgggtagttccaatgaatgatcagcagaagatacagatggaggggttgtgtgtgtgtgtgggtagctgtgtgtgatggtagtgacaggaggtagtttttctctaggtgtaagtgcagttctagatggagatctcattcaaataaaccagtaattatggagagaaatgtgttttgtgtggcttagtgtttttgactcatttacttttttttttttgagatggagtcttgctctgttgccccaggctggagtgccatggtgcaatcttggcttactgcaacttcagcctcccgggttcaagcagttctcctgcctcagcctcctgattaactgggactacaggcacatgccactatgcccggctaaggttttatttttagtagagatgaggttttaccatgttggccaggctggtctcaaactcctgacctcaggtgatccaccctcctcggcctcccaaaatgctaggattacagacatgagccaccatgcctggcccattttactttgcgatggtcccacttctcgttgtgtattatgagttgcaattgttcccggctttcaaaatgagcattggccttttctataattctaaagtttttggttatggtcccagcattgtattatcagtgattctcaaccggggtgattttaccctccagaggatacttgttaatttctggaaacatttctgttgtcagaactgtgggagaagacttccagtgggtagaggccagggatgcagctaaacatcccaccatgtacaggacagcctcacaacaaaataatcatctggctccaaatgtcactagtgccaaagtttagcaatgccagatgaaacattccccatcttttcaaaagatcatccctttgttttcagatttaagtccaaagtataaatggagattaacctcagagttagtcttcttttgactcttaaaagtatatcttagggttagctaaatgtatgctactatttcaatatggagcttaaagagaataaatattctcccaaaatacaaaagagtcctgtggttatagtaatccagctttaagctttggtgggttgttgctattaatgtagcaaatccaggcactaaaagtggtcacttggaaatatttatttccattaaaaatatccaacatcaagggtgtgtgtctggatatgtaagtgtttgttgttacagtagcagatttgtaatgtccagtactttttttatttgcttcttgtgtactaactgcaagattgtggttaaggaatacagtgtctatatttcttaattgtataacttcttcattgaaatacatgttttatcttaaattcaaaagaaaactccttttttttgctttgtaggaattgctggttacttaactactcatgatttacttgggaaaactttaaattccacaccctcaaattattagataattataataaatatttatttgcagattatcattgttttccctttttcaatgacctgatatatgattttttaggcatttaattatttttgtctttaaggcatgaagcacagtaggttttagattcaatgccaattcataataatgttttgtaggaacaaaatagttaactcgtttatttttaaaatgcatttttcattacatgagtagtacttgaagcctacacattgtgaagaaattgaataccacagaaatacttacagtgaacatttagagttccttttcttccccaataccattttctttcctgggggcagctaatattaacagtggatccttgtacatacaagttagacaagaacaattgacaaatattgctaattccaatcattttcccccacactgtggaaagaaatgatattggaactctgtgaaggacatttaaatccatagtccagatagagtttggaagtgaatcccactacttaataacatctttcattgatacagcacatttaaactttgaaagtgttttcatggccatgtgcttgcttttttctgctatccttcaatatttgtaagaggctgttagttgtgtgcgaatttcagttttctgttatttgttggcattgcagtgtttttcctcatttgcctgcatttcctttgtctccatagctggttccttttgtgcatgttgagattggacctacatatttttattcattgtgttatgcccaaatacattcttaagttctttttatttgtgccatgccaaagcaataacctccattcctgtacttacgaggtaaaatattcattgttactttttacaaactactataccccttccaggtgacaaaacatttgaaaatacatgaaatgggtatttcttttttccattattgattttactgactggattttcatgtgaatcatggggataacatattataaaatcctaagaggctgcttatatatctctcctcaccagtagtaatatctttggatttaggggctgcaaagtatttcatattacgtacttccttttccttattcaagagctcctgccctatgtataactgggaaatgaaagatgtccccaaggcacacacaaaactgtcttctattttccagcgctcctgccttttcaggctcctcctccaggcccttccttctgggttcaggctctcatgcaatctctttccctgaaaatttcattaccctttaaatctgattcccacttcctgtctcttctctctggaattcatctttcacaccaataccagagttgtacttctgaaaggatctggttgtcttcaccattaatacaaattaataccaagtgccattaatacaaaatgtccctttcttgccctgaagccctccctgcatctccactgtgagctgagtcaggtggggagaatacggtgggtcaccaaagaccatcctagactattgcctttctctgaaaatgtcatgtacttgctaggaattcacatccctcctcctcctgtctgctcatctgtcttcagcccagctcatcactacacccatagctagataatcgttccctcctctgtgattcgactgtgtgtcatttacaccttcacaatgacccatctcaggccgtcttttattatggtgagaaatgtgtgtctctcttcccacgaggcatgagctctttgagggttggatccctgtcaggcatagagcaagttagcagatgtgaatgtaattgatgtgtccggcctctctagtgagagtggatttatacagtctaaagcctggttatcctaagtggcaggacacctgtgtagtcatgcctcttccttcaactgttgaacagtcaaaggcacacatgaatggacttgctctgacccggaatctggaggggggcgtgctggagctccaacaggcagaaccaggttttgagagtactttggaaagcattttagggtaaaaatgcaatactttctaagagtaatattagtacggatgatttaacccttcttaggtaacatataattgatataattatctcataagggtttgagttttttttctcatttgtgaacacattttactttactgaagggaatattcatatattcccttccttagatttaagaaccttattagtttttaataagtgtagtagcagtgtcattgtttgtcttccctactaagtgagagagcacattttcaaggttgtgtttttgaggttattgagtattataaagtgaaacaaaataggaacctggctgccttaaattactgttttaattctggcttcacactatttttttttttttctggtctatgtcttaaaaagctgtggacattccgacagatgggggaggagcaaaagaaaatgccaagaatttagctgtaatcaagtctccagaggtagttgtgtaccttgcaatcttactgtcttaaatccagatttaccaagctttaaattacctccatccttaggtcacaggatgggggatgggaaatgaggtgagatagggtcagaggaattgttttaatgaccttgctgttccttgtccgtgatcccatagcaggttgttgcccatctgaaatgcttagaaatcattgcttttgagcagtgatggtccatgtagactttgacccttccatactagaatatttgatattttgattttcaaaaaatactgtattcgtaattttatattcatttgaatatttgtgagtaaaaataggtatgagaaatggctgccccagattagtacttagtttatttttttttgcatgtgaaataatgacatttgctttagaaatttactaacagtttttatatttcgttttggtttgtaagaactgaagtcccttaaagaaatgtgtgtgtgtgtgtgtgtgtgtgcatgcgtgtgttctgtaagcagatggaggtgaagaaaaaaatcgtcattattgtagattagaagcttgtaagtgcatcagctgagtaatttttaaatggacagagaaacactattttcatgtgagctctttgacgatctttgtaatcaacctctttgttgtggtggaattgacttaaagatgagcagacttttggtatgtttgaaaagcacaggaaacatctgctacaggttgattgtgacaatattttgctcagggaaaggggagataagatagggagagtggaaggcagagtagagctccctgtcttctgccttcacccatacaggtacaggtggtaggtagcattgatctttgggacttgataacccttcccgcgcggtgtgccacgaggtggaaacgccgagtgaatctgctgctgccaggcacttctaaaggatgggcctttccttctgtaccaattccttcccatgagctgtatttggccaggtctagccagatatataagcagtagccatttgaaacagttactttgaaacagttacaggatagaacaagcattaatgttggcagcaattaaaaaagtgaaacccatgcttatgcaaacacatgctcatcctggctgttcattcctgtggtgcctctgatgggacataaacaccaaaacttggatgtggtaactcttttatggtctcaatcttggtcataataaagcagttggttttgtagatcttagtataataatcgctaccatttagtgcattcttctatgtgggagtctctgtttttcagaacaaccagacaagatagttgttatgattccagtttcacaatgagttattaaggctcaaagaaaaattagtttctcaaggccccatggctaggcaggtgctgagcttggtagtcagacctcagcatttctttatatgggcacactgtctcttttagagcacagtgtggttagaattacatgcaggatttttagtagtgaaaatattatagtgtggctttacaggttcccttctattccctttgtcacttttgggatgatccattggcctacatggcttctctgtctgtttctttcctttttttttttagtatttattgatcatttttgggtgtttctcggagagggggatttggcagggtcataggacaatagtggagggaaggtcagcagataaacatgtgaacaaaggtctctggttttcctaggcagagggccctgccgccttccgcagtgtttgtgtccctgggtacttgagattagggagtggtgatgactcttaacgagcatgctgccttcaagcatctgtttaacaaagcacatcttgcaccgcccttaatccatttaacccttagtggacacagcacatgttccagagagcacggggttgggggcaaggttatagaccaacagcatcccaaggcagaataatttttcttagtacagaacaaaatggagtctcctatgtccacttccttccacacaaacacagcaacaatccgatctctccttcttttccccacacttcccccccttctattccacaaaactgccatcgtcatcatggcccgttctcaatgagctgttgggtacacctcccagacggggtggcggccgggcagaggggttccccacttcccagatggggtggccgggcagaggcgccccccacctcccagacggggcggctgccgggcggagacgctcctcacttcccagatggggtggctgccgggcggaggggctcctcacttaccagatggggtggctgctgggcggaggggctcctcagttcccagacggggtcgcggccgggcagaggcgctcctcacatcccagatagggcggcggggcagagacgctccccacatcccagatgatgggcggccaggcagagatgctcctcacttcctagacaggatgacggccgggaagaggcgctcctcacttcccagactgggcggccgggcagagacgctcctcacttcttagacggggtggcggccgggcagaggctgcaatctcggcactttgggaggccaaagcaggcggctgggaggtggaggttgtagcgagccgagatcacgccactgcactccagcctgggcaacattgagcactgagtgagtgagactccgtctgcaatcccggtacctcgggaggccgaggctggcagatcactctcggtcaggaactggagaccagcccggccaacacggcgaaaccccgtctccaccaaaaaatacaaaaaccagtcaggcgtggcggcgcgcacctgcgatcccaggcactcggcaggctgaggcaggagaatcaggcagggaggttgcattgagccgagatggcggcaggacagtccagccttggctcggcatcagagggagaccgtgcaaaggggagagggagacgagggagggggagagggagggggagagggagggggagggggcgagggagggggagggggagagggagagggagagggatctgtttcttttctctttctttttttctcatgtcagagggagagaaggaacagatacatgtgaattgcatgtgccctgatgggtctgcgtgtattagagagagggtgggaaggagggaggagggaaggctgttgaggccataaaacttcctcatatgccagtgactggagtagttaaggccacttactcaagtcaaagccaattgtggttaaaacttccttgaaatataatgcttccatataaattttgaaaattttggctgaggagactatcagttttccttattcaaactagagttaatgaatttcccagttatacagcagtaatgcattctttaaaagtgcagaatggagattagcagtgcaagaatctgtggtgacaagttaaacggagaatttttaaagtcattttatgaactctgtgaatgtattcacactttctctctttttgcacttctgtcttttttggatgccccactctacccgtcctgagcatgtcttcccaagaagccttctatgctaagaccttgaaatgctggagcaaacacagaagtgacctgtaaccaactgaaaatatataagggtagcatggacctgtgggaatagtgtcagacaggctggagaagagaggaggaagcagcttggggaaagtgtgcaatggaactgaaaggctttcaaagctgtgccaagaataaacgagatgcagaagtgcttagacaggatggtataatattaatggaagacacagagaaacctagctagataagcactttttacttgccatcttcatcagagaatggccttcaaaactacaaagtatagaatagtcattactgagagtgctttagagcctgaacttaggaccacaagcaaaaccactcagagctcctccagatgcataaatctacatcccaagtgggatttttacccttgatctcagggtcatttacgtcataatcttgtgagaaattaccagaaaaatggagatggaggaatgtcctaattaagaggaaacattagtttttagaagcagaagatataaagtaagtttgatgtcagttcctagccaaactgtaagataaataaccgactagagatcttatatgtgcttaggaaagaatgtcgtggtcaccaggaatcaacatggataccaataataggccttgcccagactcatttcctttaagtactactttcttttctttttttttttttttggaggaggaagcctagattattagatacacagagtgataacatctcacatttgaagatgctctctcatttagttcaaataatgctcacaaatgaacattcttggcaagtcttgatttcaccaaagtatttgagataatctctgataaccttatataaactagttagatctttgtgatcaattcaaacattataaggatcagaatagttggttctgggtggcatattttaaggacattaaaaattgatgtagtttccagagcgtgttgatcagagtagtgagcaatacctaaatatcatgtcctacagacatcatggaaggaattgggaacatgtaatcagtagaagaccagagaaaaacatggcagttgcccacctatggaaagaaatgacaatgattttggtattggagctcaaaagctaaaattgcatctacttacttgcattttttttttttttttgagacagagtcttgctctgtcgccaggctggagtgtagtggtgccatcttggctcactgcaacctctgcttcccagtttcaagctattctcctgcctaagccaccccgagtagctgggactacaggtgccccaccacgcccccagctaatttttgtatttttaatagagacggggtttcaccttgttggccaggatggtcttgatctcttgacctcgtgatccgtagcctgggcctcctaaagtgctgggattacaagcgtgagccaccgtacctggcccttatttgcattctttaaggcctggttccaatgttaccttctctctaaagtctctttctctttgcaaaatgtttgctttcacatttgtctttgaacccctatcgccatacacagtagctggattttatatatatagtaggtgcttaataaatgttggatgaaatattggagctgaacggggactgtcttgagttctcagataaaaaggcatccaaaagcagaaatgagaaccatctattgtattccctctaccgtgctatttgtttattcctgctctgagttactaactttagagaaaaattgttctaaattatatcagagcaaaatattttatagctgataaaacctagaaatgcattttttccctgtaatttgcattttaaatcataactattgcttgcatttaagcaaaaagagctagcgtttggaaatttttagagtggttactaacctgtcatctcttgaggattttagtcaagaatgaagaaaataatcattttcaaatttggaaggtttagaaaaagaaataacataaatgaaagcgatgctatcggagctttaaaaagttcctttgttccagtggcggtagatcttgagatgtagtaggctgaacgtcacgaagtaatatccccctctgttatcatgttcgattaggccgattcaacagtcattgagaagtggatggatggcgtgaaagacttcttaatgaaacagcaggctgcccaaggagacgacgcaggtctacagaggcagttagaccagtgctctgtgagttctgctgatctggggaacttgtcataaataacattttgttctttttctatgttatttgctgctattattaaaattgtgagaatatagcatagcattacatctagataaaatatctttcatcataaagcttttatgactttatagctaataaaagaatgacagattcttcaagtttttatttctggacgtggttatagaattttgagaggttatagaatagagaacaagaacaattttggttcattaggagtcattgtatattgcatttcttgtgccacatggtgaggatttaagaaaaacatatttaacaaatgaatttgagaagtgtctgttcatcaaattcatttaagtatgtttttcttaaatcctcaccatgtggcacaagaaaagcaatatacaatgactccatgttgtgcacgtgtaccctagaacttaaagtgttaaaaaaacaaaaaacaagaaatgaatttgctagtaatagtgcatgcagtttatatttggtgaaatcatcaggcttctctacattaattaaaaggctattcccttctgagagtcaagtatttccagtctaatttggcagatggctatatcaagcacccaggtgaaatgagtttcttaaggcacaatatttcttaagtagttagaagtactgactcttaagcagtctgcttgtgtaatatttgcagggagataagcagacaaactataattatggcatccacttatatagtaatgaactcaacatgcatcttttatgtgtttaggcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggaggtgagtttttcaactttactacctacggttttcaggagatgtagactgtagcttctctcagctgactaaatgtattatgacccatccagtttgaaaaacgatggtctagaataactccagcatgggtagtgagctggggccaaaaaaaaaggcatcattttttaaattaagagagggtgctgattgtccagtttggctcagggcttatccattcttgtcttaaatctggcttgaaacacatttatgacacttgctttacccctaagacatttgagtgggaccatttatttacttagcaaatatttcttaatcagttgccacctgtcaagcatcattctaggcactgcaggtacagcattgaacaaggaagaagaaactcctcttaaggagcttacattctagtgaggcagatggataatgaataatatcatggaggagtagcaaggagttagggctaggtgggttatttcaaataggatggtcagggaaggactttctgagatggggatgtttgaataaagaactgagtaaagtaagagatgagccttgtaaggttcagataagaacattcaggcgtggagaatagcaggctttaaaactctgtggtgggaatgaacttggtctgtttaataaagaatgaaggcagtgtagctggaataaaacagagaggagttagtgagttggagaatgggaatatttgaggttagaggtaggcagaggatggattagctatggccttggaggaaaggacttgggatttatttcaagtatgatattacacagaaagcaattggaaggttttgaacagggaagtgacatgtgatatagatcttttaaggtcactctggctttttgttttgtttccttttttttagcaacagtatcttgttgtatcacccaggctggagtgcagtggcacaatcctagcttactgcagccttgaactcctgggctcaagcagtcctcctgcctcctgggtagctggaactatagatgttcaccactatgcctagataattttagaaatatttttgagccagatgcagtggtgcatgcttgtaatcccagtactttgggaggctgaggtgggtggattgcctgagctcaggagtttgagaccagcctgggcaacatggcaaaaccttatctctataaaaaatacaaaaattagccgggcatggtggtgtgcgcctatagtcccagctacttaggaggctgaggtgggaggatggcttgagcccaggggatggaggttgcagtgagctgagactgcaccactgcactccagcctgggcgaaagagccagatcctgtcttaaaaaaaaaacaaaaattgtagagatggggttcttagaggctgaggcaaaaggatggcttgaggtcagcagtttgagaccagatgccagtctggtcagatgctgctgacctcaagcaatcctcctgcctcagcctcccaaagcgtggagatcacaggcatgggccattgcactcggcctctctctggttttcatgtgaatagtttgctctgggaaggcaggaatgaaaacagaaagaattcttataaggttactgcaggcttggagagagaggatggacccatacactagggaggcttaacgaagtagtgatggagggcatgagaaatattaggtttgaaaataaagaagagacctaaggaaagaattggatgtgtgatagaagaaaaagtgaatggtcaaggatgactcaggatttttacaaagcttccactttgtgtgaattgtggtgtcatttactgcaataacgaaggagaagcttctgtgggtgtaggtgaaatgatgactaccattctggaagggttaaatttgatgctagaagctaaggaggaaaaatcagtaacggggaatgtggggtcccaaatgctaggtggagaaaacttttcacagggcctaatgctgaggattgcaggggccaatcaaaacagaaaatcgagctttaaatttgataagaaggaggcatttaataaccttgagaaagcagggtcaatgaactggtgggaaaaaagtcatagtggatagttcgaggagggtatgggaactgaggagctgggacaccaagcataaccaactttgagaaatttctgtcttcaggggagcagagaaatgggtgggtgctggtgatgggaatccaaagaggtggttttgttatttttaataatgagagatattaaatgagagatattaataagaggacctcactttagaaaaaaaatgatggtgcagaaagagattgagataggagaatttatcaagtgaagtctgtgattatgcgaggatgagatccaccgtctaagtgaagatgttgctagagatatggtttctccgtggtaatggaagggaggaaatgatatgggaacagtagaactgggaggtattctttcccaattgctttgatttttattagtggaataatagtgaggctatatatagctgaagtgagtgacaaagcagtgaaaaatagaagtcaatatgaaatataggcttaccccacagtcacgtaaatagtacgtatttcttaataaaatgcttttggctaatgtttgtatcagaaaaatttatatttgcataactgaatattttgctttgtgtttattgttttacccaacttattttgaacatgttcaaatgtaaagaaaagttaaagaatgataaaaaggaacagctgtatatccatccattcagagacttgctaatgttttaccacatttgctttctctctctctgcctttctctttatacacacacacacacacacacacacacacgcacacaccctttttttttggtacttttgaacagtaagttgaaaacatcatgacacttcacccctaaatactctagcatgattttccaagcatgaaggcattcttctgcaaaaccacaatactatgatcacacttaagaaactaataatgttatactctcatctcttatcctagctaaattcaaatttttctcaatgtgctataatctgatggcatgtgccttaaggaactggggtttttgaggaaatagaaaatggtttggaagtggcaatgaggatcaaggaaggtgataattagaagtttgtatctctatctatctatctatctatctatctatctatctatctatccatccatccacatacatatggtgacaaataattcattgtgaattactgattcaaaatacaggaataaatatatgggaaatttaaagtgtcctcaggaaggaggtaaccacatgtgtgaataattatctagagcatttccagactattgcattgcattgactagtacaaatgttgaagtagttttggacaaacataattttgccaaattttcattttgctaaaaagaacaggcatataaaacaaatcaacaaacaaagatagtctatttcatctattatattcatgatatcctgaaaaaaaggaacattttaatgccaaaaaatagaaagtatatattctcaggataattaaagataattttgagggtgttttgttgttgttaagcttatggtagtgtctttattttcttcatttctttttggatctgtgaaaattatattgctgactagtgttcaagaagtacacatacagagaattttctggaaatggggcccaagaatctctgtctctctctttctctttctgtgtgtgtgcatgtatttttatgaaaagctgaccaggttaacctgatgatcagccaggcttgggaatgggattgtgagtgttgctggcatcagctccttggttaccctgtggggacagtggaagaaaagctcttgtttggtcctgtctatttttatgccggagatcctgtttggagggagggactgggaaagcctctgtctcttgcttaactctaacttctgtgagaaccatccagctcctgtgctggcctttggttactatccacctagcagccaagcaggccctggcagggtggccactactgtggcgtttaatttgagcatgaggctgaacctgccaagtagaggttggactgtgactgcagaacggcgccttctctcacagtagaagtcagtttgtcgttatggggaggagtgctctgaaaatatttctagacttctccaaaatttttaactaagttactgaatcagaatcagacaactatctattttttactgtaacttttttgtgtctgtgtggcatatacaaacatagtagacatcaaaaccaaaattttatagagcggtgtcttatgacatctttaatagcagcctctccctccctgctttttaaaagtgaaatcttaatgggaagtgcagttaaaaagaagaaaatggacattttgattgcttctaggggttttttttttttttttttttttgagacagagtctcgctctgttccctgggttagagtgcagtggtgcgatctcggctcactgcaacctctgccacccaggttcaggcaattctcccgcctctacctcccaagtagctgggactacaggcatgcaccaccatgcctggttagtttttgtatttttagtagagatggggttttgccatgttggccatgctgatctcaaactcctgacctcaggtgatccccctgccgtggcctcccaaagtgctgggattacaggtgtgagccaccaagactgactggcttctagattttttgtttttgctttcttttttcttttttccattataagtagtgctacattaaatttacttcatatatgtgcttttactgttatagattagattcctacatctgggattacagtcaacagttatgcattgtcaaaattataatagctatttcgagataagagtattatccaaatgtggtgtggaatcccagtcttaagattattttcattactgcttatattccacagcgttagcatgagatgtatgagattttatctgaattttaaagcatgcaattcgttgtggaaagttattactgtgcctttaaatattaagagctaaaacttgacattgaacacattaacatttgtttatttgggggaatggcttttcctttgtagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaaggtgaggcggggacgaccagtgccaacaggcttcatgcctccctcctccctttaaaaccagcacatcaatcatctgtctatctgtcaaacactatgtgcatgtagcatctttcacagtaggtttttgaattaaaaaaacataacagggtagctgctctaattttagcaggggaagaaagccaggagtccacatatttggcttggcccatgagttgagtccatgagggcccatgagacaagctcttaagttagacctttgggaggctacagagaatgacttaaaaacctctggtagtgggcatgaggaagaatgatcatttttttttaattggggtaaatacatataacattggtcagcttaatttttaagtgcacaatccagtggcattaattgcattcatcactatttccaaacattttcacaaagagttattttttgtaaggggaacaaaagagacctcccaagttgtctgaggtttattcttattttcctgttactaatcttccagttaatacatacggcacatatgaacactgacgtttcattagagcaggtaggaatagcggtaggaatgcatcggggagttcatattagttggatccactggatacatttcctgtaaacttgtactcctctgtcgatagtcttgaacactctctttttatatataataaaagaactgggcatcattcccaaatttctaacacagcttcaactgtccttgaatgttcaagccaaaggagatggtgttttcaaagcttttttttcctgtaagcttaagcaacacagtgactaatgttttacctcaaagttaacttacctagaagtgtaactaaagcaaaaatctgtgatttttttcaaaaaagggattatatgacattcatacattattatacatgaatcaaagtaaatatgacaggagacttgttggaagttgttttttcactaaaacatcttttttagtgtagctctttttgaaagatttaaaaatactcagtacataaggtattttaaaataggctaccatgttaagaattgtctcatttattgtctttctttacactattggcattgtagttctgtggattttaaaagttgctatagatgagatttgagaaaaatgatatttaaatatttgattgggcaacattttatttatttttattctttcaaacagccattaggacttacaaaaccactacacttaattactttcccccaatctaaggaagttcaaaaccattaagtagtagagaaaagtaaaggggaaagtgaaagactgttttatttgtatttattgccattaaaagtaatggcataaactgcaattacttttgcaccaacctgataggttgattttcctgaatgtcagattgtttatcttagcactgagaaacagctatttctggatcagatcatctcagtctaactttatcattgaaatgctattaattagcagaaggatacatgtgcctatgttctataattttttaaaaagcttaaattatttagagaacttttaaagatacttctaccatagtgtacctcaatttttgtgaaaatatatttatcacagtgtaatctgctcagccctccagtgataatgaaaattcactcacttaaattctgatcttggacccagactttgaaaatacttcatgtcagtaaacatactttggataacttacgttaacactgctgttatgaaatgaaaacatttgtgggagctgagtacattggatgcatgagtgaaatttcagagttagcattcttatttcaaaaacgctcaactgggctgggtgcagtggctcacgcctctaatcccagcactttgggaggccaaggtgggtggatcacctcaggtcaggagtttgagaccagccccgccaacatggcgaagcctcatctcgactaaaaaatatgaaaattaggtaggcatagtggtgggtgcctgtaatcacagcttctcgggaggctgaggcaggagaatttcttgaactgggaggcagaggttgtagtgaacaagactctatctcaaaaacaaaaacaaaaacaaaaccccacaaagaaccattcactgttacctaaataatgttctattttggcagttagaatcatccagatgttttaactttggtttaattcttgaaaaaaaaagaaagaaaagaaattggttactgagaaagggagacgtttttcaagttcatccatcctttcttggaacagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggtatgctattattattattgttgttattattattattattattattattattattttcagtgatgtatttctgagatccaaactctgtaatgttttggccattttcaaatcttggagaaaacttctcttttctttcaaattctggattataaagaaaaaatagttcttgggaaatagtttgataaaaatgaaagaggggttaaaaacaggagaccaaaatctgtccctaattatcagaaggttcttgggcaagtcattttgtatattcaaactttactttttttataggtgcaatccaggttttcatgtaacagatgatctgtagggcctattccagtccaaaaattgcagagcacatttcaagcctctcttttgttttgttttgcctggttgagtacatagagaggaattattttcttttgagtggtgtctaaagttcaagagtcacctgaaggaaaaatagaacttaaatatgtgacagttttactgggtcttagataaaataccttttttttttctccctggccattacacgtaaaatgtagatgagtctatgaaatttttttaaactaagagtgaggttttgcttgtttgtttttatagtagtatgacttttgttattgcttgttggaagatttaagaaggctttcaatttacaacaatttaatttacattcaatttgacgtaaaacaaatatttgtattgtggcaaatcttgaaatggtaaaaaatggcaactgcaatatttaacctaaattcattcattactttgatcattcattcatttgtaaattcattcgtttcttgttctaaaccaattttgtgctaagataaatatatatcattgaggcaagttagtaagaaagctacttgatttgggatctgtctgcttcttggaagtggtcttctttgagtcattttttctttcccataagaaaagaggttgtgcttgcatctgagcagatttttggtctgctttttgcttgtggaaattgggggactagaacctcttttcttttattctaattcagtggctggaaaattatggctgaggattttgttttgttttgtttgagacagggtcttgctctgtcacctatgctggagtgcagtggtatgatcacagctcactgtaacctcaaactcctgggctcaagtgaccttcctgcccccgcttcctgagtagctatgactccagccttgcaatgccacacctggctaattatttttaaattttttttgtagagatgggggtcttgctatgttgcccaagttggtctggaactcttgggctcaagccatcctcctgccttggcctaccaaagtcctgggattaaaggcattagccactgcacccggactggctgagggtttaaatctaacttgtagtttggttttggatacctggttaactgagaatagtttatacatttctcaagggttgtacaacacatacccccctccaagaagaatctgtgataggaagcaaatgtgtcctcccaaaacctaaaatatttactggctggccctttgtagaaaaatgtactgctccttgatctggtaagcatacttcatatggagagtggaccggcaggtgccttcactcatttatgtaaaccagaagatgcctccactcattcagtacattcaagacgacaagcccaggaggcatccagctgagttctttctcctaaacttaccactcaaataagttcctcttataataagggattataaatttataaatgtttccacccactacacaacccctgggtccctgctctggaaacctcagaggggaatgagtgatcaaaaccaacacagtaagaacagtataactccagttttggtaaaatgtggctctcttatattgacatgtcctcatgaatttagaaaaaagttgggaaggctacattgcaaacttttacatcagttagctccaagttggaattgggtggggcccaggagatttcaattttctatgaaattattttttaaaaatttacaattgggagcaattttttcattttgttcaaaaaccaaactttttttttttttttttttttttttttgagatggagtttcactcttgttacccaggctggagggcagtggcgtggcctgggcttactgtaacctctgcctcccaggttcaagtgattctcctgcctcagcctcccgagtagctgggattacaggtgcctgccaccatgcccagctagtttttgtatttttagtagagatggggtttcaccatgttggccaggctggtcttgaactcctgacctcatgtgatccacctgccttggcctcccaaaatgctgagattacaggtgtgaaccaccgcacttggtctttaaaaaacaaactaaataatgtttctctcctgtttttcttactaattatatagttctatttttgacatttaaatcagatcatggaatttattttaaagagtgaggcagcctcttgcccactctttgctccccacccttcaccaactggtctcatatgattttgttgattattttattttattttatttgagatggagtcttgctctgttgcccaggctggaatgcagtggtgcaatctcagctcaccgcaacctccgcctcccgggttcacgccattctcctgcctcctccagagtagctgggactacaggcatccgccaccacacccggctaatatttttatatatatatatatatttttagtagagacagggtttcaccgtgttagccaggatggtcttaatctcctgacctcatgatctgcctgcttcagcctcccaaagtgctgggattacaggcgtgagccaccacgcctggccgattttattttatttttttgaagtttcaactccatcagttctgaattcctaggtatactcacatccaaatgaaattattagcgattaaagagaatgtgtagtactagagatacgatgtgtgaaatggctttttgtctaatttaaaatttttcatgctttaggaggtctggtcttgttggattgaactgcttcactatttggatcttgaaactacctggttaaacactttggaagagcggatgaagagcacagaggtcctgcctgagaagacggatgctgtcaacgaagccctggaggttggaacccgtgatctccacggcatttctctttgctgtgatgaggccacacgtgtattacaatgaggaatgtaatgctttacgcaggcaaatgcatttgcttcctcagtggttttcaatgtcacttgcattttcttccatagcctgaagtgtttatacaatcatgtgtatttagattattggtgacccattatatcagcctcaagacgtggttagctgtttgacatcttacattttagacatgttgaagcactctagtggttttccagtttattttagtaggccctggacaaagctctgccatatgttattaggacaactgctctcttgtttcatcaacaagttatttttactcactaaacacagcactgacagtttataggggattcctgtctcttaccttcagatgctagaagttaagacagtggttgagccatgggatcttgtcgtaggagcttgtcttcaagcctggatttgaactccttgaggccaagaaatgtacccgatgctttgttattcctcagttcccagcacagtgtgtagcacatgttaacttaataaccgtttcttaaatgaaatacagtgcaaagagggtaggtttgcttaacaaaaaagaaaagggaagggggtagataggcttttaaaaatgtcatggtaccatgtgggaactgagtggacaactggattaaaggtcagaaatgagtaaaatgtggcacttacattccaggagacggatgctctgctagagaaaagatgtcacttctcaaatatagcagagtgagagacagagtgaatgaaaaatatgaaaagcttaatttttttcctaatgtaagagtgaatacgtatatattcttgaaatatggaaaataaagaaaagtataaagcaaactctaagataaacattttaaaacagtttgtagatttcttcctaattattatcttttatgtatgcatactagaaggtagtatattggatcaaaggctttggagtcttttatttacttatttatctttttatttgagatggaatcttgctatgttgcccaggctggagtgcaattgcatgattttggctcactgcaacctccacctcctgagttcaagcaattctcatgcctcagcctcctgagtagctgggatcacaggcgtgtgccactaccccagctaattttgtatttttagtagagatggggttttaccatgtcggccaggctgggctcgaactcctgacatcaggtgatccacccgcttcggcctcccaatgtgctaggattagaggtgtgagccatcgcacttggccaggctttggagtcttaaagctttagagccatgttggaatcttagctcttcttttgactgtgtgtatgtaggcaagtaatttaacctttctgagcttcaattttccaatctgtaaactgggaatgctatttagcccatatggttaattagatttatgtatataaaaagtgtgtatataaaacaatgcctcttattctgcatatattgtaggaaaatgactacttatttttagtaatataattaataaaagttgagatcattttgcttgtatagtactgttctctgcctttgaactttgtgtcatgagcatttccccatataattaataattatttttaactttttattattcatttatttattgtttagagacatagtctcgctctgttgcccaggctggagtccagtggtatgacagctcactgcagccttgaactcttgggctcaagtgatcctcctgcctcaccctcccataattaataatagttgaaattatttttgtgaaattatatcatatatcacttgtgctaatttctcaattttatgcattttttaatcccatgatggatatttttgtgaattagtaatttacttaacttttggtcctgttacttaggtagatttttagaaaatataattacttgtttaacaaatagacattttggggatccttgataccttttgccttagtaaatgcattattatttttttttcccatctccattccagtctctggaatctgttctgcgccacccggcagataatcgcacccagattcgagagcttggccagactctgattgatggggggatcctggatgatataatcagtgagaaactggaggctttcaacagccgatatgaagatctaagtcacctggtaagagttgggacatacatgggtgttgattaggtattgatgaagtggagctggccctaagctccatatcatagagctttaatgttggaaaaatctttaatgttggttaaagttggtaaccaatgctaacaggggcattgagggtattgaaatattcagaaaggaagaatagatctaacactctaagacagaactggatgattaaaaaaattatttttgagattacttctacttacaaacatttaattttcattaaggatcatatgatagctgtatataagaacaacaactcatactatcctagtaaatattagggccatgatatttcacataagctgctgtgaaagccatagtctcttagttcatatccaggttgtaacatacatattcgtatcacaaattagagaaagaacatttcttttataggaaggttgggtatgaatattaggtgcttccaaacacatattaaataataactgttgatgttcagcccatgaataacatcaagcttaacccaaaagtgctgtaaatagtagtttgatatgtatgtacacctatagaatttgttttaggctttggaaaaaaagagactctgatgtttgtgtattgatagacatttttcttatgttttatattcttaattggcagacattgctgattcctaaaaatgctttaaaattataataaataacacatttttatcttctgtttaatgcatcttatgggaaacctttacatttttgtatttcaacattatatatagaaagaagtaataattagtaattcagctgcatggtacataagatcctagtgggacattttcactgttatcattagtaattattatttatttataaagaaagctaaagtcttggatgaaagcttttatggtcttttcttagtggccagaatatatatattctgctatttatatttgtgttgggcaactaatgattcaatttctcctttgtgcaggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcaggtattgccgtgcatttgagggcttttgagctgtaaagagagcttttgtaattgcctcctcaactataagagaacccctcctgctctccaaaaccgagagtcaatgggaaagattgaccttacttacagggcagcatttgggttttggagttctcttgctttctatgtgagactctggcaaaagtcttatatagtttattttattttattttattttattttatttatttatttgagacagaatcccactatgtcacccaggctggagtgcagtggcacgatcttggctcactgcaacctccgcctcctgggttcaagtgactctcctgcctcagcctcccgaataactgggactacaagcacgcgccaccacgcccggctaattttttgtagttttagtagagacggggtttcgccatgttggccaggctggtcttgaactcctgacttcaagtgatctgcctgcctcggcctcccaataatttttgtatttttagtagagacggggttttgccatattgtccaggctagtctcaaactcctgacttcaggtgatccaccttcctcggcctcccaaaatgctgggattacaggcgtgagccactgtgcctggctgaaaagtcctgtatattttaaattgtagttttcttagctgtgaagttgggacaattccttccttataaataagttgtgaacattagaaacgacaaatgcaaagcccttagcaggtgcgtcatgtacaatagtcataccatgcagtgggccatattattattattatacaaaaacgtattattattattttttagacggattctcactctgttgcccaggctagagtgcagtggcgcgatctcggctcactgcaaactctgccccacaggttcaagcaattctcctgcctcagcctcccgagtagctgggattataggcgcccgccaccgtgcccagctaatttttgtatttttagtagagatggggtttcaccatcttggccaggctggtcttgaactcctgatgtcgtgatccacccgcctcggcctcccaaagtgttgggattacaggcataagccaccgcacctggcctacaaaaacttattaaagcttctgtggaggtcaacattatgtaaaatacgatatcatgtattacacaacgatatagaacttttgtattgtctctttttatacttaagtaaaaaaaaaaggacatcctctcccctttccaatctctttttagaaaatccaagcagagatctcagcccatgagctaaccctagaggagttgagaagaaatatgcgttctcagcccctgacctccccagagagtaggactgccagaggaggaagtcagatggatgtgctacaggtaaagaaggccaggagcttccttttacttttcaacttgttgggaattttcttcaaaaaagagaaagaattgattacttgggcaccgtttgtattctttgtgatgtaaaccatgggatgggagtgatgatgtgttgaaggttgcatcctagggcagcagaaacaaattgttgcatgtgtggaaaaatatgaaatctgattttgatagctgagatgagaaacaagagagtgagccagatttagaagttagctttatatacactttttctttaatgcagagcctctgtcagtatcgtgtggctgatgctgtgggcaggccgagcatgaattggatgcagcatcatttagttctttcatggttgatatgacattgactttcactctgaacttgtgatgaagggcattttgagttctaggttcctgaactatctttttgaacatgaagttttaattccagtgaggtcagctttatctaaatttcttatccaaatctattacttctgagattgagacactgagtgttgtaatttttgacactgggctatgcagttcacttaggtgatcgggtaccctcactgagattcattaggagttttttattttgggtcatatttctgaatttttttcttttggtactttatggtacaaatttttagtagtatctgttatgctcatgatgagagagataatcatcctgatgggaattgcatattttcatttctgcaaacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatggtgaggcttttgggtgattggcacatccagtggctttttcagcagctgttatggcttggtctagcaagtacatgcctagtgtgtccagtgatcactagtctacagtgtgctaaacataaggattgatgatggaaaacgtgttaaaaaataagaagtgtggtctttccctccaaagaaattagaagagataagagagatagctaaggaaactagaatagacatgtatataacatgatgacaaaaaccaaaacaaaagaaatacagcttaatcaccatgtgaagttaggagggcttcagcagagtgtgactaataagcaaagttttcaaggataaatttgaattagctagaagaaccatacttagaatggatatcgtaaaaattccattttctaggaaaataaaaatttcaatagaaatttaaaccttaagataggaaagaagaaatgatatataaggccttattacttttttagtcttgaactttataattcaattgaatagaaatttaaaaataatgtggctaaggggacacaatcttagaattagtgttctgcttgagaatcacagaacttaagatgagactctttaggacaggagaggtatagggacagttctttgtgcttttcaaaacaaaggataaattttaatatatatgtgcatgtatgtaagtatttatttgattattgtgacataatggtaatcagagaaagtgctgtccttgacttcatggaacatacatagttcaggggtctgttacatgacagcgtcctatgagatgttgagatgatgatgtataggtgtcaagagaagctgtttagaataaagctttttggtttcaggtaactaggaagaagacagctctgaatttgacctacagaactacgatttctttttttatatttaaatttatttttatttttaatttttgaagacttttaggttcaggaagtacatgtgcacgtttgatacatggatatattgtatgatgctgaggtttgggcttcgactgaacccatcacccaaataataaatgtagtacccaattggtagtttttcagctcttgcccctttcctccttccctccttttggagtcccattgtctttgctttccatctttatgtgcatgtgtgcccattgtttaactcccacttataagtgagaacatttagtatttggttttctgttcctgaattaatttacttaggataatggccttgagctgcattcatgctgctgcaaaggacatgatttcattttttatggctgtgtagtgttccgtggtgtatttgtaccacgttttctttatccattcccccattgatgggcacctagattgatgacatgtctttgctattgtgtgtagtggtgtgataaacacgggagtgcatgtgtccttttggtagaacgattatcctcctttacttatatacccagtaataggatttctgggttgaataataattctatgtttagttctttgagatatttccaaactgctttccctaggggctgaactgatttacaatcctaccaacagtgtatggtgttcccttttctctgcagccttgccagcatctgttgttttttgactttttaataatggtcattcagactggtgtgagatagtatcttattgtggttttgatttgcatcagaaatctgtttacttatagttatatacatcttgatatatcgagttttgtattttttatcatacaaattatatatgttcattgtggtagacttagtacttctgagaaatagaaataaatgttaataattccaaatccaacagacagcagtagccagtgttggcttgttttagtcataacatgcaagattttttaaaaatgtaattttaattgtgataaacattctgtttttagtcctaatgttttcccattttatgtaggaaaaatatttatattatcaagtactttcataagcatttgtctgagattttgaaagaatgagcataaactctattagtttattttcttgtcagatttgaagaagttattacaagcttgatttcatttgactcgaccttcagaccaaatctgagaaagatgatggcctttgatcaccatagttaggtcttggctgtcaatctgtgtaagctgtggtctgacatgatgccagttggcaagttgtcaccacagtgtgtaatttgtctttttctttgtttgttttaaagaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgaggagagcagccccacagctcatctctctgtctctctctctctctctctcaatctctctctctctctcgttctctctcatgtatttttaaatttcattttttggaaaatgcatgtttgaaaattatgagattcatacgtgttttcaatttattgtaataattgttatatttctttaaatgtatgtggtaatattacagtgattcatagttacatagaaatttatttttggctaggcacagtggctcacgcctgtaatcccaggtctttgggaggctgagtcaggtaatggcttgagcccaggggtttgagaccagcctgggcaacatgatgaaaccttgtctctacaaaaaaatacaaatgaaaacctccaaaaacaaaacaaatttccaaaaaaaaattagccatggtggtgagtatctgtagtcctagctacctgggaggctgaggtgggagagctgcttgaacctgagaggcagaggttgcagtgagctgagatcacaccactacactccagcctaggaacagagtgagacactgtttttaaaaaaaatttatttttaatatttaattcaggctaatatttatactttcaatggctactgatattccataaattattctaaggatactacaagtaatatatgttcattgtggtagacttagtgtgtctggaattggtgggttcttggtctcactgacttcaagaatgaagctgtggaccctcgtggtgagtgttacagctcttaaggtggcgcatctggagtttgttccttctgatgttcggatgtgcttggagtttcttccttctggtgggttcatggtcttcctggctcaggagtgacgctgcagacctttgcagtgagtgttacagctcttaaggcagcgcatctggagttgttcgttcctcccagtgggcttgtggtctcgctggcttcaggagtgaagctgcagacctttgcagtgagtgttacagctcataaaagcagtgtggacccaaagagtgagcagtagcaagatttattgcaaagagcaaaagaacaaagcttccacagtgtggaaggggacccgagcgggttgccactgctggctcgcgcagcctgcttttattctcttatctggccctacccacatcctgctgattggtagagacgagtggtctgttttgacagggcgctgattggtgcgtttacaatccctgagctagacacaaaggttctccatgtccccaccagattagctagatacagagtgtggacacaaaggttctccaaggccccaccagagtagctagatacagagtgttgattggtgcattcacaaaccctgagctagacacagggtgctgattggtgtgtttacaaaccttgagctagatacagagtgccaattggtgtatttacaatcccttagctagacataaaggttctctaaggccccaccagagtagctagatacagagtgtggattggtgcactcacaaaccctgagctagacacagggtgctgattggtgtgtttacaaaccttgagctagatacagagtgccgattggtgtatttacaatccctgagctagacataaagactctccacgtccccaccagacccaggagtccagctggcttcacccagtggatcccgcacccgggctgcaggtggagctgccttccagtcccgcaccgtgggcttgcactcctcagcccttgggtggtcaatgggagtgggcgccgtggagcagggggtggcactcatcagggaggctccggccgcacaggagcccatggagggggtgggaggctcaggaatggcgggctgcaggtcccgagccctgccccgcaggaaggcagctaaggcccggtgagaaattgagcgcagcgccggtgggctggcactgctgggggacccagtacaccctccacagccgctggcccggtgctaagtccctcattgcctggggccggcagggccagcctgctgctccgagtgcggggcccgccaagcccacccggaactccagctggcccacaagcgtggcgcgcagccccggttcccgctcgcgcctctccctccacacctccctgcaagctgagggagtgggctctggccttggccagcccagaaaggggttcccacagtgcagcggtgggctgaagagctcctcaagtgctgccaaagtgggagcccaggcagaggaggcgccgagagcgagcgagggctgtgaggactgccagcatgctgtcacctctcattagtacttcaaagaaatacaagggaaaaaataaatgttaataattccaaatttcaatggatagcagtagccggtgttggcttttttctagtcgcaacatgtaagatttttctaagtgtaattttaattgtgagaaacattctgtttttagtcctaatgttttcccatttcatgtaggaaaaatgggaaataataatccctgtaaaaactcaagttgttggtccttagatttctaaattgaacagtctaccgagaaatgttaaaacatcagggctctagtaaataaccagtggcaagaagttcacattaatctaccaggatttgaaatcctggcaagaaatatctctaatttgggcattttagtgaatccatgcaggagttgttgagcatttactgtgagtgaatgaatttttgccctgaaaccaggagagcaaagaatgtgtggaagtgtgaaaccttaataggtaatattgaaaacccatgtttgatagtattttggatcctccttcagttaggaaatattaactacttccagttgaggtaatattgaagtttctatataagcccagagaaaaatagctgaaattttgttttcagttgaaatcagaacgaccagtttatactttttctgggtgattttgatctcacttctgcaagcttagattgttgatgtgatacattttgatgtattacatgtctggaacacacaccttagagcttctttttggaattatacagctggttattcgttaaatattattatatttattcactgactgggcattttatgaatggaatggtattgctggtttttgcactaattctccaattgtgactataattttagtattaattaattttatcatttaaagtttcactcaatcgagattttactctgtgtcaggaattatacaaggagacagtgatgaggaaagatataaattatctcgttgtctaatggaacttagggtagtgaaagagaaaaacattgagtagttacatgagatgatgtcacattatcagtctgaagagttatgaagaatgtacatggttctttaagagtataggtaaaggggggtttcacccagtcttgtgttaggaaggcttccctgaggaggtgatgcataagccgagatctgaagtctgggtaggagtaacctgggtgaaacgaggagatttctagactgataaaacagtatatataaaagctctaaggcaggaggcagtgtggtacatttatgtggctagagcagagagagccagtgtgaggaacatggtgctagggagataggattagacaaaatcctgccaatgtcatagagtttgtgttacagattaaaatctgtgtcttaagcagttactgcacaggttttagtaggcaaattacatactcagatatgtcttttaaaggattactcactgcattttggaagaggaattggagggaggctggagtggatgtgaggagactggtttcgaagtcattgtacacttggtgagagatggtcgtaccttgaactaggatggagagtggagatggagtgagtgaattgatttcagacatatgtaggaagtgaaatcaacaggacttggtccaggaggagagatgaaggatgacccctgggtttctggcttgatgatgtggatggtgtggccattgagatgggtgctgtaagaaaagatagaggaccgggtgcggtcgcttatgcctgtaatctttgcacgttgggaggccaaggtggtggatcacctgaggtcaggagtttgagaccagcctggtcaacatggcaaaaacccgtctctactcaaaaaaaaaaaaaaaaaattagctgagtgtggtagtatgtgcctgtaatcccagctactcgggaggctgaggcaggagaatcacttgaacctgggaggctgaggttgcagtgagtcaagattgtgccactgcactccagcctgggcaacaagagtgaaaactctgtctcaaaaaaaaaaaaaggtagaagcatgcagaaatcacaggtatgtattggacatgttgacattttaagtacctttgagaatgttaattggaaatgtcgggtactcacatgattattcaggtctggagaatatatctggactgaagaggtggattttatgagtcatctgcatagaggtcataattaaagtaatcagggatgatagattgtctaggaacaggatatagtgaaagaagagggccctcaaccaagtcttaagaattacatcatttagtaagaaatctcaggaagatgagcttgcaaaagaaactaatgtaagtagcaagaagtggtagggacacagttgagtactaggtctggaaagctaggggaagatggtattttgacagagtgcagttacctgttttggatattttgaaagttaaatatgatgtccacataaacatattaattagatcagttgccattggggtcattattgaacttagcaagggcaatgtctgggagtgatggtggtagaagccagaatggcatggctcaatccaaagattgtaccaccctggccttggccttaacctctttaagtttcattttcattatccataaagtagaaagaggctttgtgaattttattgcatacgtgtgtaagattccttagcacaacacggaagctgtattaagagcttggtaaatgttagttaagttcatttgttttctgtcaacaacaatgagagcaaaataataataaggtttggtttgtatagtcgtgtactgcattttaagttaaagtggttaattataaaacatataattgtgaaaatggtgctattttcccctcaagttactataataccgtatttttccttcatggagaggattctaagatatcttatgttcaaaattataatagatactagtgatttttcaactttatttctgcccttttatgtgtgtttttctcgcttaatacacataacaatcttttttttttttgagacggggtcttgctctgttgcccaggctggagtgcagtggcaggatcacggctcactgcagccccagcctccagggctcaagcgattctcccacctcagcctactgaccagctggaactacgagcacgcaccaccatactggctaattttttgtattttttacaaaatgaggtctttcattttgtagaaaatgaggtcatgtttcccaggctggtcttaaactcttggactcaaaagatttgcctgcctcggcctcccaaagtgctgggattatagacatgagccactgtgcccagcctcataccaatcttttgagggctatacctctgccagtatcacttaggaaattaatgatagagctaagatgaaaacccaggattgcctggcacttaaccactacagcatattgcctccttgcagaaatgcaagcttagaggattctaaggtgctaagacaaaggttatgtatgtcttgggggttatatatgaatcagtttggatctttagttaacattctgattcattctcatttatgttcattcccatctcagtctcagtctctccctgcctctctccgtctcaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaagtaagttgcagttcagatgaaacaccagcatgatgccagcgtaacatggcatttgttcgggcgacctggttggataccatgtccctccattttatattaaatctagccttttcttttttgcattgtttttccacttctctgtcctaagaaaaaatattttaaaaataatgattatattttattttctttataatttctacttttagattaaggggtacacatataggtttgttacatggatatattgtgtaatgctgaggtttggggtatgaatgatcccatcacccaggtagtgagcatagtacccactaggtagtttttcagctcatgcctccctctgtttctcgcccctctactagtccccagtgtttatcgttcccttctttatggccttgcgtacccaatgtttagcccccacttgtaagcgagaacgtggtaattggtttcccattcctgcattaattcacttaggataatggcctccagctgcaaccatgttgctgcaaaggacatgatttcattcttttttatggttgtatggtactccatggtgtatatgtatcacattttctttatccaatccaccattgatgggcacctaggttgatgacatgtccttgctcttgtgaatagtgctgatgaacatatgagtgcatgtgtctttttggtagaacagtttattttcctttgcctatatacccagtaatcagatttctgggtcagtaatcagaattctgtttgaagttctttgagaaatttctaaactgctttccacagaggctgaactaatttacattcccaccaacagtataaaagtgttcctttttctctgcaaccttgtcaacatctgttattttttgactttttaataatagctattctaaatggtgtgagatggtatctcattgtggtttcaatttgcatttctctaatgttagtgatgttgagcattttttcgtgtgttgttggctgctagtatgtcctttttgaagtgtctgttcattttatttgcccactttttaatggggttatttgtaaaacagctcttttaataagatatttttatcctgattccaaaagcattacattcatggatcatcaaggcctttataggtattatttttatatagtacttaaaagcctaattcaccacctttaaaatcaatgacacatatttacagagtgtttacaaagaattgtgctgagtttaattcttctttaataacattttaaaaccaataagtaatctttctattgcaaactttcagatgtaaagaacttaggaatagaattttaaaaaatcaatacaagagttttctttaaccctgtactttgaaatcacagagattagaaagttgatttgctggttctggcttctgcagtagagaaagaattgaatggaacatgagtggttcttttaacaaggcattctgttttcctaaatctctttcctgagaaagaagcgagtatactagtgggaagtgctgaatataaatgatcaatactgtgactgatgtttatataaagccacaagtatcagtttgacaccctctacagctctacacgtttgctgtgggccttgaggagaaggtgctgagaggttgtggggtgacacaactcctgcttactttgaatgctctgtggagatgacagctgggagaaagttaagatagtagacactggaaagactattctcagtttagaaaaaagctcatgaaaagcgtgatcatgccatgagcagtgtgagtgtaaaggaagtgaagaaaggaatgtatgagggaaatgagcattgcaagtcatcggtgtgttgtggttgaatgcaaaacaaaggcaccaaactttattgttgttaaatttaagtttttcaaggacatattatcatcctcgtgcagtatactttgaaaatcattactttttaaattagtaacataagtaatagaagctatttgaatgaaatttgcctagtgtaatacaaaaaaacaggagcaaaaatcacctataatcaaacaatgctattttttttcatttttttgagcacatttcgatgtgcacatgcaaaagcatatatttaaaaataaattttgttgtaactagtatttattgaccttcttttaaaaacttacatctttggcatttttctttacctatacttgtttttatatagcatattagagatatgcatagtatttcattcttaatttttttattttctcatttctctattcatgtccatttaaattattaccattttcattattatagataacgctatggtgaatatattaaaccatatcatacattcataattatttcctgaggataaattcttaaccctaaaagtattgatcaagggacaggaatatatccatttttaagtcttatacatattatgcaattgttcttcagaaatagtgcacctaccacatgcgaatgagaatttctacttgacatcatgttttggttatttaattagaacatttttgacaagtttataggtcttctatagcgctgttaaaaataccgctttttactctaattctgaccattttttatcaccaaattggtcttttaatttggagctttttatctgttctgattatcaatgcttagtgagttgtgtttgattgcaaacaaatttttttattactgtagcttccttttttgtttttttaagttttattttttttttgaaaaaaagtaaatccttctgaatattttttaatgaacaaaatccatctttttcttcattatttctgcctttagtgcttagaaagaccacctcaactccaggttcatttaattattcactttttttttctactagcttttttccttttttttaattgttatactttaagttatgggatacatgtgcggaacgtgcaggtttgttacataggtatacacgtgccatggtcatttgtctcactcatcaacccgtcatctacattaggtatttctcctaatgctacccctcccctagccccccagcccccaacaggacccagtgtgtgatgttaccctccctgtgtccatgtgttctcattgttcaattcccacttatgagtgagaatatgtggtgtttggttttctgttcctgtgttagtttactgagaatgatggtttccaacttcatccgggtccctgcaaaggacatgaactcacatttttaatagctacatagtattccatggtatatatgtgccacattttctttatccagtctaacattgatgggcatttgggttgattccaagtctttgctattgtgaatagtgctgcaataaatatacgtgggcatgtctttagagtagaatgatttataatcctttgagtatatacccggtaatgggatttctgggtcaaatgatatttctggttctagatccttgaggaatcacctcttccataatggttgaaataatttacactcccaccaacagtgtaaaagcattcctatttctccacatccactccagcatctgttgtttcctgactttttaataatcgctattctacctggtgtgagatggtatctcattgtagttttgatttgcatttctgtaatgaccagtgatgatgagctttttttcatatgttttttggccacataaatgtcttcttttgagaagtgcctgttcatatccttcacctactttttgatggagttgtttgtttttttcttgtaaatttgttgaatttccttgtagattcaggatattagccctttgtcagatggatagattgcaaaaactttctcccagtctctaggttgcctgttcactatgctggtactttcttttgctctgcagaagctctttagtttatagatcttatttgtcaattttggcttttgttgccgttgcttttggtgttttaatcatgaagtctttgcccatgccagtgtcctgaatggtattgcctaggttttcttctagggtttttatggttttaggtcttacgtttaagtctttaatccatcttgagttaatttttgtataaggtgtaaggaaggggtccactttcagttttctgcatatggctagcctgttttcccaacaccatttattaaatagggaatcctttccctattgcttgtttttgtcaggtttgtcaaagatcagttagttatagatgtgtggtgttatttctgaggcctctgttctgttccattggtctatatatctgttttggtaccagtaccatgctgttttggttactgtagcctgatagtgtagtttgaagtcagctggatgcctccagctttgttctttttgcttaggattttcttggctatatgggctctttttgtttccatatgaaatttacagtgtttttttctaattctgtgaagaaagtcaatggtagcttgatgggaatagcattgaatctaaaaattactttgagcagtatggccattttcacagtattgattcttcctatccacgagcatggaatgtttttccatttgtttgtatcctctcttatttcattgagcagtggtttgtagttctccttgaagagctccttcacatcccttgtaagttgtattcctagctatttaattctctttgcagcaattgtgaatgggagttcactcatgatttggctctctattattggtgtataggaatgcttgtgattttttgcacattgattttgtatcctgagactttgctgaaattgcttatcagtttaaggagtttttgggctgagactgtggggttttctaaatatacaattatgtcatctgcaaacagagacaatttgacttcttctcttcctatttgaatacgctttatttctttctctttcctgattgccctggccagaacttccaatactatattgaataggagtggtgagagagggcatccttgtcttgtgccagttttcaaaaggaatgctttcagcttttgcccattcaatatgatattggctgtgggtttgtcataaatagcttttattattttgagatatgttcagttaatacctagtttattaagtgtttttagcatgaaggggtattgaattttatcaaaggccttttctgcatctattgagataatcgtggtttgtgtcattggttctgcttatgtgatggattacgtttattgatttgtgtatggattacatttattgatttgcattgaactagccttgcatcccagagatgaagccgacttgatcatggtggatacactttttgatatgctgctggattcagtttgccagcattttattgaggattatcacattgatgttcatcagggatattggcctgaaattttcttttttttgttttgtctctgccaggttttgttatcaggatgatgctggcctcataaaatgagttagggaggagtccctctctttctattgtttggaatagtttcagaaggaatggtaccagctcctcttagtatctctggtagaattcagctgtgaatccatctggtcctgggcttttgttggttggtaggctattaattattgcctcaatttcagaacttgttgttggtctattcagggattcaacttcttcctggtttagtcttatgagggtgtatgtgtcctggaatttacccatttcttctacattttctagttcatttttgtggaggtgcttatagtatcttctgatggtagtttgtatttctgtgggatcattggtgataccccctttatctttttcttgtgtgtgactatttgattcttctctcttttcttctttattagtctggctagtggcttatctattttattaatcttttcaaaaaaccagctcctggattcattgaattttttgaagggttttcgtgtctctatctcctttagttctgctctgctcttggttatttctgtcttctgctagcttttgaatttgtttgctcttgcttctctagttcttttaattagggtgttgattttagatctttcctgctttctcatgtgggcagttagtgctatgaatttccctctaaacactgctttagctgtgtcccagggattctgttatgttttgtctttgttcccattggtttcaaagaacttctttacttctgccttaatttcgttatttacccagaagtcattcaggagcaggttgtgcagcttccttgtagttgtgcggttttgagtgcgtttcttaatcctgagttctaatttgattgcactgtggtctgagagactgtttgttacgatttctgttcttttgcatttgctgaggagtgttttacttccaattatgtggtcaattttagaataagtgctatgtggtgctgagaagaatgtatattctgttgatttggggtggagagttctgtatatgtctactaggtccacttggtccagagctgagttcaagtcctgaatatccttgttaattttctgcctcactgatctgtctaatattgccagttgggcgttaaagtatccccctattattgtgtggaagtctaagtctctttgtaggtctctaagaacttgctttatgaatctgggtcctcctgtattgggtgcatatatatttaggatagttagctcttcttgttgcattgatccctttaccattctgttatgcccttctttgtcttttttgatctttgttagtttaaagtctgttttatcagagactaggattgcaacccccgcattttttttttttttgctttccatttgtttggtaaatattcctctatccctttattttgagtctatgtgtgtctttgcacaagagatgggtcccctgaatacagcacacggatgggtcttggctgtttatccagtttgccagtctgtgtcttttaattggagcatttagcccatttacatttaaggttaatattgttatgtatgaatttgatcctgtcattatgatgttatctggttattttgcccattagttgatgcagtttcttcatagtgtccatggtctttatattttggtatgtttttgcagtggctggaactggtttttcatttccgtatttagtgcttcctttgggagttcttgtaaggcaggcctcatggtgacagaatatctcagcatttgcttgtctgtaaaggattttatttctccttcgcttatgaagcttagttcagctggatatgaaattctgggttgaaaattcttttctttaagaatgttgaatattagcccccattctcttctggcttgtaggttttctgcaaagagatctgcattagtctgatgggcttctctttgtgggtaacctgacctttctctctggctgcccttaacattttttccttcatttcaaccttggtgaatctgacgattatgtgtcttggggttgctcttcttgaggaggagtatctttgtggcattctctgtatttcctgaagttgaatgttggcctgtcttgctaggttcggggagttctcttgcataatatcttgaagtgtgttttccaactttgttccattcttcttgtcacttttgggtacaccaatcaaatgtaggtttggtcttttcacatagtctcttatttcttggaggctttgtttgttcattttcattattttttctctaatcttatcttcacactttattttattaagttgatcttcaatctctgatatgctttcttccgcttgatcgattcagctattgatacatgtgtatgcctcatgaagttttcgtgctgtgttttcagcttcatcaggtcatttatgttcttctctaaattggttagtctagttagcagtttctgtaacctttttttcaaggttcttagcttccttgcattgggttagaacttgctcctttagcttggaggagtttgttattacccactttctgaagcctacttctgtcaattcatcaaactcattctccatccggttttgttcccttgctagcaaggagttctgattctttggaggagaagagacatcctggtttttggaatttacagcatttttgcgctggtttttcctcatcttcgtggatttatctacctttgatctttgatgttggtgaccttcgaatggggtttttgcatggtccttctttttgttgatgttaatgttgttgctttttgtttgttagttttccttctaacaggcccctctgctgcaggtctgctggagtttgctggaggtccaccccagacctgtttgcctgggtatcatcaggggaagctgcagaatagcaaagattgctccctgctccttcctctggaagcttcgtttcagaggggcactcacaagataccagctggagctctcctatattaggtgtctgttgacccctgctgggaggtgtctcccagtcaggaggcacaggggtcagggacccacttgaggaggcaatctgtcccttagcagagttcgagctctgtgctgggagatccgctgctctcttcagagccagcaggcaggaacatttaagtctgctgaagctttgctcacagctgccctttcccccaggtgctctgtcccaggcagatgggagttttctctataagccccttgctggggctgccacccttctttcagagatcagacagtctggctacagttgcttttctgagctgtggtgggttctgcccagtttgaacttcctggaggctttgtttacactgtgaggggaaaactgcctactcaagcctcagtaatggtggatgcccctctcaccaccaagctccagcattccaggtcgacttcagactgctgtcctggcagcgagaatttccagccgttggatcttagcttgccgggctccatggggatgggatctgctgagctagaccacttggctccctggcttcagtcccctttccaggggagtgaatggttctgtcttgctggtgttccaggcaccactggggtgtgaaaaaaaacaaacaaacaactcctgcagctagcttggtgtctccccaatcggctgcccagtttagtgcttgaaacccagggccctggtgatgtaggcacctgagggaatctccgggtctgtaggttgtgaaggccttgagaaaagtgtagtatcttggctggatagcaccgtacctcacggcacagtccctcatggcttcccttggctaggggagggagttccccaacctcttgcgcttccctggtgaagcgacaccctccgtgggctgcacccactgtctaaccagttccagtgagatgaaccaagtacctctgttggaaatgcagaaatcacctgcattctgttttggtcttgctgggagctgcagactggagctgttcctgtttggccatcttgccagccacctcctctgctagctcttttatagtttcatctttttacctttaatgcattaatctttccagtatttattttggtgtatttcgtgaggtaaggctctaaccttctttccaaaaggataaccaattatcttagtgctattggttgagtaattaaccttgtccccatggatttgacatgctaagttcatatattcttattttcctgttgcctttcgttgttttctgctccactgatctggccccatgaaatgtaccagtttttagaatgtttagccatgttttatagtatattttaactgcagttaatgggttccctctctttatgcttcatttttggtatatatcttatatgaactttagaatttttattgttaaattcttaaattctattggaaattttgatttgaattgccttgaattcatacatttgtgtagtgcagaattgatatctttgttatattaattctattcggtaacatatatgtctcatttttgtcctaaattctttcacattcctacataatgttttgatttttttctttataaacattattcatatatgcacaggagtttattcctacatatctatttttattgctatgtaaaaatatacttttcggtttttttacagagtgcttattgttggtacataggtgatattgattttatatattcaatttttaaacatccatgttcatatactcataaattcaatttgtttttcagctgattctcatagcttttttaggtaaagactcaaagcaatgaaaaatttgtttcttttggaacaatatgctcttaagtttccatttaatcttatttcagaattgaaatgataaagatgatatatacaagtcacaaattcacagcacattctcttcattagagtaaatcaaatgaaacatcagtatatattaataaccaccatctttttatcactgtcttttcagatttaaggaacatgcagatttcaccacattttaatgtatttgcacttaaagattatgtaaaattattttcaatgcaaagcttaaataaataatattttcatttctgaatactgtttttattccataacttaaatataactattttcaatgtaatcttttttactgtaaaaaagtatgtgtactatttagatgtaattacttgtagttcattattttttatagttcttaaatgctattctagtcaatcagtacatgcccactgaagaaatgaaagattcttattaataattgctgagagcatagctattgggtatcctttattttctccccccttgctagagaataatattggaaagtagtatttcagttctgtcataaatatgccagtaattgacatggccaagtgagtgtttaaacctggactcatttgtgaatttgtaattggtatgctttccaaggtgtgatttaatgtagaaatataaacttgagctccttaaaatgattggtttaaatgttgatttaaaaaatggtcaataatagtagcagtagggtagatacatgcatattgctttttgattgaaagagctttgtagttttaattgtggaactcatgctctctctataattctgtgactatatactttgcctggtgaaacttacgaatgtgccgatcactttatcatcataccatccagagtattatctttgcacttatgacagttgtaagaccaaagcttagacttgctgctctcttgtgagttacttacatgaaatgtttttttgtaatgtttattcagtatattatatgtgaaatcacccagctgtaagatgttatccttgcaagtacctatagtacacatcgatagtttcctctggtaatctaggagataaattcattgtgaatttttttaagttgtgagttctaggatccttctgctttgccagcttgtagttactgaaaatgaaattgagcctttacatttagagtgatgatgaaggtaattggcattcatatgtaataaatggatttatatttaaataaatgaaataattgctttcccacagctgagtgtgttacactcactggtatttgttgaattacacattttgttttccatttggaacttaagaattctcactatgttaataagtttgggaattttgtaaactttgacattgtaaattatatagggagtcatggactactttgtatatgtggcagaaaagtttttaataatttaaggttgtatatacttttataatattctgaagcatcaagtaggtcttggtgtttttattttctagaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatggtatgtctcaggaaaaagtaaatgatgaaatcttctcctctcttctagttattttttaaatgaatacaactttgattaaatttcaaatcctgtttactgtgtgtcacagtgatgttttgcttgtgaattaatttcattagactaggttttattttttctttggaaaggtaataactagaaagaatttacagtgtttctaaatattcatgatctgcatggaatgaggtactttcatattttagtaaatgcaccttatttgtttcattttaatgatttcatattgtatttgattttcgtactatcagaagctatttttatataaaatcttcatagtgtttgaataatggcatactggttaagagcacaggctctagcatctgacggcctatgtaaaaattttcattactagcttggtaacactggtaaagttacttaaacattctctaaacctcagttgtttaatttgtaaaatggacattattatatctatctcatacagttttgcaatgattgattatgagccttaaacatgtagtgctcttaaataactatatgcaaaacaaccaattttagattttgctatgattataattattaaatattgtatatgtgttagtctttggttatgccactgctctgtaaatttgcatctcatggaaatagttaccatttaatttttatatggttttatgttcctatgatactaattgtgaatatatggccaccccaccctcccctgctgaggaaggcattgtcatttataattttttttaattctgaaatacctgagataggacttttatcaaatttatagaattactaggtaatggatagagacataaaaaatacattatcatgtgtttgaatatttatttaaattcctcaggatgtgtagggcagtgaagagcatgggctttgctcttgatctctaacagatttatatccacagtccatgacttattatctgtttaactttagctaagttacttaatgttactaagcttaaatttccatatatacagaatgagaacaaaagtatatacctaacagagttgttaaatattgaatataatagtgaatatgagattcttggcacatagaatatgctcattaaatattttatatattaatttttaattactagctttatttcacattcttatggcccttatttctgtattcttcagtctacacctttcaaactctccattcaagcagtatctttctagtgctgttagaacatttgatttacctgcttaataggggtaaacaagtctggcactcatcagttcttcctacttagaatccagatcactgttgatattttctcatatcatttattagttcacattttctttttttaaaaatgtttattttaagttcaggggtacaagggcaagtttgttttatttttatattgtttatttgttcactttttttttttttctgaggctgggtgtcagtctgtcacccatgctggagtgcagtggtatgcaacctcgacctccccaggctcaggtgatccttccacctcagccttgagagtagctgggactacaggcatgcgccaccacacccggctaatttttttattttttgtagagagggggtttcaccatgttgtccaggctggtcttgaattcctgaggtcaagtgatcctcccatcagggcctcccaaagtactggattacaggcgtgagccaccacacccagcctacattttcttttttcaactatgtttcatattatagattaatgatttctttctttgtaaaaacttttactgtctaagcattttccagtttcttttatcccacaaaatataattgctaaaggttaatttcatcataagtctcgttaccctttttggtcacactctaacttcttgccttagattaactgtttttcccagtcataatctgcttaactcttgcttctgttttcaaatctgttctgtcaagcacatttcatgtcctgcttcagtacatcttgctgtggtctgtgccagatgtaatattaagggctggtgatactgaggtaaggatacaaaggcactgtcctttgagcagagcatacagaatctttttcaattcatattttcatcattttaaaaaattattccttaaatgagttttttaaaaatatgggccaggtgtggtggcgcacacctgtaatcccagcactttgggaggctgaggaaggtggatcacaaggtcaagagatcaagacttcctggccaacatggtgaaaccccgtctctactaaaaatacaaaaattagctgggtatggtggtgcaagcctgcagtcccagctactcgggagactgaggcaggagaatcacttgaacctgggaggtggaggttgcagtgagctgagattgtgccactctactccaggctggtgacagagcaagactccatctcaaaagaaaaaagaaaaaaagattgaagagggcaaatcagatcagttgtaatataagaataaggaataagagatgaacttgcattgaaattgaaaaagaaactttcaccttttattctacttcaactttttattgtgctgaggtctaaatcaaataaatttaaaaagtgttaagcaccatagatgtgcatttttaggaataagatgagttattcactgaagaagagctctgcaggaaggtgaaagctctcctttaaattcatggtacagtttgctctttgaaggtcttttaaatctcttttaagattatcatcttaaatatttcatatggttatgtaagcattttattaattcctttgtagaaccatcagaaccagctagaaatatttgatgggaacgtggctcacataagtacctggctttatcaagctgaagctctattggatgaaattgaaaagaaaccaacaagtaaacaggaagaaattgtgaaggtagcaaacacagacatcagtaacgcttttgggagtggcatgttttgttgtcatgttttctcttctggaatgctctaagttacttagctctcattcctcccaagcattagattcattaacatttattttgatgggagaaactgagacaataagagacaaaataagagacgaacttgaaattgaaagacttgtaagagatttcagcacaatcaaccggagtaagacctattcacataagatgccaatgagtcttgctgattgctgacttttgtattctccattgagtgctgcttacttctgtattctccagtgagtcttacttacttttgtattctccaatgagtctgtcttacttctgtactctccaatgagtcttacatacttttgtattctccagcgagtcttacttctgtattttccaatgagaattacttacctctgtgttctccaatgagtcctatgtgaacagctctcacctggttgattatgctgaaatctcttactggggatcccagatatttatttaaactacctttccttctgtataagcatcacactcatgtttgggtttgatttttcccatgagataattttgtgttttcttataattagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaagtgagtaattatgcttttagagtaaaccatttttcctatgggtatgtatctaaatgatagtcatacagtacatacatcaacaattttgttttattattttaattttattgttttctctctctgtcaccgaggctggagtgcagtggcatgagctcactgcaacctccgccttctgggtgcaagctattctcctgcctcagccacccaagtagctgggatttccggcaactgccaccacacccagctaatttttgtgttttttttaggagagatagggtttcaccatcttggccaggctggtcttgagctgctgacctcaagtgatctgcccgccttggcctcccaaagtgctggaattacaggtgtgagctgctgcacccggccaacaatttttaaattaaaatgtttttaatcactttttctttgaatggagcatttgtccgtatttatttgtgattgtgcatatgaaggagagaaaacaagcaattagtattgaagaaaataacctatttgagaaaaggtttcaaagactcagtcaaaggttagaattggttatgaaatgatgaaactaattcccaagctagggatgaatattaaaccctttattttatggtcacactctatatatgtcttcacattgcacacaccacagaacttgtttttttttttgttttatatgacgacaaatctaaaagttacagataatttcacagtttaatcctaatgtaggaaagtactacctgattttataaatttaataaagagctttagacatttaattaacagggtaataaataggacctttatgagagtgctagttttcccacacttagccaaccccagatggtatttatctgcatttagttttattaaaattgttttattgagttttatttaaacaaatataaaatttttctacgtagatgttatctgaaaagatgacattgagaaatatgcacttctttgacgtttgtgtatgaaaatccaaggggaattctactgaggaaacttaactgggagacattctgtgaggtgtccctgccctgggggctgggtggctgttcttcctttctgtggccatggtaaggatagtttctggatcatggccatagtttcctgctatgctcgcatgtggtctccaaatccacgccacaacactctgggcagccacaatgaattgcaatactacgtcacatccctggctagagtttggagaaaacgggtcattcagagaagtctgaattggtaaaatcattgccatataaatgaatgaaacaaaagttagctgagctgaatagaaaagtcagttaaaaaagtgttagtttctctcttgacaccccatctctctgattaatgatggaaagtcaaattaaaaatctattttcagagaattcttttccttctacagttgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaaggttggttcaaggagatttcaaaaccatggtggtctcatttttcttctctattaatttcatttttacatcaagatgtttgcccatataatctgtcaaacatgatgaaacagattcaaatgtgattttttgatgtgtgtcaatgtaagagtcacatgattcatgtgcttaaaaagaaaatagactcagtttctgaactagacataatccttagtattatctaatgtttgctaaactctctttgagacattttatcttcaaatataaaatatatttaaaaaaaacataaattttttgatcgttcaggttaacatatcttgacgtatactatactaagtaggttagttttcctccttaggagttgataggaagtgaccttatgcatttttcttttgagtcattttttttttccttttaaaaatttagatggatgaggagagtgcccagattgaggaagttctacaaagaggagaagaaatgttacatcaacctatggaagataataaaaaagaaaagatccgtttgcaattattacttttgcatactagatacaacaaaattaaggtattatgattggagagtctctgttgcatttaaataccttacttaactcttgccattcagatgtgtgatgctgcatcacagatgctttaaaacacaccagttggaatatcatctcctcctttctagtgtgtgttactagatgtgttcatatttttggatggtgcagaactcaaaatggaaatgtaaaaccttattattggccatctcttttggatttctgattatgttatcaaacctaaaagagatctatctatttcagaagtggcttcctccaattccatattttatttgtgaaggtcttgtctatgtcaaaaaaaatttctagtttaaaaataactcagtttgtgaaagtgatgtaatatgatttatattctagtaaagattcactaccagctccctttttatttctttatatttttcttttttttttttaaagatggggtatctctatgttgcccaggctgatcttgaactcctaggctcaagtgatcctcctatgtcagtctcccaagttgctaggactacaggtgtgtgggccaccatatccagctccagctcttttttaaacggcaatctttctagctgcattttaagtgtgctgttgttccctggggtccgttctttggtagttccttctagaacgatttttatttgatgactttggaaattaagtagatcgattatggtactgtatttttactgtaccttttctatgtttagatatgtttagatacataaatacttccaactgtgtttcagaattgcctatagtattcagtacaataacgtgctgtaaagttttagcctaggagcaattgactataccacacagcctaagtgtgcaggaggctgtaccatctaggtttgtgtaagggcactctatgatgtttgtatgacaatgaaataacctagagacacatttctcagaacatgtccctgttattaagcaatgcatgactatactttaaaaactagccattctctcaaggctgaagcctcaacatccttcttaactatttcttgttcctcacatatcttctcacatcacactgagtaggcattaaaactgttgagactgcttgaagcaacatacaggtttgaacgtgaagttagatattgctctaccagctgcttgttttatgaccatcagaaagtgccttagcttattttacttcactatcctttccataatttagactaatgattttctcccatgatattatatcccatggacatattcttatgtctgttttttctcactctagcatgtcctttgtctcttcctcacagttattctccccaaagtcatggctgatcatgtcattccttcatcgaagaaactgtttaggaaaatattgcaaaatacagaaaaagctttaaatgcaaggtctgtcaatataacgacatacaaagtcttcagtctgacccctggctccttatgtctttgatgtgctgtcacttcccatgtagtacagctatgctggtttttctttacattttcctaaacacatcatgtgccttagcacatctgggaacttattaattttattccgattccctagagtgagttttgtctttttaggttagctgaaaaatgcgttatcttttaaaactcagctccatttttatttctaacttctgtcagattatattatagttctctgctttattgtgactttttaaagtatctttcttccctaatgcttctccaagttcaggcaatatctttttcatctttgggtccgaaatcagaaattattactggcacaaaatagaaataagttttaagcttttaatacataaataaatttgtttgttaaaagtactaatatatactatacaagctaatttcattctggctttactaacattggtaggcgaactatgttacaaacttcaaatctatagttttcaaacttatatgattcttaagtgtgaacatgagaattactgtgggggagctttaaaaaaactacagtgcccaaatctaattcctgaaacaggtaaatcagaatctctcaggacctaggtgtgggcatttacaaaaacaaaacacaaaacatttgtagatgattttaatgtacaattaggattgagaagcactagtttacaggactcattgtcttacctgaaatatatgttaagtgaccttttccaatttgtttactagagtattactgtttttaaattatgtatgagcactttataaagatattaaccacttgccataattgctataaaatattatcttattgatatttatcttctaattattttatctttaagatataaccatttaaaatttttgtttagccacaggtgactatgttttcccttagtgatttttcaggggtttctgttttgggatctaaaaagttttcatcctccagaaagttgatgaatattcaattctgtttagttccaggtttttcctatggtttggtaaaaacaaaacttagaaatttaataaaacactcacttaaaaatctctttaatctttgctatatgatgtgagctacgtcatgtaacactgtctcatttaagtactgacctctagtatatttgtgtttctgtgtccttggagaattctttaaaaataaaattgtccagaagtaaagtctcggtcagatctcgaggacatttttttagtcctagggcattttgattgatcactctcttgggggaaaaaaatctattttgggaatacagaaagcacatgtttaagtcttgaacggccttgctgcttctgcaagagtgggaaggctcagaaaaatcctggattgtcctatagtctgaaaagaaaaagaggcagtcttaatgaatgggaattttttaaacttggatctttatgatacctactaacctccctagtttattctaaagcttcaggtacacgtggtcttgcagaatgacaatccgttatgtaactgaagaagcagcacaggaattccagtcttgcagtagtagctgaggtataaaagtggctcccaacatttacctaatggagcagattaaaaaacaaatgtggcatgtattatctagtggtgctaaatgaggaaagtactacaaaggtaaatgtccctacaagcataataaagtagttggatgtctggagttttttggtcttttggaaaacagatgacctttcagcaaaatcttggttaatggatgggaagccaagaaggaaaacgggtcccactttcctcttttactttttcgacatgattactcaacctagaaatactttcattgggctattttcttttccttaaagttaagagggagaacaattgagcctagttttctgatcttccaaaataaaaacactggcttatttgaaatgaaaatccaaaagaattatttttgattttttcttttcttaaaaaatacttagcatctttttattcataactggtttctgggtagatatgttatttatttcagcattcttttatatttgcttaaaacacagaatttgtttccttagacatatgggtaaatatctagaaatgctttctgactaaaatttaaacttgcggcattaggataataaaattaatcttggagacaagtgtaattagttctgttgttaaagtcaagaaatgtatagacctgcttctaacctggctatccagaactaccctcaaatgatggacgcagtagtttaacaaattctaggaggcaataatgcagtcctctaggttcaacaccatgttatccactcaatgattttagtcatgagtcttggattcctttagagattggattgtaaccattttcaagatcactaactgaattaacatgcatttgtgatcgttttacctatcatcttgaatttacagatgattatcattttttagaagttcaacataggagaagtgaaagtgtcaaggaaggtaccttaattcatgagcagctgcagtttggccctttgcaagtggtaatacgtagcacttattaaattgtggccatctaggagtaaagggtttgaactcctgaaggactggcggtccatcccagagagcactttattgtttagaaagctctgagaagagggccgggcatggtggctcatgcctgtaatcccagcactttgggaggctgaggtcagctgatcacttgaggttaagagttcgaggccagcctggccaacatggtgaaaccccatctctactaaatatataaaagttagctgggcatgatggtgcatgcttgtaatcccagctactcaggaggctgaggcagaagaatcgcttgaacctgggaggcagacggtgcagtgagccgagatcacagcactgcactccagcctgggaggcagagcaacactctgtcctgcacccccccaaaaaaataaaaatgaaaaagaaagctctgagaagaggatccagaaaatctatattagggcagatgagtagtccatagagcctcaagtctgtctaaatatgacacttcatgatctattttctaatgtaggatattcctgctctataatattattctcagagattaagattacatactgaattacctggatattactttaatcaaaaccctttgtgcatttcatgttgtgttatggaaacatgtttaacttgcttatatttttagcaatgaggtccaattttaaaattgtgatatttttaaaagagtgaaataatgtatcaaaatgttttatttcatacaaaactttgtgattggcaggatattctcattctttcaacaactcaagaaaggaattgttgttttttgtttgctaactgagtttagatggcatagatcttaaagcctgtcaaattaataacatacttatactgtttaatatcatgctgcagatgaaaattaggatacagattgttaaggttttctgttgcaaggtaggtttataatataaaatattaaaactaagttttaaaaatttggttcatgatattgcattccttcacacaatagtcttgttattattcattgtgggggtattttaagagatatatatatatatatatatttttttttttgctgtttttgtaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaaggtagacctctgggcactgtgtttgaatggccacagttaatgtagaagtagaggaagaaatttgttcttgtgcctacttagatggtctatatcttttacaatttgtgccaggggattaataatatgtatgactagtaaagctttcctatattgtcaaagaaaatatattaaattttgaatttttaaaaagtgggtatggattgttaaatgtgcacagttataaattatttgcaacatcagagccttgtttaaaattaaacagagacatagaccaccttcctgtcttataaactagattgtcagttgatgttaattgtcagcatttatcaggcaatctataatggtttaaaattggccagttgaggtatggaatggcatcttgattgtaagttaattaaacttaaattctagcaaggcattttcatgtaacttgattgcatttatatgtaaaatcacaataaattcactgataatatggatttgatagtgcattcctctcatttaaactaacattattagatatttgaaaatatcactatttccagcttcaaatgcctcattacctatagagaatgttactgaagcctttcatgtgttctgtacaaatgctactattgtgaggactttttttcctgccttgagtatattatgtagcatattccacacactttggttaaaacagagtatcatttaaaaaaaaaaagttttcagttttcatgattaacaatgattatgtctcattattatttcaaatgagtgttctacaatataaatatctggtcatctgtgattcctttttttgttactttgctggattttgttaatctatgacaatatatttttagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaagggtatgtgtaaatgaaattaatatttaatttaaaaaaatgcctgcaagttcatgggcgtgaagaagatcatgtggacactgagattaatgagaacatgtttcatatccttgtaggatgccctattatttttttttcttttaagaaggagtcttgctctgtcacccaggctggggtgcagtggcatgatctcagctcactgcaacatttgcctcccaggttcaagcaattctcctgcctcagcttcccaagtagctgggattacaggcgcacaccaccacgcctggctaatttttgtatttttagtagagatggggtttcaccatgttggccaggctggtattgaactccggacctcaggcagtccgccttgccttggcctcccaaaatgctgggattacaggtgtgagccactgcacccggccttatgccctgtttaataaattgtgatgagtatagttccttaaaggaggaatgtgatcatgtatagatgaccatttataacataatatcttaatgatatggaagcacttctaatttttagtgtctaaatagtgtccattctctttaaaaaaactaaagaaatttttcattaatgttcactttctcagcacacttgatgattaatgtgagtgaagaacagaggcagctacagataattagaatccatatatagtaccaaactcttttttatagccttctgtttaaatgaatgcttttgagccttcttactagattttgaccaggactattaataggtagaaatgaaaacaggcaagatttttgccagtagctgtggatgtgatggaaaggcaaataagttatgaaataacccagtggaaagcgctgtataagaggaaagggagcacagaataatacattgggtaacttgagagacatacgcacaaaaactaggcatcatgttccttctctttttttctattttagcctacatatttcaatgtgactaatccttgaaaagatagcttttagtggcctttggtatattcctttgtttggattttacaaattttctctttgtacctttggagaacattcttttacatacatctttatccatacttatatttcattaggcttgatcattagatgaagacaaatttctttaaaaataatgacattttaaacccctgtattatatcatgaaattggttactatacccctgccaacagtatttgtaaaaatatccttctttttgagcccttactaacattgacaggttttttttttattatttaaaaaaactttgccagtttaatagtgatagattacatctcaattttattttcatttttaaatttttagtgctactaatttttgtacgtcaattttgtatcctgaaactttgctgaatttatttaccagttctaggagctttttggatgagtctttagggttttctaggtatatgatcatgttaccagcaaacagtaacagtttgagttccttttaaccaattcggatgccctttatttctttctcttgtctgattgctctgtctaggacttccggtactatgttgaatgcaagtggtgaaagtgggcatccttttcttgttccagttctcagggggaatgctttcaatttttcctcattcagtataatgttggctatgggctaaaagtcatagatggcttttattacctgaaggtatgttccttctatgccaattttgctgagaattttaatcataaagggatgctagattttgtcagaggctttttctgagtctgttgaggtgatcatgtgatttttgttttaattctgtttatgtggtgtatcacatttattgacttgtgtatgttaaaccatccctgcatccctagtatgaaacccacttgatcatggtttattgtctttttgatatactattggattcagttagctagtattttgttgaggatttttgcatctatatcagggatttggtctgtagttttcttttttgttatgtcctttcctggttttggtattagggtaatactggcttcatggaatgatttagggaggattccctctttctctatcttttggatagtgtcagtaggattggtaccaattcttctttgaatgtctgatagaattcagctctgaacccatcgggtcctgggcttttttttgctggtaattttttaatcatgattttaatcttgctgcttgttattggtctgtttagagtttctatttcttcctggtttaatttaggagggttgtatatttccaggaatttatccatatcctctaggttttctagtttatgcatgtaaaaatgttcataatagccttgatcttttgtatttctatggcatcagttgtaatatcacccattttgtttctgattgaactgatttggatcctctctcttttcttggttaatctcaccaatagtctgtaaattttatttatttttttagagaaccagctttttgtttcatttttttttgtatttttgtttatttgtttcattttcatttagctctgctctgatcttggttatttttttttcttctgctgggcttgggtttggtttgttcttgtttatctagttccttgaggtgtgactttagattgtctatttgtgctcttttagactctttgatgtaggcatttaatgctatgcacattcctcttagtaccgcttttgccatatcccaaaagttttgataggttgcgtcactattatcgttcagttcaaagaatttttaaatttccatcttgatttcattgatgacccaatgatcattcaggagcaggttatttcgtttccatatatttgcatggttttgagggttcccttcagacttgatttccaatttcattccactgtggtctgagagagtacttgatgtaattttagttttcttaaatttgttgagacttgttttgtggcttatcacatggtctatcttggagaatattccatgtgttcatgaatagaatatatattctgcagttgttgcatagaatgttccgtaagtatctgttaagtccatttgttctagggtatagtttaattccattgtttctttgtcgactttctgtctgggtgacttgtctagtgctatcagtggagtattgaagtccaccactgttaatgtgttgctgtttatttcatttcttaggtctagtagtaattgttttacaaacttgggagctccaatgttaggtgcatatatatttaggatataatttcctgttggactagtctttttatcattatataatgtccttctttgtcttttttaactgctgttgctttaaaatttattttgtctgatataagaatagctactcctgcttgcttttggtgtccatttggatggactgttattttgcacccctttgccttaagtttatgtgagtttttatgtgtcgggtgagtctcttgaagacagcagttacttggttggtgaatttttatccattcttctattccgtatcttttaaatgaagcatttaggccatttacattgaatgttattattgagatatgaggtactattctatttatcatgatatttgttgcctcaataccttggtttttttttttttttcattttgttattgttaataggttctttgagatctatgctttattgttgttgttgttgacaggtcttcttctgtcacccaggctggagtgcagtggcatgatctcggcttactgcaacctctgcctctcaggttcaagcagttctctgcctcagcctcccatgtagctggggctacaggtgcccaccaccatgcctggctaattttttttgtattttttagtacaggtggggtttcactgtgttagccaggctgacctcaaactcctgacctcaggtgatccacctgcctcagcctccgaaagtgctgggattacagacgtgagccaccacacctggccaagatttatgcttcaagaagattctattttgttgtatttctaggatttgtttcaagacttagagctccttttagcaattcttgtagtgctggcttaatagcagcaaattctctcagtatttgtttgaaaaagactatctttccttcatttatgaagcttagtttcactggatacaaaattcctggcttgtaattgttttgtttaaggaggctgaagataggaccccaatctcttctagcttataaggtttctgctgagaaatcttctgttaatgtgatagattcttctttataggttacctgatgcttttgcctcacaactgtcaatattctttccttcttattgactttacgtaacctgatgaccatgtgcctaggcaatgatctttttgcgatgagttttccaggtgttctttgagatttttgtatttggatatctagatctctagcaaagccgggaggttttcctcaattattcctgcaaatatgttttagatacttttggatttctcttttacttgggaacacaaattattctttggtcttttaacatattcccaaacttcatggaggctttgttcattttttaaaattcttttttctttttctttgtcagattgggttaattcaaaagccttgtctttgagctctgaggtttcttctacttgttcgaatttattgctgagactttccagtgcattttgcatctctctgagtgtgtccttgatttccaaaagttgttttatttatgctgtttatttcactcgagattttttccttcatatgctgtgtcattgttttgatttctttaagttggacttcacctttcactggtgtgtccttgattggtttaataatcgaccttctgaattctttttctggcaattcagagattttgtcctggtttggatccattgctggtaagctagtgtgatttttttttttttttttttttgagatggagtcttactctgttgcccaggctggagttgcaatggcacaatctcagcccactgcaacctccgcctcccaggtttgagtgattctcctgcctcagcctcctgagtagctgggattccagacacgcatcaccacaccagcttatttttgtatttttagtggagacagggtttccccatgttggccaggctggtcttgaactgctgacctcaggttatctgcctgccttggcctcccaagttgctgggattacaggcatgagccactgcccccagcctagtgtgatctttttgggtattttaaagaaccttgttttgtcatattaccataattgtttttctggtttcttctcatttgggtagagcatgtcagagggaagatctgggaatcagtggctgctgtcctgattcttttgtcccatgaaatgcttccttgatgtagtgctctcctccttcccctagggatggggcttcctgagagctgaactgcagtgattattatttatcttctgaagctagccatccagcacagctactgggtgctgagcgggtactgggaagtgtctgcaaagagtcctgtgatgtgatgtgatctgtcttcaggtctctcagctgtggataccagcacctgctctggtggaagtaacaggggagtgaagcggcctctgtgagagtccttggttgtattttggttaagttcgctggttttctgttggttggcccccagccaggagatggtgcttacaagagagcatcagctgcagtagcatagagaggattaggcggcaggcagggccatagagctcctaagaaattatcttctttgtctttggctactggggcgagtagagaaagaccatcaggttgggcagggttaggtgctgagtcagactctccttgtgcatggcttgttgtggctgctatgggggatgggggtgtggttcccaggccagtggagttatgttcccagggggattatggctgcctctgctgcatcacacaggttgccagggaagtgagggaaagcgtgcagttgcaggcctcactcagtttccatgcagcccacggcccaaaaggccagtcttagtcctatcaggaaccccttccgccacccccacacccccactggcccaacagcattgggtttatttccaggcagctggtgagcagggttgagaacttgccccaggtgacaagtctcccagctgagaacgcaagctgatctccagttcctcggctctcccatgcagcatgcagcagcattccacctccttcaaagggtctgtagattctctcagttttcctggtatgttcctgcggtagttcttggaacaaaagtccactatgtgtctgcacatgctgctgtttgtctgagtgggagctgcaagttagaccttcctcctatccaccatttttttttctctctgtcactgatgatacattctaagtttaatgtttgtattttcaaagtctttagatctttggaacagtcttatagcatctcgaatttggaaattgtgattgttgtgtagttattgtgaatttttgcaaatgataatgagtgtcaatatcacctcatagtgccttttttttaagtgcttttctttttccatgctcaatagaaaattgctttactgtgggcagtattagcaaaatgttaaaagtaattttcatggagaaagacgatatacacattatttaggggttattgatattaggagccattttatttaaaaaatatatattttattaatattgttaagatctcagagatcacttctaaaactcagctccattactcttaaacaaaaagataggagaaaaaattatttaggatcctggtccaataaagcttttcctttttatgcttatttcatgtatcctgaatataacaagcactgggttttactttgccatctttaaaagagtttggtttaaacagaaatctcaatagccctctgtcttattgcataacgggctctgcatgcaatttcatactttgctgtatttaggtaaatgggaccctcaggaccagtcattacccgaagtacattaatctgctcaggcagccgttataagataacatagactgggtagcttaaacaacagacatttactttcccacagttctggaggctggaagttcaagatcaaggtgccagtagatttggtgtctagtgaggtctctcttactggcttgcagatggccaccttcttgctgtgtcctcacatgagagagctctgtggtgactcttccacctattataaggacaccagtcctttcagactagagccccacacttatgacctcatttaaccttatttgtgtcctggaaagctctatctctaagtacagtcacactgtggggttagggcttcaacataagaattttgattggacataattcagtatataacatatagatagaggggtatacgggcattttgaagtgttttggccttttgtgctttattcttgccgggaactaagtgttctggtagtaaaacaacatatttttccccaagaaaataatgaatcatattttatatttcacagtatttaaatgttaaatgtataaagttggatgcgttaacatgcctacaactaatcgatcctgatttttcaagccagaaaaggctgcatctttttagttaaaaagctgctcgagtgtgtgtgtgagtgtgtttgtgagtgtgtatgtgagtgtgcatgtgtgtatacgtgagtgtgcatgtgtgtgtgtatgagagagaggatttggtagctggtggtgtgagcagattgctttgcccttgttatgatgcatatatctctaggaggaattattacctgtatcccactacgaaaattggttttgtggagcaataggctgtgaattcagttgtttgaggtctttctgtttaaatgaaatttgattttcttttttagaaaaatggctttaggcagtcctggaaaatttggaaacctattttattttgtgtattgtcctctagttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggtgagtgctttctgttagaggagggggactgcacatatggttagtgtatgcctgttaagacagatttcagaagtagggacaaaatatattaatttttcagaagtcaatggacaatttgtaatttttgttccaattcttgttaccagttataaaagtttaagaaattggtcaatcacaattttcaatcaggatttcaaagaaatttaaataaaaatactccttggtggctaatgtgaaaaacaattttatttaaacaattttatatttagaataaaatttgtaaactgttatgcctaagactataccaagaacagaaaaaatatttgcatgcctcacctctgttttttgtacttaaacacttaggcatctcatttttctttgtatcattgataattatcataaagtaaattattctggagcgacagcagggcagctgctcatgtaagtctaattcagtcttgggaaaatataacacaaagttagttctgataacaataggtctttaaaaataatggtagaaagcacacgcaatttcaattctaccattgataaaaatattttctcttttattaagttttttaaatgtattttatttagaaggacatgacaatttaaagataattcatttgtttttcttataaatgtgttaatgtggccgggcgcggtgcctcacacttgtaatcccagcattttgggaggctgaggtgggcggattatgaggtcaggagatcgagaccatcctggctaacatggtgaaaacccatctctactaaaaatacaaaaaattagccgggcatggtggaacgcacctgcagtcccagctactcaggaggctgaggcaggagaattgcttgaacctgggaggcagaggttgcagtgagccaagatcgtgccactgcactccagcctgggtgacagagcaatactgtgtcaataaataaataaataaataaataaatgtgttaatgcatttttcttatttttggagttacagataagtgtttaaatttgacttgaaaatattcattcaatctgttacttaaacatttgtagaccagtgtattagtctgttctcatgctgctaataaagacatacctgagactgggtaatttataaaggaaagaggtttaattgactcatagttcagcatggctgaggaggccacaggaaacgtccagtcatggtggaaggggaaagaaacatgtccttcttcatatggcggcaggagagagaagtgctgagcaaagtgggggaaaagtcccttataaaaccatcagatcactctcactagaacaacacgagggtaaccacccctgtgattcagttacctcccactgggtccctcccttggcatgtggggattatgggaggtacaattcaagatgagatttgggtggggacacaaccaaaccatatcaaccagtgaagcaatatcttagtaaaatgtgcatttaggtttacttgtatgtggtaggacacaaggatataaggatttattggggtatataattttttaaagcaatgccttcaagcacttgcttgaaagaagatgagcaattcattttcatcaaacatgattgatgcttatgctttaatgtaaacagctgttattcattttagttattaagctgccctatttccttgtattttgcctgatgacattcatgaaggtgggttagatttcaaaataaatttcatttagcatgttcattgaaatgtaattaaattgttttaaaatgccttttttttctaacataaaatatctttccaggagtttgtttctttcacacttaaattgataccacaatacttgggtggattcattgcatcagaatcatttacttattagtgaaactaatcttgagttgtgctctgttacaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggtgatttagctatgattgtttgcaggcacaggagtgaacatattttggatagaatcttttaagatgcaatctaatgagttcttttattgtttgacattataataggaattttactgacatttaagacctccactgcccacgttctcccttcctgtatttttaggctgtccataaagtctcacttttctactcaaatgctacatatgtaaaaaccaaacacctttattccttttatttacaactgcttattatgatatggtgattatgatgggaatttaaagtagttgaaataactgaaactccaggtttcaggtttgaaggtctgggttcaagatcagaccttccctttgcttatttcctgattgagcctaccttagtaatacgtctcactaagttattttggtgtcaaatgttgtgttctattcatgctttgccaataataaagttcttcatctatgtaatataatataatataatatagtattattaatttttatgtcagattatgttacagtgactcagattttatttgggcatcttccagttgcaaatttgttttgcaattggaatataatgcccaacactatagacactttccatatttaaaattatttgacattattttctgagacagtcaagatttatgaatgatttctactttgtttcatatattccgtcattaatgatcttttttgtttgtttgtttcttgttggtagtttagggttaaaaactccacgatttttttttctgttaattttaactctgttgatgaagtattattttagtgataagctatcattttgtgaaaggccaatctaatactttatcaggtccagtattattatgcaacctaaaatattcaagtatcatgtgacctacagttgcttttcatttaaaaaatctattattttgtgtgttttggtaagagacaaataataattagtacgttttggttgagagattaccacatggcagagagagtatctggcaccttgcacacattgccttgtttaggagtcatgactcacctcttaggggactgttaagccttgtacagctttagaaactgaggctaagagaggcgaggttaagtaacttgtccaagatctcatagaaagtaagtgatcatactgtcttatgctctcaatattatgctgtacgaacttggaaagagcacagaactctctggccaaagtgtcttcctctggaaatgagaactatgatatcaccacagaggactgtcatgaggattaaatgcaatagtgtttggaaaatgtgcatgccttgactattcatagtaaacacttaaagtatctatttcttatgaaagcaagttatcttagaacttattctctaagcatattgctgaattttgccaatgattgattaatgacttgatcgatatttattgagctctatgtttagcactgaagatacaagtatgattaggaactcaaagactaagaagaagaaaatgatgaaagaaaacatcattaaaaagataaagtgtcacagaggcagatatgatgcgctgtggaatttaagtgtcacagaggaagcatgccgaagctgagttttaaagcatttatagcaattttctataaatttcttctagggagggccttctaggcagaagaagtaaaacagcagaggtgggaggcataaatagcatcgtcgtgtgagagatctgcaaaggattgaaaggagaggagggttcaatgaccaggggaaggattggaaaatgaggtcccataagatcttatatgtcatgctattcagtttgcatggagggtcttagcttgaaatgatttatctcctagacctttattggttttttgagacagagtctcgctctgtcacccaggctagagtgcagtggcgtgatctcagctcactgcaacctctgcctccccggctcaagcaattctcgtgcctcagcctcctcagtagctgagatgacaggtgcctgtcaccatgcctggctaattttcatatttttagtagagatggcatttcaccatgttggccaggctggtctggaattcctggcctcaagttgatctgctggccttggcctctcaaagttctggaattacaggcatgagccactgagcctatcctctcttatacctttttaaggaaaaacatgtacctgctgggagggttttaacaataaatgcagaaattcttctaaaggtagatatctgtggagtgtggtaattacagctcctaaaactaataaggtgaagctaatacgtgtttttactcattttttggaagtgaaaagaataatgaatctcttccccaacagcttatattttgactaaaacaatatttgtctttgtaaattaacgctaaacttcaccttaggttggtagtctatattaaattgggaccattttgggtagattgtatatatgttgttaacaaagtaattgagaattatcacacagttcaatttgtttttgtattgagtgcctgtagttaagtatttgcatagttcagcaacctgcagagttatttcttcccttttttggagacaaggtcttgttctgatacccaggctggagtgcaatggtgcaatcgtagctcactgcatccttgagcccctgggctcaagcaatcctctcaccctagtcttctgagtagttggggctgcaagtgtgtgctaccacacccagctgatttttaaattgtttgtaaaaataaggtcttgccatgttgtccaggctggtctcgaactcctaggctcaagtgatcctcctgcctcagtctctcaaagtgctgggattacagccgtgagccaccatgcccagtgggttattccttagtgagcaattgtttcttctgttagaacatgaatttataatttgtttttactcttggggataatatttaaaatgtagattatatttagctaatttgcagatgaaaatattgggtgactcaaatatatcttattgaaatcactttataatgctagttttcttcatagttctgttttgaaagtactaaattagtcatgatcttgaaacattggacgtgaaatttcaactcttttttagaaacaaaggcctataatagtattttgggtgtttccaaagttgtcatttaagttaaatacttttcactatggagggtagattacttgttttagtcttagtaattagtgctgttgctgtatttatttatttttaatcttaaaggagcattctttcttgatggatacttaaaaattatgattttgtagtgattttcatttttttaaacattatacatcaaatattgactgtttattaaatatagaagtattatctaatattttattacatgtattgcacgattatgtgagaacttttgtgattaaaaatgaaaactcctagctgcaaaaacataaattcttattaggaatgatacaatacaatttatttaaaaattgcattcagtttttaaaccagcagttaattatagcagctataaaaataaagataccaccaggcttttaatagctttcaaatccttttaaaaaacacataatcttatttgtcatatgagttctaatcatattcctctcttctgacagatggtttatattcttataaatgttattcttataacactataaagatctaattgaggcagttccttttttatattcatttgactgttttccttgcatcatttaaaatttttgctttgtttttttctatatctctttttgtaacagtgctctattcaaatataatagttattttaataaacaagccaaattcacatgtttcttgtcttccctaatacttgtaagattctcccattcttgataccttgctttgttcttattctttctgttctatgaataaagcagagtaatagttaccacctaatgtgataacatgtcatataatgattcctttcaatattcgtgaaacactcaaagagaattatgctttttccctattattttagataaagacatttttcatgttttaaaaaatttccattatgttgcggagtggtatctaactgtaaaaaaggcttttgtattcaatttctacataactttttatgatgagggaagataatattctttagtttcaatgtttttgaatttaactaaggaaaaaagcttcttggtctattattaagcaatctttatattgtagaatatatacattgtttcacttaaaatatatattaaaataattattagaaattatttattttgggaaatatttagtcaggatattcaaagcaaatatgtaaggttctgcttaattggacagtttttcctcaatatttttaaataatatattcttttaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagtaagttgtttatttctgtctatatgccttttggtgcccgaacattatacttcagagtcacatactgcgtgtctcaagaagaaaagggaaaagaaactttgtactttttggtaaatgtggtgaacctgaaagaggaatatcttttattttttaaagagcagttataattttggtcttgcagagcttaaacttcacttatgtaaaaagaacaaactattatggtgtcagtattagaccaaaggtttttaggatattgtaaactgaccttatcattttaaaatacaatagggctatgaaatatcgttttttgtttttagatttggaagaaaattactgattattgtctataaagctgcaaaactcaactttatagataatcagtaattatcagagtgacttgctgaggaacaaaatgcagcttgcaataggtttagtgtcatggttgtattaatcagattttctttgttggtttgcaactaacaagtattgtttatagttgtatatgtatataatctataaaaattcatacatatatagatgtataaatatatccaaatatccataaattttgtattcataaatatttattttttgtgttaagaattaaaatacttgttgcagaacactcagcataatgtgctcacatttttttttaaaaaaagaaattgtgggctgggtgtggtggctcacgcctgtaatcccagcactttgggaggccgaggcgggtggatcacaaggtcatgagatcgagaccatctggctaacatggtgaaaccccatctctataaaaatacaaaaaaaaattagctggccgtggtggcaggcgcatgtagtctcagctactcgggaggctgaagcaggagaatggcatgaacccaggaggcagaggttgcagtgagccgagatcgtgccactgcactccagcctggctgacagagcgagactccgtctcaaaaaaaaaaaaaaaaaagaaattatgagtgtgtattcatacatgtacaagcataagtgtgtgtgaaaggttacttactaattcagagattttgtctataaaggagtatgattgaagcattttgagaaagaaacattgaataatgatgaaaaatattttgtggaacatatattaagttttctttttaaaatgtgacaatatctaacaagcttccttttttacctaaaaatttcagtggtttttttgggaatgtctcttttgtaaacaatttgaggagagttagaaaaggtggaacagtatattaggatggagtagcaaggaggagataagaacagaatgttaaattagcagtgtaaaaataatatatgacccggttaagagacagtgagtaccagagagcccgtttgtgcacaggagtgcaaaaatacacacagaaggcatgtgctcactcccttcctagttatcatttgttagcatgagcttaagcttcttataagtttattttttcacttaacaaattagaaagttacatttgtaataataccaaaaaggtttctaatacagttcttgaattttcccttatctgactaccttctaaccacacctatcttttaacttctccaggacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataaggtgtgtgtaaagttactatcacacatttctcatatttattgattttgttgtcagagatgtgggatcatgtaactgctttactttcaagtatgtccaaatggggcaaattttactaaagcttactaatgtttatattttttatctgtcatagacagaggcatatattctagaagaatactttttattttatacagaactctttggcctaggggatttatacattatatactacattaaataatgaatatatgttggaattagtaagaaaattccagtgatgatattctgaaaatgaagaccttaaaatagcattctgagccgggtgtgttggctcatacctgtaatcccaacactttgagaggccgagatggggggaatcacatgagtccaggagtttgagaccagcctggccaacacagtgaaaccccatctctactaaagatagaaaaatttgccaggcgtagtggcacacgcctgtaatcgcagctacttgggaggccgaggcacgagaattgcctatacctgggaggtggaggttgcagtgagctgcagtcacaccactggaccccagcctgggtgagacagggagaccctgtctcaaaaaaaaaaaaaagaaataaataaagaaaatagcatcctgattttgcacatgacttttcacacatgtatgtttattttcaatgatttttttcattaaatatatatttactaggttccagtgaaatgtaatggcatgtgactacaaatacaactaatatctttccctcctaccattattttttttttgccattgaaacggttaaaagtagataaagtcatagatatcttttttgtttgacctggtacacaccatttcagagtatgacgtctgtataggacattgaatggatatgtctctgtccttggtttggatggactccatatcagtcattttctctctcatcctctttaaatggtagccattatcctatagctaatgatgcaggtgctttattgatctggtctctctgattgggaatcactgcctgttgagtcactgtgattcacacatgtgtatctctggtctggacctttctccatactctaaacttgtgtatgcaactacctgctcaacatctctccttaaatgtctaataggcacctcaaactaacatacacaatcgagcttttgatatccctctcccttctgtgccttaatatacatctcccaccttagtcaatggaagtttcatcttattattacttaagtcagaaatattggagtcaatcctatggtatatgaattctatcacaaaaagaaacaaagaaaacccccaaaccaaaaactatacctcagtcaccattagcagcttttccttcaaaatacgtatctactggatggatggtttattggatagccagatggctatgtgtgataaggcaaatgtagcagaagtttgacagttgtagatgtcagagggcacatagatatttcctctacaattctttcgacttttcttaggtcaaaaaatatcatacatttgactgcttcttacaacccccattgccactaacttgtttcaagcctgccatcatctcttgtcttgatgactacaaaggctgccccactcatctcccctgcttcttcctttgccctttgttattctgttctagacaaagcagccaatatgattggttaaaacataattcagatcaagtgacttatctgagcaaagtccaccaatggttttctatcttgctcagggtgaaagccaaaatgcttttttggcttatgaggcttctcatggcctggcgtcctgtgatctctcctacaatatccactgctctctctcccctacactcctttccagacatgttaggtcctgtgtcacttgccagaaaggttgtccatattcagtcggagcacacatatttatttaacacaaagggtatcagtgggtattctgcagaaaagggcacagttgttaatttgggtgcactatgtcagacaaagctagagctttggttattgcagaatttcatgtaaattttaatataattcactttggtgaattatgaatgtctaagaccaacaatgctcattgtgcagaaaatctcaacaaacataatttgggaaattctaacatggtttatttcattcattcatacagtcattcattcactcaataggtttttattggagtctcactttctgccaggtatcattttaagagataggaatgcattaaagagtgtggcattccttctaactcaaagagcttatcatggatgagaccagcagacaaccaattataacatccaggtagtgatgggtacataaaggtggagcacctgcttggctttgaggggtagctgtggaaggttttgttgaaaagatcacattctggttaatttacgaaggatgaataagtattggtcgggtgaagaatgagggaaagtgcagtgtagagagaagtggcaaatgaaagtgtctagaagagacagagaatgagcacagtgtatataggtccaggaagtagcccactgtagaatggaaggctgagggatgttctcagagatgagatcctggaggactcactgtgcatcacaaggaatttgagctccatgttgcaaacaatctaccactttgagggtagtgggcagctattgatgggttttaagcagaggaaagtcatgtttttgaaatattgctatagcttcactacggagatagatgaagtgatcctaagaattgatatagaaagatgagttagaatcttcagaagagtttatgaaacgggtgtcagggaagatagggataaggaattcagatgtggacatatctgaatatctagttcacagagagggctggactgaagatatgttttgggcagtctttagcctctcaaaactccatttgattcctgaaatctttggaaaccaggactcagggagagcccagggtgaagggcaagaagagcaacacagctgccctgaaggatattggtatttgatggatgggcagaggaaaaggagttggtgaaggaaattcaggagagccagccagagaggtaggaggaaagccagaattgcagagtaataacagaattcaagggagggggagtggacggcattaactggtgcacaggggtcaggacagctaaggactggttggtgtttttgatagcaatgtcagtggagttaggggctcaaacaagattgcaatggagagtgaaggtagagccagaagtttaggtcgttaggggaagaaaagtagcagagctgccattcagaataacacctcttcttttgaactacagtcatctttatttacgtagtattcttctctttctgtttgtcctgatgcggtagatttgcagagaggtgcctaccaccctgaaggaatgcatccaggagcccagttctgtttcacagacaaggattgctggtaagatatgtttatctttaacaaagttttttaaaaaatcagtatgtaaaattttgtgatatgagcctcatacatgaattagaaagacttagaaacgtcgtgccattttctttatttaatctactttcaatgatttggaaagaacatcttctttaaacccaagacacatttggctgcccagtgtgggtaaggcatttgttctcgcggcagataaggctggcctttctctggactccagtgctacctgggcatccacaggtcctgccgaagggaagatgagaggctaggtgcaaaaactggggactagttttctgggtccaggcagcttttcaggaaatcagctataacttgttgtgttaacatgagcttggttaacatatgtaattagaccctgatcatgactgagaacaaaaggcttagatatcctgggaagcaggtgggggatggatatttagaagcattctccaacctaggagacaaatacttctcacttggatgtggagaaagaagaatgttttctcactatttccttctctctttatccagattagatcgcaggctcctgccccatagccactgttgccactgccttgcaagttttctgaaccatcatgccctgctcttcctctgttgagtcacctggcaaaaccgcaaatgtgaccaactctaactgtccactcactccctgacagctgcttctgctgattctttttattgctcctccccgcttttttcttctcccttgtccttctcctcctccttgacttccatgtccaccttctactttctacctcttctctcgtcctccacctctacctcttctacctcttttttttgggagggttctttttatttctcttattcctcttatttttcttttcttttccttctcttcctcctcctcccctcaagttttgaaaaaagtgatgacagacaatatattttttttcatttttcgagattgcaagctaattgaggaccaagtttgtgttttttattacttgtatttctggaaatttgcacaaaaagtacctggggcctgatcaagtttcttgattaatattcagaacacttgagttgacatttgggtactgctgctttgcaaatacaggctcaactccataatcatagggaaagaatttgatgcattttataaaatcgtcatgggttatcttactttttaaaacctctatatggtaaaggagcagggaaaatttgaatacatatttagaagtataaaaagctaacagcaaagctacaacttccattaggtggatggctcatttttaacaggatattcgtccttgggataggcctgagacctgaagctaatcttagtatgtctctctcctcctacgcagtgttttaattcagttccttctttttaacattttatttagaaaataaaattaaccattttaaagtgaacaatttggtgacatttaatgcattcacaatgttgtacaaccactatttctatctagttccaaaatatttctatcactccaaactaaaacctcttactcattaagcagtttcttcccattccctcctactcccagcccctggcaaccaccgatctgcattctgtttccatggatttctctattctggatatttcatataaatggagtcatacgatgcttcttttacttagcataatgtttttgaggttcatccttgccaacaccttgccgactgtactcatttcagagctatgactattcatttcaaataagcactcagcgctaagagacagtcctaccgtactttcttctgagtactccttggtactcatttctcaactagtgacctcatctcattttcaaaagaaaaaaaaaacctttttcgttttcccaccagagaatccatcaagctacctgcggctgtacccatatactttacacacttccttcctattcagtgaaagggttattatctcttttcctaagaccagctcctccacttatgcataggatcccatattctctgggctgcttacgtatcctctttctctgatagctactagatcatccttattgccataccttttgaagcatgtagctctagtctactcatttaaactgatgtacagtattacataacattggatatactacaatcctctaaattctcttttctacctatgcttaccagtcccagaactgtagacatttttttttagatgattcacccagtccttaggccaataaacttgtagtcaacctcaactcttctctggaattaatattcaatccatcagcaagtagcatcatttccatgttccattccacctacttccgtggtcttgaacacccttatctttctatctagattattggaatatgctcctaactcataatcctgattttattcttgcctcagtacttctccatgacctattcctctgatagcagatagagtgattcttttaaacgagtttgattgtgtcgtttctttgttcacagtcttttaatcacttccatccacataaatgagttccaaagtctggccttagtccagaacaccatgcatatctgcctgtctctttaatcacatttcttactacttttccctttgttcattctgtttcaaatacactggtcttcttgctgtttcaaacatgccaagaacgtaatcatttctggtctttgtgcttggtgttccttcttcttgtcttccccaaatgttcttctcttagatattttcatgtttcacatactcacttcctttagttctccttcagatatccctttctagaatagccctttcttgcccacaatatctcagatacaccctgtctctgtcttcttgtattgattttacttcataacacacatccattttcctgatagaatgcaagctctggcagggcacggtggctcatgcctgtaatcccagtgctttgggaggccaaggcgggtggatcacctgaggtcaggagttcgagaccagcctggccaacatggtgaaactctgtttctactaaaaatacaaaaattagctgggcgtggtggcgggcgcctgtaatcccagctacttgggaagctgaggcaggagaatcgcctgaacccaggaggtggaggttgcagtgacccaagaccgtaccattgcactccagcccaaactttgtcttgcacactctcatgcctgcagcgtctagaatagccccttacacataataggttcttaataggtatttgatgaattaaaacaatgaattttttttatctacaaaaaaagttaaagtgaagatggggcagaaggatgtgtgagatattctgtagggtgtatatctagtgatggaatcactgggtttagcatatgggtgccttctacttcactagctgccattagggtgctgtctggattacttggcccagtttacactgacactggctgtgtgtaatgggttcttattgttctacagcattaccagcacctcaacactttgctctcaggacccctttacacttgtaaaaattattgaggaccctcaaatagcttttgcttttgtgagtgatagttatccgtatttacctaactagaaaaattttccattaattcatttattaagttgtttaaaaataataataaagccattatatgttaacaaaaatagcatgtttttgtaacattagcataagatgctgggcacagtgaatcatgtctataatcccagcagtttgggaggctgaggcaggaggatcacttgagcccaggagtttgagaccagcctgggtaacatagggagaccctgtctctacaaaaaattaaaaataaaaaaaattagccaggcttggtgatgcaggcctgtagttccaactaatcaggaggcagtggtgggaggatcacttgaactcaggaggttgaggctgcaatgagctgtgttcgtgcctctgcttcccagcctgggtgacagagtgagcccctatctcaaagaaaaaacaaacaaacaaacaaacaaacaaacaactctgttttctaaaacaaacaaaatcctggaaaagctgcagttttatattttttgaaatctcttaaatgtctagtttaatagaacacagctgtattcttatttctgcttctgcatttggtctcttgtgatgtcacgttatgtagacttagataaaacacactgtacacgtgggagagactgagcctaaaaaggcaaataatgtgctgatgataatagtgtaggcatcttaacctagagcttctcagatgtcacttttctgatggtggtcctgtggatgtagggtatttcattttaatttgtactatctcagttatagaagaggtcagacatttatttcacatttttatgtttattgccttttttatttcctcttttgtggattgtctttagatgattttttaagttttagaaaaagtattttggctatcagttctttgtctgcaatgggcattgcaaataccatctcctttcatctttcaaaggcttttaaaatctttacttatggtgctctttggaattcttaaccattaatggtttattaatagcttcccttttttgtgttttgtttgagagctacttcagtcctctgaagtaataaaagtattccttatttttaactaacaattttgtttttcatatttaggtccttaatccactaagaattaatttttctatggtgtatgtgaggttaaaatcagtcccatcatttccctgctgcagccgtggtgactcacttaattgaacagtaaattcttcttcattgatctgtaattcagtctctgccaaggtcagatttctctgccacctacacattgtgactcttctcttctgttggtctctttaaatgtctcagtctataatatactgagttaataattattagctaaataatataacttaatatctgggagggcatattcctctatcaaaaaataatttgactgttttttgtccttttctcttcaatattaattttataaccagaaatttgaattaatgattttgttacattcaagcctgttgggatttttattaggattgtgctgaatttacagattggctatacattttagaaaattatttaagcctcatctaatatatcatacctgaagtaggttacagatagttttaattactaattcaactacttattgtatcaaaaccaatcaatttggcaatgaatattaaatacatacttttttttgtattttctgactcagtaattctacttgggaaatctatgctaagatagagatcagaaatgtgcaaaatactctacatgaaaagatattctttgcaagttttttaaaaaattaaaataaaatttcaggagcaatctaaatatccaagggttaaataaaagtgaatatgggtataggttattacataggtattcataattgtgtttactaagaataaaatatgctcacattataaagttaaatgaaaaaaataaaaaattatgaataagttggctttataattaaaatcatcttgccaaaataaaataatacttccagttctcccacatttgtacttttaatttttctcagtgtcagtgctgattatgttatagaatgttgcaaaactgttttgttggcttgatagctaccaaagacatatggatattacaggtaataccatagccatttcagtatgaaaaaataacctcttagaattttttttacttaaactaaattttatttaaatacacatacacgtgtcaccatgacaccaccataattaaaacatcctgttgattaatttctcttttgctacatttttcatttcagctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaagtaggtgcatagtgtaaaagcttgtcatggaaacgccacaacccagaggtagaccagatctgtttgaatcccttttgtttatcctaaactatgagagaatgaggtttaaaaaattctgtatctgtcaaacaaccattcagggctaactacaaagcatagagcttttcttgcatttatactgttgtgatatgatcaggtttactgacttaaactaaagacccagtgcatttttaaaatctaaaactgataccgtaaagctaggcacattagtataaatataagctggcgttagcatttcatgcctgttgtgtgatgtaggataatctcctaaagtgcctttgcaacttatatttcataatgagattaatttctgattttaaaagtgaatatctcctataactttactactatacatgtaccatctaatattcatttgtaaaaattctttttccctatttagtgtgtgctaagttctgggctgtgagtggtacaaggatactgacaagaatattctaggtagaaattgggaaactacaatgaaataataataacagctcttgctaaattttattaagtgcttcatgtgtgctggtcatttttctaagtattgtacacgttatctcattcaattctttaatagtcttgtgagataggtactgtttttatccccacattacaaataagtccacaccgaggcagaggcactgagtgcatatgagttgacaaattactgtagcaaggcaagagtctaataaaagcctcaggagaagtacaggcaacctgttgggggagccaggatgaggaaggggatcacttctccagtgatggaaagcaaactgtgtgggattttggcatctgggacaaagtggtgacattcctggtatagggaacagagtgaataaagtcatgtggtacaggaggcacaaaggacagtagggccaacatttgtgcaattaagaaatacagtgtgaaacaaggcaggaaaagcagctcaaattccctttgtgaaggagcctgcaggctgtgcaaagccctttggatttttagtctgtaagcaattggtaaacatcttccttcccatttctttttctttttaaaattgtgtttatgaactcatgataaccgtgctctgctttagtagaagactaggatggattggaggcaagaaatgcataaatcaaggcaaagagccctttctgaaatgactaagatgatgctgttgcaattagcagaaataaggaatagaagaaattgagtgtgaatgagggtttgagtgatttagtttcagacgtgttgtggtggggagtccttatgccatttagaaggaagtgatcagtattcattaccatgtgccctgggatttaggattgaaagttgtgagcaatccatttagaagtaatatttgacaccaaaggagtagctggaatctacaaaacgggtgaatttgtaaagaggaaggactgggaaaaagtcatttgccactatttgtattttttgtaaattgctttctagtctctatgactgtcattagttctgtactgaaaacacatgattttcctgatgttgttaccatttctcccatatttattagcactgagagacaaaccatctacagcagcagtttttcgtgtctaagaggatttaatttatagttattcctcttagcacttttctgtgtcacccccaaccctatgacattagtttgtgttcgtacctgacacagaacagatatgcaagtcatcatcagcagcaataactgctaatgttttcagggcatttttcagcttttgaagggattttctttgtttaatgtcctcagactggatgtaattgagctgtcagtattttattatttcttttttgtgaaaacaaaaacacagagaggtaaagctccttgcctggtgactcaggtgctaaatggaagaactgagatttgaatgcaggatccttgactttaaatcatgcactcattttctgccacgttgctgatgcttcactatgccatagaggaggaaaacaacgacaactttgatgtcagcacaactgttttgcttattattcttctcatatggcttattaacctatccgaataatcatttctacttaacagattacaaaggctgacttagaacagcgccatcctcagctggattatgtttttacattggcacagaatttgaaaaataaagcttccagttcagatatgagaacagcaattacagaaaaatgtaagttttttaaaaaaagttatgtattatcatccactttccctgcaaatggtgacacacacacacacacacacacacacacacacaaacacattttcaaagattattcaactagaaagtaatagtgtttaatatttgttactctttatttatacagaaatgtagctttcccttgtttttatgttttgtgaacattgttacaataaccttatgaagtccttaattattaacatcacgactcttaagtaattacttacacattgggttttcttctcttaacttaggctttcttttagaggaataaaaaaaggttaaaggaactcacaagaatgcaaatcctttctctcattatactttattctctaaaatcaggtcttactgtgtcttttaactcaacccaaaattcagtccacaaatatttattgagcaactactatgtgcttatgtgactggcattaatttggggatactttagttataaatgagagaaaacaacaacaaaaaataaacatacaaaacaatagcaaacaaagatccttgcttggggtttgcattctagctcagaagcatctaggttctacaaacccttcttagtgggaatgtactaccaatagcaaacgaagtctaaattctcaagagtgacacctagggattgtcacaatctgctgccactaccccttttctcacttcagccctcagcccggcctgtaattatgctgttattccttaaaatatcctgacatttcctagtcttcttacctttatttgcattattttatttctcttggccttttcttcccaggtgcaattctacgcagcagctaaaatgtcatcccctttgtgacatctttccctcctcttctggtccctggtgaatgttaatttctatttttagttccttctatggcctttccccccattgctttattatagatcttacaactactttaattgtctctctcttccatagattgtgaatatccgtctttctgcccttgggcctttaacagtgccaatacaaattaactacctaataaatatttgtgacaaaatataaactggaaggataaatcctaatatttgtcaagggaagaaagtcagctactctccctgtaaaaagtatgttttgatttcaaaatagtcatggtagcaacagggttattataggagatacattagaaaagaacttttaatgtctaacagtgttggcttatttttactaaatacatcattttccttcttttctctttttatgaatggatggattgtgcctattatggaactttggagtgagctggtttccctcacatcacaggggagctcctctgctctagtgataccaaactattgacaagccatttccagtttgctttttctatcatcttgatgttttcttttaattattattttttccatcacctctctttttgtccaaaacttctttcaggtgtttgtttttttgttttacaagacttctcctaaatatcttccctttcccattgaatgtacacactctattttctctctatatataaatatttctgtgtgtgtagaggttctataaccttcatcactcctcattatatgaaaaacccttcccagggggaatgtattgctaccaatagtaacctcgttttagggcttaactcacaatgaatgggataatttgcctatttcttatgataaacctgtgatatttactctcgcttgatgtctttggtttcatttgtttactgttaaaggattctattagtaatagaattggtcataagtactttatgtaactttttaactgacaagagaacattatgatagatttggcctctcttccttaagtttaaaacttaagcaatttatttaaacagctaagacagaatgaaacagattgtctcattgagcaagttttaaagaatgatgacatgtaagtataacttaaggcctgaacagccttgttgatagcttttttgttttttgagatggagtttcactcttgttgcccaggctggatgcaatggtgcaatcttgactcactgcaacctctgcctcctgggatccagcgattctcctgcctcagcctcccaagtagctgggattacaggcacctgccaccatgcccagctaatttttatatttttagtagagacagggtttcaccatgttggccaggctggtcttgaacttctggcttcaggtgatccacctgcctcggcctcccaaagtgctgggattacaggtgtcagccactgcacccagccagttgatagcttttatgtttcactataaccatatattatcccaagaactttgccaaagtgttccatgataactcagctggaatgttatcttgtagttacgttcctcttgggcctggtacttaactatagcctttctttttgtctgatatccaaagcatctttcagcagcgtggttttaacattctacctacttattatcagcaggttcttgcggatattctaagttattgtttattagtacctcagttcaagattatgaactaactctgaagtgattaataaaaaatttaagtttccagccgggtgcgttggctcatgcctgtaatcccaacactttgggaggccgaggcagacagatcacgaggtcaggagttcgagacctggccaacatggggaaaccctctctctactaaaaatacaaaagtagccgggtgtggtggcacacacctatagtcccagctacatgggaggctgaggcaggagaatcacttgtacctgggggcggaggttgcagcgagctgaaagccaggatcgtgccactgcactccagcctgggcgacagagcaagactctctctcaaaaaaaaaaaaaaaaaaagtttccttagatctgtctgtccttaaaaccttgttaaaaatagagaaaggagaagagagaaagcttgaggagaaatagaaagagagagaaggtgataatgagtgaaaggaatgaacaataataaaagaggaaggacaagagccagtatggaatttttatgatgaagagctgctgggtgcacagttcatgagtctcttttacttttagcatttctcttgaacttgaatatataaaattccttttagagagttttcctgctacagtaaaacaaatgcaaaaaaaaattcttacacagttcagtttcttctaaaatcaagactgccttagaaaattctcctttgagggtaacaggtgactatctctctgtcttaaagttctgtcatgaagtactgttaaaccctaccttcatcaaaccaggtctataaatacaactgtaaatacaaaattaaatagaacagtattttctttataattgtttggcagtatcagtttataatagtagatatttttttgggagttgttttagagcactgaaaataagagttcaagatttttttttctcaaacaccgtttcagaaatatatcaattgtataggatggcagatgtatattaaaattccttcaaaatgtgtttatcagcttgccttcttctgtttatagacttatttgtgatacatttgatatatgatattttttctttctcctgagggttacatgttgggatttttttttcttttataatgctaccctcagtggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgataaccaagtaagactcatcagatattttttggcagtattgttttgttggatatactttttttctattgttcactgtaattcttaacaataggaccctgccatgttttttcctaagttcttagagtgtctaatgaaatttatatgaagaatttgatctggaagatttttttcgaaaaatttctggaggcataacaagtaagaatatgcatgtctccgagatttatagctcactgactttttgcaagtgaaacacaccctcaaatcagcatctagaaagagaacactttcaagattccaggaaccctcttttgctcccttctgtactgtattagtctgttctcacattgctataaataactacctgagactgagtaatttatgaagaaaggagatttaattgactcacagttcatttgagggctactgtagtgaagcatgactgggaggtaccaggaaacttaaaatcatggtggaaggcaaaggggaagcaggcaccttctttacaaggcagcaagacagagagagatagaagggagaagtgccacacattttatttatttattggagacattgtctcactctgccgcccaggctggaatgcagtggcactatctcagctcattgcaacagccacctcttgggttccagcgattcttgcctcagccttccaagtagctgggatgacaggcgtgcaccaccatgcccagctaatttttgtattttctgtagagacggggttccgccatgttgcccaggcttgtctgcaattcctgagctcaagtaatctgctcactttggcctcccaagtgtcacacactgttaaaccatctgatcttgtgagaactcactatcacaagaacagcacaggggaaattcatccccatgatccagtcacctcccaccaggctcctccttcgattggacatgagatttgggtggggacacaaatccaaaccatattacttacttaccctgaaggttatttttattaataagtttttccaagactttcatttgaggactactatagtgaacaaatcagataagtaagtttagtttcctttaatgactttttaaccaaactgttttatcaatttcgtaatagcagacatcttttttgtcatcagttcagttatagagttgataatattgaacaactatggtatttttaaaagtgcttttaagattctctgtataaaattataaaatattcttgaattggaggttttagttgtgaggttatagtttggtataacatttatttgcccttcagctagcctaagatggaagtgtatatttgtgaagaatttaagaaagtatatgtagaaaacaatcgaaaatgtggaagtatgtttttattctccacaaatgcagactttacttggttacagttttaaaagcaagtggccagttatatgcatttctggatcattctgtgtgtttgtgatactgctgactgtttccaccaaatgactcccaagtaatagtgaagcccctggccccttaactagaggaatacaattaaaagtgatgtcagtgtttcagttatcatattagaacattattttttaatcagcagtgtgattcttttcttctgaaaccttaggctgatttaaaatcttcccaattgctacaaaaagcattatattaaaggtttcagttgtcatttagatttcatggtgagtaccttgatccagagactctcagaggctgaaaaactatgtcaaagaaccaatgccagtggacaaattcagcatcagtttggctattcaagcaaactctcagtaaaccttgcttggcagcttgatccattcaagtggttatctttgtaaacacaccttgtgatccaggggcaagagatggaagacgtccatgttgttgattcttcacgtttctccaggcatgtatgcaggaactgtctctgtattcagtcctttatgacgcatgtccgtgtaaggatcagagaggtacagcagaaggaatgaaaaagacaaatggtttgaggaaggaaaatatctcaaaaagaaaatgataataatcttgtaatattgtcatctatgtactcgatcactttcttggacatgtttcttttcacttctactaattttggtttaagcttacatataacaaaagggtttgcccccagtctgttttcatcctgtgatatctgtatctaaagcatgtcaaaatctgctgggagtaccattgttttgattatactaattactgagtgaccaagtctaacaaacagacctgcacttgcacctcagatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaaggtaagtctaaggccctggcaggtaaatgtatattgtcaagttgagaatttgatggctttggctttctcgtggaaacctgccaaacatgtggctactacaagtacattttattattatgtatttttatactgtgatgttctgagttagtattatcatacttagtacagaatgtatgcttatacaatatgtttttgaatttttacaatggagttttttattttatttttttaaatcagcctaaaccttgccaatgattatgtgttctgattgtcttacgctctcagtattatctagaatacactttgtagtcttctgatggtaaggagtgcaggtgtttacagatgcatcagggtaatggtatccctaaaggtaattggaatagcgtgctatttgggtggggcatcctaagttgaggaccagacacacatggatccaacactagatccctgaaataatctatgtgcatttaggattttagttaatttactatcttttttcccattactttgtctagtcagagtatttggaacagcccaaaatagaatatgtgtttacaagagaattttctgtcacttgaatcacttgaacacctagaatttgagaaactataaacagtgattagcatctctttaagactgcatatttatattcatcattagtaaaaaaagatgtttacatcatgcatatagtactgggaatgcctgtgtctaggtgaaattacgcacatctttattaaaatgcaactgtcttaaaaccaatttggtatcaaaacacatctattttgacgtgaataaaatgggtattagagcactttatattcctgatatattcctgctaataaagtatggctaagcatttaataacattttgacatggatacgttttatacacttccagagtgttatttttagttacaatctctgaagctctgaaaactcaaagaagagggttatgatggcacaatgtgaggttgaatgtgttgttagatataccttggatactggagaaaataagactgggttagcaaagacaaaacttcacaagtggttaaagcagagtggctataatattggtctttctaacattttactacaacttttctcttttattataataggttatttggatttagtaaggatatcataactcaggcagggaagaaggtgaattaaaaacagctttaaccttaagagatagcattaggagatatacctaatgttaaatgtgagtcaatgggtgcagcacaccgacatggcacatgtatacatatgtaacaaacctgcacgttgtgcacatgtaccctaaaacttaaagtataataataataattaaaaaaaagaaaagacctacaatcagacaaagcaggttagagaatttctttatggccatctccaagacagaaaggtaggggaagactcctgccttcaggagagaaagaaggaggtgaaagggcaggagaaggtcacagagagagattgttttctgaggcctgcttctgagccctgaggcaccccaatattagaacaaaaggctataacaagtgttatgggagttatgttgcaggaactgtggatgaaaacatatacgtattacagtaagtacgatgaataaaaattatttgcataatatagctaacataaaaaaaagagatatagtccttaaatatgctctgtctttgtgtttccaaaaattccatgtataagagttaggactttgttttccttgtaaacttaacaaaaaatttatccgttaggaatgtgtggcctgctttatttagcacctccaattcttcttcttattttttttttttgcttttactttgtaaatattttaagacagcctacagcagtagttggattagatggaagaggcaattaaaaatgaattatattgcaaggtgatttttcgtttatcatagctaagacaattacaatgttccagtttctttgtagttacaagtggttgtccttattgtgttttctctctgcattttccggggggtggaaataagtaattatattaatatttagacatgatttagatatattgttatctataaaacagggaaaacagagcaaaactggctcataggatcccttcgtgaatgataactagggcttctatatgtaaagagagttttctcttttaaacccagtgaactttacaatttttaactattttaaatggacatctttgtagaatatataaatctttctttgccttcttaaagcttgtgaatgtatatttaacttttttctgaattcttggtagtattgttgcaaagatagaattaaggaactttaatggatacgagtgaccttagagttcttctgaaccagtgtttctcaacctttctttacattatcgcttccctaaggagcctgtgtagactcatcttcccatgaaattttaataccatgatatactgtgtactgtatggttgtgctttatacataaaaagaatacattttttcaccctccccctgaaaagaaataaccatttattacctgtgttgagaatacatggtctaatctaatattctcaggctcagagaagttaagtgacatgttcaaagtcatgcaacacagtcaggatgatatttttctatactaaatggtaatgctcttcatgctgtgagttctgaagaattggcagtaaatttattcaggctgctatactttgtgagatttggggctttgttttgtgcgtataaattttgagtgtcgtctcattgtcaggcactgtactgacctcttcacacacatcatttcatttaatcttcacaacaactgcaggagagaggtagcattttcatcagtcctatgttaatgaataaactgaagtacagagaagttaaggaattactcaagactacacagcttataatggcagagttgggattggaattcaagcttgactggcaagccaggctcttattgtctctaaaaacagtttcatttttgttctttgaatcagactgtcagccgttgctgacattcttggtgactgctttgtgtacccgcctctcagttctgtctgtaattccgcttactgattcttatctgtgttgagtttagaagccatatcagatgaaagatacggggccttttttatgcataatgtaatgcactccagtacgtggccatcacaccccgtctaatggctgctgagaggcctttttaccatggctgccctcttatcttccagcctgttctttatatacatcattgtcagccaaattctggaggggtgaagggttgttatatttgcacatggaatactgtgcagcataatgtgtgaagttcaatatcagctttcaaaggaaatgttttgtatgaattgcagttagcctaaataatttagctattcacaattataagtccacaatcccttatctacaatgccaaaatctaaaaacagctttgataacagaaatctttgaattaccatgcagctctttattaaagtctttatttattctggttagtatgaatagcctttttccttgctgcagaaatattaatgtgtttgattgcttccccagaccctgttcaggggtagtaattaatatagttactttcataatattagttttctaatgttcaaaaataatattacttctgaaacgcaactgaatcctgattttttggattctttgaaaagtaggcctgtctctaatgtttctaactaatctatatatcctgaccactactttttttacttatcactttttttccttccatctcttaatgctaattaacaaattttctagtgccagttgagatagtgattgttgaaatgtgtttatagcacagtcagtgtggatgcctgatttgggtctaaaatgctattttagctgtatatattttggcactccagggcaaaaataacattatatatatatatatatatatatatatatatatatatatatatatatatatatatacatacacacacacacgtatacacacctgtgtaacacacatgtatatatacatacacatatatgtgtgtgtttatacacacacatatacacacacatataactgtgtgtatagacgtgtttgcacatgcatgtatatacaggtatgtatatatatgcacactcatgtatatacacacatagttatctacactgaagtattgtaaaggaaatgagacagtataactgtgtgctataaatagtttcttagaaatcactaattactctgtgtttttctccttgtccttatcgcattttaccttgcctatgttaaggtatttctaggtttgtacaggcagaacagaaagcactgagtgtaaggtatatggggcaatccttggttaaaagcccatcttaggcacttgccttctgtgctaacctataggaagttatttcaactcaccgagtcaccatttccttgattctaaagtggagaacatgtctaatatgtggggttattgtgatatcaaaagttatgtgtaaaagttcttggtaggtagtatatgcttaagaaaaagatgcccaaagtgtcatcatatgctctttcatataatgtctttctgataagtccacttcctttagtcaaatgcacagtactttctggggttaaattagcagaaggttgagtcattatcagttgtttgtccatagtcatttctaactctttctactttaattaatgataaaatacttctttgtctgcttttctgagtgcagtatagatattctaaaattttattaacagatgaaatttcttaaaaaatgcagtttccttggtttgcagaattatcacagttgctgaatttaccttgcaattaagcattttctgccaaagcaaaagtccaaccatcctgggaagaaaagatacggaatttaaaaagacacaattatttatttaaaaaaatattttattttattttattttatgttccaggatacatgtgcaggacatgcaggtttatgacataggtaaatgtggtggtttgctgcatctatcaacccattacctaggtagtaagtccagcattcattagctatatatcctgatgctctcccttctcctgcccccttcctacaggccccagtgtgttgttcccctccctgggtccatgtgttctcattgttgagctcacatttataagtgagaacatgcggtgtttggttttctgttcctgcattagtttgcggtggataatggcttccagttccatccatgtcccagcaaaggacatgatctcattcctttttatggctgcataatattcctcggtatataggtaccacattttctttatccagtccatcattgataggtatttgggttgattccatgtcttagctattgtgaacagtgctgcaatgaacatacacatacatgtatctttataatagaatgatttatattcctgtgggtatatacccagaaatgggattggtgggtagaatggtagttctgttgttaggtctttgaggaatgccacactgtcttccacaatggttgaattaatttacattctcaccaacagcattaaagccttcctatttctccacagcctcaccagcatctgttgtttcttgactgtttaataattgccattctgactagcatgagatggtatcccattgcggttttgatctgcatttctctaatgctcagtagtgttgagctttttttcatatgtttggtcacataaatgtcctcttttgagaagtgtctgttcataagacacaattatttaatgtgggagcacaaatacagatttattcagtaagataactttattttcttcttttgaaatgctattatctttctcattaatatttattaattaataatggccagctagacatgtggaatgtatatagttttcaaaaggttatttaaatattgtgtatagtaaagactgattttgtaactattctgaaaacaggttaagtttcaaaaatttaattttgattgactttccaagtaattttgttgtatatttggaagcttctattatatctgttattactttttcagtaatgatgtttattgtccctatagattaataaaaatgaagcttttttcagcatttattctttgtccaatttggtcaattccttttaacagtgatcagtagaagatacttatattgggattgtttcataaggcctgatatcagccaggctcaaccttcaagctcttaaaaatgaatgctgtagcagctgtcattcccgaatgaatgggcttaggtgaaaagtacaggtagccttatcctcctagcatgcccaccaatatgaggttcagagatttgggtcagtcaacttgatttatcctctcggaagcttacttctttccctgaaaatcacctttatttttcaacttgttttgtttattttctttgctaggatttgatttttagttttcccttccaagctgggaataaagctggccaaaaagagaagggtaaaaattatagtcttctatattttcctcttctgttacgttgttttaatatttcaagtatcattttattactttttttaaaaaacaattgccaacaatgtctttgtgataaatgcctatgaatgttaatgttttcattttgtaaatatcaaactcaagcatgcggatattttctcagcacatttagctccatatcaaacaaactaaagagccaatgcccacagaaacaatgcccacagtctttgtttttgttttcatttgtttctttttccattaattgattaatcaaccagttaaacaagtatttatttagcttcctatttgccaagctctgtgaccagccctaaagattcaaccataaatacacctcattcctgctcccaggaagctgacattgcatagggggagcctgcaatgtacgtaagtggtaaataggaaaataatacataattataggaggttgttttggaggtaagagaaattaaagaggtgctatgtaagagagggacttaactgaggcaaatttagaaagcataacttggtggcatttgagctggttctgaaggttaagaaggaaccatctgaagaaaattacagagtgaacagcaaatataaaagtcatgaggcaggaaagagcacagcatgtggttgcaatataatgaatatgatggtaagagcttgagatgcggtaggagaggaaggcagaggccagatcatgctgagctttgtaagacatggggtattagtccgttttcatactgccataaagaactgcctgagactgggtaatttataaaggaaagagttttaactgacttatagttcagcatggcaggggagacctcaggaaacttacaatcatggcggaaggtgaaggggaagcaaggcaccttcttcacaaggtggcaggaagagaattgctgagtgaagggggaagagctccttataaaactatcagatcttgtgaaaactcactcattatcacgagaacaacatgggggaaaccatccccattatccaattatgtccacctggtctctcccttgacacatggggatataggggttataattcaaggtgagatttgggtgtggatacaaaacctaatcatatcacatgggaaggagtttggatattaaaagtacaatagaaagctattggaattgttaaggaagggagtgacactgtctaatgtgtatatatattaaaatttaatctctctggatcttatgtggataataggttgctagtgggtatagtagaataattgcgaagatcagaaaggaagtgatggttgtggtccaactgggacatggtggtccccgtggctactgtatgccagcaatgatggaaataagatgttagatttgcgatatgccttggaagtagaaaagacattttggtggattagatatatgccttaagggcttggaaacaatccaagatggtattttgtaaaaggatgagtggtggtaccattcaccgaattgggaaaggatgtgggagttttggaagaacaaaaattgcaagttggattttgttaagtttgagatgcctgttagatatctaagtatataggttaaataggcaattatgtatgttaatctggaactcagatgttctggacctcagatatgaattgagagttctcagcattcacattggaggttgaacatgtgggactggatgagatcaccagggaaggagtgaagatgaagaagagaggggtatgcttaactgagtccataaggcctagggtttggtgattgaacaaaaaaggaggaaggagcaaaagggactcagaaaaaatttccaatgaagtgaaaaaacgcagatttgtcatgttcagaaatagagggaggagaatatctcttagaggaaatggagagaggagaatgtttctaagaaagaatgatctactggattgaattgggctgaataaccaaataggatgacacagcacactattttggtaattccacagcttggacattcctggtgattttggaaagagcaatttggaggaagtaatgtggctggaagctagagagtgagatgaaggtgaagaagtagaaacagtttgtggaaacaactttagagaagtttgtgtgaagagggacagagattttaggtagtgcttagtgtgggggctgtaaggttaagagagtcgattgacttttctgttaaaatggattatagtaaagcatgtttgtgtgcctatgagaatgacccactagatgagagactgatgattaaatgcagaggggacaaaggaaggaggacaggaaggctttgagaagataagaaagtgagatttagagaattgggtttggtaagaactggaatgcatttttcattatgaccagaaaagtcaacgagaaggtgagtttagatgtacgtgaactagaccattagtggtggaagatgaaaggttctccatgcaagaactgagctttatgatctatcgagcacattgtcagtgaagttggaggtaggactaagagaagttggaagagagaggattgggtgtaagttcagatctttgtgagtgggatggagagtttcctagggtaaatatatggtattgctgggcagtaatgagtgcctatttgtggtttatattattaaatgtaaggaaaggtagccctgttgaactactctttaatagcattcatctactcaatgaggcaatgaagaagaatgcagatggaagtgggagaaagatggagcagggaagagtaagatctttggaaatgagaggagaacaggattgcctgtggtccataatagtgtctaatgtgtccctttctctgggtggtgtcattcctcactagagctatggcttggcaaacagaccttaagttggatttcaaacttcacttcctcattgaggcagtggtcaacctctatatacagtgcccctgaacctgaagctcagtataggaacagagtggatacatgtgttgtgctttctacagtgggattttgcctggaagatgggtgaacaataacctggaggtagcagtggggagcagggaggacccttattccagcttctcaaactgaggcataaaggatctgagagaaaaaggaaaagacttcatgaaaagtttgcagggaaccccatgcagtagctcatgtctgtaatccagcactttgggaggctgaggcaggtgaatcgcttgagtccaggagttccagactagcctgggaaatatggcaaaacctcatctctacaaaaaatacaaaaatcagctgggtgtggtgacacatgcctgtggtcccagctactagggaggctgaggtggtaggttcgattgagcctaggaggtggagattgcagtgagctgtgatcacaccactgcactccagccttggcgacagaaccagactctggaaaaaacaaaaagtttgcaggagaaataatggccctatggaaactggtttcagtgaagacaaaaagggattggcctggggagatggaaggtacagcagagtctgctgatcctagaagaggagctctagagcatggtggaagaagggttggggagtgtgttggagcagactggggaaggtattggagttatgattcaatattggttgactaatgaagaccaaatatctggtagtgacttagctaaaggggaaataggatgtggtgagggaaatcctctcaaagaaatggctctgtggtcttgactatttatttcctgacaatcacagccccaagagagatgctcctttgggttcacaaggctgtgggcagggatcatggggtagcagcaggggattgtgaaatgaagactgactcttctttcaactgcatttttccccacagcatgctttaatgtatttcccaggtgaatattatttaaaagaacaaaattaccttgtgaaggtgctcactgaaaagtttaaggtattgtttcattgtaagttttctacctgccactcaaactactgatgctgctgtttttcattctaaaagagataaatgtatttaaatattatattaatgtaaaggtcaccttttgagcacaccaaaatttggcaacacacattgatgggtttcctgagatgctcttttcattaaactctttaaaaagagagacatatctattcatgttcaaatactcttttgaccaattataagtaaatgcacaattgattaaataatatatcttgtagcttaaaatatcaagtattatttaacatctttaaaataacattttaaaaaggcaagtatgtcatgttttattgtgttacaaaatgattataggctatagggtgtcatagctgcttttattacaaaaatatcttttaaaagctaagcgtttacatttaaaaaaaatcctacttccctttactgtaaagtgttataaatctgtcacccgtggatgtccttaaatcttttttgggaagctatttatatttttacttggtgtcatttcttgcagtaaagacttttatagtctgttgcttcttctgtttgaagtaaaaaaaaaaattatttctgctaatgttacccttctaaacttaaaatgttgtatctttaggtttttagtctgtgttctttgtgatttgtagatttaacaaaagatttagaaaaaaatttctttgcctttgtcttctagccacaaattcctaagcttaaaatcatttcttttcctgtaacagcattccttcccttgtattatctcgttatttttctcaatacgtcctctagctgtgttctgatctttcttgagacgtagcagtcagaactgccaaatatgaaatctacattgagaatcatagacgaatgcaagttcagtgctggatgcgatcttagaactcttccacattaatgcttcccaaccttttttgcgatcggcacactactcatctattcccgccagtcatctttcgtttacatgcagcaattcttaatgaagctgaatttgaaactagggatggaggtgagagtggaggaacacttctagtaggttttgtgattcctgtgatggattatgtagttttaaaaggatctctggagattttgaaatgggtaatttactgatccagtacaagccccttattttaaggatgaaaaaaataaattggagatttgaaatgatttaccccaagccatacagctagtaaatggtggaggtgatagaattaggtcattgtcttttgagagcagtgtacacaaatggcattaaaggtggtatattcacctgtgtaataaagtatgaatacgtgttcctgagactctaatttcagtgattttattgacttatgatattatgataaatcatgtggagttccttgagaatggataaaaaatcttgtaatattgagtataccatactctagcctagggtctaatttttaaaagtaagaaaaaataaactggaggtggaggaaacaactaagctatagtctattagaaattttatataaattatattaatttcaaaaatcagaatataaaataacatgtataagctatgattttaaacttaaacacatacattcattataataatatgaagacaatttgcactgctataagtagggtttgacttttagtatagtcattatgtttagtagttaagtttatgataaaaatttgataccagctatatatgcattaaaaaaaaattccaggacacttatcattaaatttcacatttgcatgcaataagcaaaattaattgcctagtatttcaccaaattcatacatgaggttagggaaaatatttactgagtattcactatatcttgatacatttatatgtgtatatctcatttcctccttcaaatattgctgcaatatggagatgttattcctattgctgtataagtttattcaataaatacttgttgagtttctactgtatgtaggtcctggtcctattgggtgcactgatgagcaacagctttaaacaggcaagaaaacaattgcttactgtcatgatcagagatacaatgaggaaggcagaaaagtgtcccccaaagtgattattctggattttctgggtgagccccatttcatcccaggagtccttaaaggtggaggaggtggcagaagagtggttcagagagatgtgatttgacgactttacctgctgttgctggatttgaaggtggaagaagtggctatgagtcaagcaatgtggcaacctctagaagttggaaaagaagaggaaccagattcacccctagaccctccagaaataaatgcagccctgctgataacttgattttagtctagtggagacccgtgttgatcactgacaaaactgtaagataataaacttgtgttgttttttaccacaaagtttgtggttatttatgatagcagcaatgaaacaccaatagccatggtaggggaaactatgggatgccttggggaaggtaccatggttttggaaagtgtttgcacccaggtctggatggtcagtagaagttaactaggtgggatggagaaaattagtggaggctggaggaaaggagcaggaggatatttaaggtaaaaaaaagtaaaatgtagaggtctggatgcgacagaggcagtgaccactcagaggattaataattggttcatttttatagataaataacatatgaagtgtgaagtggggagatgcctcctggggaggtgagccagagtcagatgatggaaaacctgtgtatcaggcaaagtttagggatgatgaagacaatccttgcccaagcgctcatggctagtgagcaatggagctttgtctaccttaatccaaaatccatatttttttacttatataaccaacaaagtagacatctcttacaaaacaactaaaatttgtttttctgaaagtttcatacaaagtgaatattttttaaagtagtatctcttttctcactgatgatcagtagataatttgtcaatgggtggtctagcttctggattgagaatgttccactggtcaccaaagtgtgctgctgaagttactttacccagtggaatactgtctgaggccaagtgctcatggtcccttagctcacttttcctttgaagtatgaccgtaggttgtctacctcccctcgtagccttgtcctttatacttgctaggtatttaaatatctgtcatataagaagaatcatctgcctttacacttaggtttcttggacatttgcatccttttccctagtttggacattctcagggtttaatagaattaatctgtaatgatctctttttacattagctgttgccatataacctattatgtgcatatgaatattcttaaataataaaaaagaattctgattatgggaaatgaaggtgtttgaccttactaaattttttaatgactaaattttatatattgaatgttcttaaaggagaatcacctgtgtgtagtggattgattgcatatgtgcactcctttaatctttgttttctagtgcctttttagcacagccttcatttggctattcttaatgttttttctgttgatgttttaaaaatggaaaatatgggcagggtttggggaaggataaaacaccaccaacaacaactactcaaattctagtgggtaacttctaaattttaaaaattaaaattcacctatgattacaaaaaaaccaacaaccactaagcactgaaaggtttataacagaatatagttcttttccctcgactcactgcagtccccttcctagaggcaactattctccttaccttcttctatcatttttacatttccatattctaaataaaatgggtatgccatcatctttcaattctttagtattagaaattgtctgctgatatcctattttggtaaatacataggaagttgcttagggatgctactgttcttttccctgcttcgccattgaattttaggtaaatacatatacagtgttgacattattttgcttgtccaaacattattaccagctaaaaactgaggtttactgtaattttgtttcctatgtgtttgttttacctgaaattaataattgccttatttttatatgcctagttttctttgcacctattgctaatccctcccacattttccagtgacctgacagtacaattttccacaaagccagtcacattcagcaggctatcacttctaatattgttccttggtccttggtgacctctcttctggagacatgctttctaggcctgctgcacagccatcatgctgggtatttgctttgctcctagtttagaatccctgttgcttggatctcatggaagttttgtgttattcgtttgtttttgccttttttgtttgtttgttttggtttggtttatttgttttcttcttggggcgatttcctcattttgtctgagtgtatcctttgtaagttttgtcacgttaaaacaggaatacagagtggtggcaacgctgaagacagcccatacctgctccagtttggattcagaccctcttttctgtgatctcctctcaccattaacaggagagcccctttgcttcttcctgggctggatctcttttttatgcttctcatatcttcctccttcttgatttgcaaactgagttctgtgggggatatctaggagcttcttgaaaaatggtatgtaggagttattttttataattagctcaattattatttttagtttttttaaaaaaatttttactttaagttctgggatacatgtgcagaatgtgcaggtttgttacataggtatacatgtgcgtggtggtttgctgcacctatcaacctgtcatctaggttttaagccccgcatgcattaggcatttgtcctaatgctctcccttcccttgccccccaccccctgacaggccccggtgtgtgatgtttccctccctgtgtccatgtgttctcattgttcaactcccacttataagtgagaacatgcagtgtttggttttatgttcctgtgttagtttgctgagaatgatggtttccagcttcatccatgtccctgcaaaggacatgaactcattcttttttatggctgcatagtattccatgttgtatatgtgccacattttctttatccagtctatcattgatgggcatttgggttggttcccagtctttgctattgtaaatagtgctacagtaaacatacatgtgcatgtgtctttatagtagaatgatttataatcttttgcatatatacccagtaatgggattgctgggtcaaatggtatttctggttctagatccttgaggaatcaccacactgtcttcacaatagttgaactaatttacactcccaccaacagtgtaaaagcattcctatttctccacatcctctccagcatctgttttatcccgactttttagtaattgccattctaactggtgtgagatggtatctcattgtggttttgagctttttttcatctgtttgttggccgcataaatgtcttcctttgagaaatgtctgttgatatccttcgcctactttttgatttggtagtttgattttttcttgtaaattgtttaaccgtaggagctaattttaaagacatagcatggccgggcacagtggctcagcctgtaatgccagtacttttggaggctgaggcaggcagatcacttgaagttgggagttcaagaccagcctggccaacatggtgaaaccctatctctactaaaaaaaaaaaatacaaaaatttgctgggtgtggtggcacatccctgtagttccagcactttgggaggccgaggcgggccgatcacctgaggtcaagagtttgagaccagcctagtcaacatggtgaaatcctgtctctattaaaaaaatacaaaaattagccaggtgtagtggcaggcgccaataatcccaactacttgggaggctgaggcaggagaattacttgaacttgggaggtagaggttacagtgagctgagatcacaccactgcactccagccttggtgacagagcaagactccatctctagaataaaataaaataaaataaaataaaggaatattatggaaagattgtcatttggtaaatacttgtataaataggactcaggaatatgaaggtataaaaagttctgctgaaatgcagtttatagaatgggtggaaagatacgaaaactatataatgtagttaaaatacaatttaagaatgaaacaagatcatcattcaaggcctttttccaggattcatgtgattaatcattgtttgaagaggattattgaccttttacgaactcataacaaggatactgaactgggatggaatattctggaagaggtagtccttaacccttaaaggagtcgtaggattgtggtaggattgtgataaatggagagggtcagcaagacatttttatgtggatataacattttcgtgtggacacaatattaagaatattctagagaaaaaggagcacaccactattacctaaacagagtattgaagaaaactaggggataaagtttgagaagtaaactgggatcaattatggaggaaattaaattccaggcgaggaaatttgaactgattctgcaggttaagaagtaagtgctaggatgaggttgatgacattcaagaatgtcatataaacagaatgttagtatgtagtctttagtgtctggtttctttgacttagcagaatgcatgtgagattccatgcatgttgttgcatgtatcagtagtttgcttatatttattgtggaatagtattccattgtatccctgtaccaaactttctttatccgtatgtaataccagttggtatttgggttgtattcagtttttggccattaccaataaggctgctatatacactggcatacagattttatgtagacatatggtggttttttttgttgttgtttgtttgtttttgagacagtttcactctgtcacccagactggggtgcagtggcacaatcttggctcactgcaacctctgcctcctgaattcaagcaattcttactgcctcagcctcctgagtagctgggattacaggcatgccccaccatgcccagctaatttttgtatttttagtggagaaggaatttcactatgttgtccaggctggtcctgaactcctgacctcaagtaatctgcctgccttggcctcccaaagtgctgagactacaggcatgagccactgtgccccacctagacatatgtttttgtttctcttggataaatatctaggggtaagattgctgagttgtatcactaatgcatggttaactttacaaaaaactgccagctgtttttcaaaatggctgtacttttacctgcaatgtatgagagttgcagttactccacattcctgccaacccttggtatagtcattttcttaaagccgttttaacatgaagtaatgtctcattgtggtttgaatttacatttctctaatgattaatgtgctgagcatattttcatttgtttatttgtcatctaaacatcttctatggtaacgtataggtttaaatcttttgcccattttttaaaatgatatgttaaaaaaagatactgcatcattataaaataaaaaaaatgccaaaaagtacaaataggaaagtaaaccaacttaaatcccagcacccaaaaataactgtttgaatattaagttaatattccagacatttctccctctatgtatatatacagatagaaggacggatggatggatgaatggatggacagagagaaaaaatacgtgtaaataaagtctattagatatgctgatttttactgtgatacaatttgtatacagtagtccccccttatctgtggttttgcttgctgtggtttcagttacctgtggtatatacaaaaagaaatcttgagaaagagagagatcacattgacggaagttttacacagtatattgttatgattgttctattttattattagttattatcatcaatgtcttactgtgcctaatttatattgtaaaaataggtatgatgcatgggaaaaaacatggtatatataaggtttggcactatctggggtttcagacattcactggggatgttgaaatgtatcccctacagatcaggagggactgctgtatcacaaaattcatcaggatttttagtatattcaccatgttgggcaaccatcactactcttaatttcagaaaatttatcatcctccaaagaaaccccataccattagtagtcagcctccattgtcctccaccatgcaatcctaggcaacacctaatctactttctctatatatatgaatttacctattttggaaattttgtataaatggaatttcaccatatctggccctttgtgtttaacttctttcacttaacatagtgttttcaaagttcatccatattgtaacacgtgtcagtacttcattcctttttatgggtgaataatagtctatgtataaatatagtgtattttgtttattaatttctgtctcaatttaggttgattctactagttggccattatagataatgctgctacaaacatttgtgtacaagtttttctgtggaaatatttccagttctcttggatttaaatacctaggagtgaaattatcgatactaatttttaaaattgagttgttttcttattatagagctctgaagaatataaagttttaaatgttgaatttacaggtgtgtgtatctcttaactcatataactccaagatagctctgtgttctaattttgatgtagatttaatgaagggtttatagaagctcatttgtccaatgcattctaaatattactaaataagaaaccaacttgtatatatatgaattgtttaaaatatataaaatcagctgcttcaattatttttattttgtcttaaatatttcttcagatattatttcttcctagaattcatttagccactgactgtaggagtatttgttgatactgtctttatgtaagtcaacacaaaaggtaattgtattgacttacataaaggcagtatcaacaaatattcgtatagtcgctgactgtatgaatatttaatccttaaaggagtggtaggattcagtgactgaatgaatagaattgccttttgtattgacctacaacatatgggggaataatttaacttacaattatgagctgtaaaatgtagttataattattttatgatatggatgtgattttaatatttttatggctctccccctttcactcttctcagaattcacatgatccctccactaaggattattcaagacacacatacagataaatctcccagttacctatggtgacttgaataaaaggtcctttgggggctgcctgttagttttttatttaggggatgcgtgatgtggaatgtcacaacactgtaagtaatggagccgtgctgtcatattgttactttcagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggtaagtgcatgggaaaccacaccagtacctgtgtttgccctgtgtgcttttgatccctctgcatgcaaatgtgttacccttaaaaggtgaagttgtcactttattctcttatgaaatccgtgctctcctgtgaataataggtttcttgaaataagctctattagatatttttacttaatgttagaggggaaaaaacccaccttgttttatggaagtaataattgtttatttagagttagaggctcacagctattctgctttttgtcattttaagccctattatggttagctttattgaatcctaaattataagggcattttcccttaatgtgaagttgtttctttctccatttattatacatacttaatataaaagctgcaaaagctctatggcttagtttataactaagaatattaggcttgatgatattacttttatgtcattagcttgataactgtgattgtatatgtagtctgaggttcaaatatttcttctacacaaaatgtgctaatataaaacttttcatttataaacattataaggaatcttatgaaatacgtctgaatctttttttgccctcaagtagttctgcttcagtactcttgaaccttccagttcaaaatctgattcatgcggagtgtggtgcctcacgcctgtaatcccagcactttgggaggccaaggtgcgtaggtcacctgaggtcaggagtttgagaccagcctggccaacatggtgaaaccccatctctactaaaaatacaaaaattagtcgggcgtggtggtgcgcacctgtagtcccagctacttgggaggctgaagcatgagaattacttgaacccaggaggtggaggttgcagtcagccaagatcgcactactacacttcattctaggtggcagaacgagactctgtccactcccaaagaaacaaaacaaaaacctatttcaatggggaagtctccttgtcaaccatagtattacatctgattactttataccatgccatgctcacatcagtttgacaactattatttctgatgtacctgtgaacacgtgttccattgtcttttgttgttgttgttttgttgcccaggctggagtgtagtggtgcaatctcagcttgctacaacctctgcctcctgggttcaagtgattctcatccctcagccacctgagtagctgggattacaggtgtgctccaccatgcctggctagtttttgtatttttagtagagatggggtttcaccatgttggccaggctggtctcaaactcttgactttaagtgatccacctgcctcggtctcccgaagtgctgggattacaggcctgagccaccgtgcctggcctccattgtcttttgatacatgtctctgcttgtcccagttggtcacatggttcttcaagggcagagattatattatctgtattgttgcctacgcagtgccctgtgtgcaaatcctaagtgaatactgactgctgtccttggaccttgactcaccgttatgaaactcagcattgaaaccttttttaaatccgttcttaggaactcttttctctgaaaacatgaaaaagaccattttgtaaaatgtcaacaaatgtgtggatctggatgaaggatacagagtctttctttgaactactctgattcttacaattgttctttaagtttgaaattattttcactgaaaagttacacaatttgaaaaacagatctttttggaatgagcttatttataaattgtccctgtgcatgaaaactcatggtgttttactgttgagttcttaagattcatttgttgaaaatttctgtttaaatacattgctgcttctatcttattcattgcgcaatacattttgtgacttggtaatgagtgtgaccaggcaagtatcaaaattaaatctgttcctttgactcactcttttgagcctcatgaggtcactataaatgttaattgataaaatatttagccatcatctgtattttaggaggtcatagaggactctaagtgtggatagatgctagattatttatttttttatgatttaaacaagaaaaagcctgacctataaatgctcacagttagttaacttatgcaatggtttaatttcagtagctatctaggctgtgcacttgagtaggtaacagtttatacacaatgaataaaggaggctttaaatgaaccctggtaatgagcaccagcaaaacacaggcctattctagagtttaatgatgtcttctgacatattttatcttaggatatattcttaccatagctaagactcttctcaatatttaatgaatattcaaacagtggaagacaaatgtaaatagaaatgtttaaaatctttcaaaataaaaatatctaagcacaggattacttatggcaaacagcatcaagaaagggtgctgataaaaatattaaaatacattataatgctttataaaatataatacattattactttagtgttgctaaaaatagtctcttttggctggtagaaagtaataaagaggacatttactaagagtccactaaaattcctttgtttaaagataaatatgtacatttatgtttagaatgtttcacattacggtaattcgcatgatttttcactcccttgctttgttattaaatgctcttaattttaaagtgttctctccattctatttttaaaaaagttccatggttttattttcagcaccttatagatagaagattgttagagatttagtaccttttactgagtttttctgaggcaagagaattttaatttttttatggtgttgtatattaatgattctccttttgtatgagtaaacagacatttaaaatagaaacttgtttggaaatggagagacgtttgttggagaaaatgactgtacagaagcatggcaaatcataacagaaaagttctggtggcatggtggtggcagtggtggtggtggtgctggtggtgcacagtctttgtgcactaaggaagatggaataaggagctccgtgtatctttgctgcatgcacaggatgtgtatgtagaactacttagctgacacattcgctgtttatacttgcttcatgtcttatgacaaccagatccaaggccatgggagtatttcaggaagataaagcagtttattctatgctcagtttaaggtgaatcttgggtgaattttgataaggataggtctaaagcacatggaagatgattaacttttgggagtatgctatgatacatgccattcttttaaggatggatgatgatttggatttatgtatctatgtttcattgccctgctgcaaggctgttaggatttattccccagcagaagccttttggcaagagaaaagccgattctttggagccctgcaggagagacaagctccttgagaactgagcagtccagctcatagagggtcttaaatgccatgcaagtatttatattttaatccagtggcaatgaagagaagtcataaaggatagtaacaagagtgatgcaatgggatttttgctttataggaatttagctgatggtatgaggaatggacttgaactagacaagagtgacagaagagaggcctgttaggatactcatgtagccatccaggctacaggtaataattaccagaaaggagacaatggcaggggtagtagatctaatgactcaatagtatacatagactgaggaaggggaaaggcagattgccaagtggtgttagagcctaagactgggaacatagaagaaaatgtcagagcagggttgcaagttagcgggaaatgtgtggggatggcaaatttcatctgttttgactttgttgaaatgaagcattggagtaacatccaggaggaattgcctggtatgcagttgtcactgtgaatctatattcagataagagtatttggccaaagatgcagaaactttattttttgcttttgtatgaaagcccattattgacttccaactagtttattagttcaagtgcatttattcttaatgtgcatgttcatattctaaaagattgttattcttttaattatatttaaaaatttcagctttacatttggcattaccaattaattgaaatgctctgattctttgctgggtaaaatcctgagttctgctgcctttctggagtggtgttgtcatgggtggctggttttgctctctaataatttacgttttaggattattacacttttatctcctatgtttgcttttagcctcattttcatcgtcttgttccatagatgcagactttgattatagattgttttagattttctcctgtgcccagctgcatgcttagcactgtgtttgaggggtgaatgcctatctcatggggacttcatctgctggttctaggacaggaattatagcttcatacttatttaataacaactttcttggcatataattcacatactgtacagttcattcatttaaattttacaattcatttgtttctagtctattcacgattgtacgaccatcaccacaatcaagttagaacattttcattacctcagaaagaaaccccttccctttactagcaatttcccattcctccccgccaattccctcccctctgaacaatcactaatctatttctatctatttgccaaataccttaacattttatactctatcctttgaatatgttctccacttttggctttacacagatatggtgacattgttagcctcaccagagggaggcagtgtagattctcagtatggacctgcagggaaaaaagatacaggcagaagtccacagaacactgcctgatgaacacagttctataagacccaataaagtcggcaaagcactgcttgataaacaccgttctgtaagacacaatataggactttaaatcgttgtaacatgaaggactaagaaaggcaaatgaagtaaaggaggaaaaacaaatacttgaaaatactgcatttcttttaaagaatcatgacaacattagacagaggtgaaattgcagcattagcccggttaccagtttgagcaggacactgataatgagcaacatctgggttctatttctggctgtgctctttgacccagtcatttaatcatccagggttattttgcacatctcctgatagtactttaccccagttgatatttgcaatgatgttcaggctgcagtagagaatatgtctcaagtgtgtgtatatatatacacatagaaccccaaaattatgtactggatttttatatgatataattatggcctcatatttcctattcataaaattaaaacagctttatggcaaatacaatgagatcatgaagatgctgtctaaggggaaatgtggcaatttggaatgttcagtagtcaattacagacttttaattttttattcacttagctgtttaattagacaaatcctaacctattccatttctaatggctttccttctaggcaggcagatgagaatccactggatcgctctgcttttagggtgtcttagtcatataacccctgcaagtattttttgttttgctttatttttgttgttttgttttgttttaggtgattttgggctgagatctgtctgggggtgattttttagcacttaatgtatgggctgttgtcatcagagtcaggtgtacccttctgctcttctcaagatttataacagggtctcctgttcactaattcacagagcacagctagagctgcatttattgggtagtgaacatatccctctttagagacggtgaatgctctgttctctcttaatagaaaccagctacagggcatgcaccgtggtggtggcagtgatatgttgaatccctgttcccaggggatgtccgctttctatctgcagctttaatgtttcacttaatatcctctttggctactgagcgcactcctctcccgcagccggcagcgcttggctgctcgacaacttccttcatttctggccatgccgggctgagcaagtgctgcctgtgagcatctgctggggggctttctctgtggcgtttgtctgtgttttttaaattgagaagttgaaggaataccagcctcctttttcctagaacctaaccccctgtatctttcaaatgctttcctggaaacgagcatgctcagagaactgacaaatcattgtccagtgaccgggaggaaatgatcgttgctcttcatttataatgcaaattctgaggtgtctccagaagtgtggtaaacttaaaatgatggctgtggtgagaacgtctctgcagaaagttgtggttttgttgcatcgcttacaaaggatggcagtttcttctcctcggtatcagaagctctgtaaggtaactgagtgattgaaaataaggatctcgggtgtctgacagttctactgtttctcaggctctaaaaactaatctttcaggttcttatcaaggaaagattccctttcttagtaactgattgtgaaagctgttaaagtgaattgcataattacattttgtttaaaaatctaaaacaggttttagttttagtacatagtttcttttgcaattgacacaatcttgtcttctgagatgggctagtgaaatgtttggagaaaatatgatgcaaaactactacattcattaagacctgttacctctctggtactttgcagtatcttaatagtgaatggcacattaatcttatgtaaattttagtaaaattaaaagaagagtgccaaataatctttcagtagatttttaaaaaatgttccattgttttatagctaattgctttttcaattaaaacaattaaaagacattttaaaaaaatgatcagactgaatttcatcataaaacatcccctatattcttaaatctccatatattatagttacacttgaagaatttaatttcacttggatggatgaattaagtagacttactggagacaacttgtttgacagttgcaaatttctaatactacgtcatcccgaacataaaccattcaatcagctgctgtatttttttaagtcagctgttatatgtttgatcatagttttgttttattcaaactatgttgatactatgtcattacttttgtcaaaattagagtgttttgatataaaaggagagagttataatagcaatttttacactaccgcagtactatattcctccttcctatcatatttttagtaccgttctcaagaatgtatcttgttgctctgttagctgcccaaactcatttgtgatcaaaacaactgcctctaagaaaatattatttttctgatgatatacagtatggcatgtccaggcatctagatgatgcttatatggcagcagattgaggtgggaagcagtattccattaactttattatatcacactgtaatttcttacaatttggccaattagatatattgctgtctggaaactttttttttttccggaagttttgggagacagattcaggtagtggggtattcttttcagaaatacttacaagagttttatttgcataagaagttaattaaaacttaatggagcttaattaattcagttacaaagatttgtaaacctagttatttcaatgtgttgtgttttgctctacttcagtggataagtttattctggtaaaacatttatgtttttcatgaaaaggcaattttgataatagataagaaaagctcattcactaattcatgctatttaatttttttaactaccagtatgaatgtataaagctttcttttttttaagagcagggtcattttcctgatccgtttgtgtgtgtactttcacaaaaccaaatatttttctaaagtcgaaggtattaagttagtgcaaaagatgaaacagcagaagtcaagtattggagaaagttgctaattagtttgctaattctaccgcaaataggcacaagttaagtcactgaagtcattggataaattaccatcagaagtgctttttgggaagacttcttgatttataatttcctaaagataccatgaaaatttaaatgtttagaataaatgttacttatttcatttagagaattaaaatttacattatttgctgttgaaatactatcttccacgtattctttcccatatgcaaaattaacaactgcctgattaacgcaatgagaaatgtacaattccagtacattgcagcaggtgtcagtataaggcagtgacataggagattttgcctaaagaactggaaatccagattaggaagcggcacaattactatgaaataaataaactagtaacagataaattttatttgtgtggttatattttgaaaactgatctaagttattgagctatattaatgtaatgaaatgaaaatttagttgtagacttaaatattaacagttgccatctcaaatattgatagaggtagctataccaaccaaaaatacttaattgtattttaattatcaatagtccatgtgtcatacctaaaagtttaaatgggtttgacatttatttgctttaagacactgtaaattcccttcccattaaattgtaaatgctgtcttgactttctccttattcctcccacattctctaaatttagtttcttagaaaaaaatgctttaagtttgtgtatctccataaaaatacagaaacagtctattgtaaatacatgtagagaccaaaatgaatgagaataaaatgtggcataatctgagggaaatttgactatttaaaattcatattggcattttgaaattcagtgtctgaatatttttatcttcttttaaattcctcttgaggatcattctttttatgtattatttgtttagtcttttgttagacttttccctctgtggcagctcgtcttttctgcttattttcatacttctcttgtttgtcagaagatagtgtgtgtgttacacgagtagatacttgtgtagaatattctcattttgtgggttttcttgtatgtttcaaagagaagggaggaatgaaaaaaggcatgtcacagctctcagagttaaaatatactcccctcccacaatctatttacacattcacgtgtattttttgcctttaaaaatatttcttctcggttatacatccaataaaatttgagcaggaagcaaaaacgtaagtgctgcttacttggagatataattagcagcattgaaattgccctgatgacctaaaatcaccctacactggatgctaattttctcagatatggttttgtttgcttagtttctttaaaattttcatgcctataaaataatttttcttttagtagagcacagtagaaaaaaagctgatgtaaatgatttgaaaaataatattgaatttaatttgtttttattgttacgtgattactttggggtgttttatatcatgaagtctttagattagaactgggttatttgtgttaatgttaaatcagaagagatttttgtaagtcctccttatttttttcttagtgccaatttctgtaaaatatttagcaattgagggcatggtaaaaagcagtttcctgtaaagtagattgggatatgaacattatagaaaaatgagaaaaatttaaaaatatttagtgctgtaaattgactccttcgtgactcaagcattttagaaaatgttgatttaagtgatataacttctatttgcttgaatgtatatgtaaatcattttagtttaagtggttttagtcaccccccaaactattctgatcatatttcttcagcaaaaatcttttaaacatctagctgtatatagatgtgtattcatttaaaaattatacatatatgccatggtgaaatcatgtattaaatattagtagtgtataattttgttcttactttctactgttgcctttttgtaccacagttgattctttttctctatgtggtatacacaacacgattttggtgactagtcatttacatacagagtgaaactatggctattcttagcctggccttctagggggcttgagctttcagtgtggtgctgatctcaaagtcttccccggaatactgtgtcttctgtggtattaaagcaactacttctgaatattctgtgaaaaatagaagagaccagaagattccacctgggaagtcacgattgaccagtgatgtctacaaaaggcttgctttgtggctgtgtgtgtgtgttttcatgtgtggacgtggacaacacagaactatgtagttgcttgtagtgctaatgagtaaatagataatgaacatgaaggcacattaatctctcagcaggtttttatgttcactgatgaagtaaggtcacatattatttttcatctacatgtacagctccctgtatttagaggtagttaaggttgagtatgtggttttttagaagacactgaatggagtggtgtattttcgaccggttgaattttgtattttttactctcaaacatttccccacctttttttcacaggagaaccctgctctccttggacaattaaatcctgaagtgatccagggcaatggagatttactttaacatgatctgattgttgagatgtgtgtattttaaggtcaactcttggattccctcagtttctctcaataaccaactcatacatagattgtttgaaccatggagctcagagtcatgaccctctagtctgcaagttagaattcccacttgatcatatgagttgtctcttcttggcttcatgagaaagtcttggttagattagtacagaaactgtgtgaaggttgaggtttaatggagaaaaatggcgtatgtagatgggtttgcctccatctaaccctctctatggatgctgtaggtgtgtttcctgggagctgtatggatacccacacagactactttctctactctgcgtttgtttctgcacttcctagtcaggtcaagattacagacaaaagtgagacgggatcaaggagaaaacacctgcacccctgcctgccactatcagacatgattcctgtggcttccaagagcacaagtgccattttagaaagctcttggacctctgttttgctgtagttccccaagttgatatgtgttgtcaaaattatgtttttaaaaagttatccaattaactaacattttcttaatcagaaaactcatgctatcaatgacttggataaagtcaatataattagctaaaaacagtataattagatctgatgcaatgctttgtcactcacttaaagaataactaatacattctataaggtagcattttaaaattcttttatagccaagatatcattatcattggtgtatgtctagaagtgtaatactagtacaaatccggaacaaatagaaggtccttctgagatggagttgaagtagtattaaggatacggataaaaggtctcttttatttgtagagtattatttgataattgtaacttaaagggttgatgatttgtgttttcctagaggcaaagtttattaaatttcaagtggaaatttcctagctgtaggtactgctagattttaaatgtgcagacatagctccttcctcttactcttaactgtgatcactaccaacttctcttagtatatttggtagtttatttttagttctctaaaataagtaattagtagagttcctaccatagagataaaagaatgtagaaaatgttatgccttggtagctttctcagtttcacaaagcttattcatttctgggcgaggtaaatgagtccaaataattgaaattggaaaggatgtgaagtgcatcagagggttgcttttcatttttcatcttctagtttgttcagttctgtggaactctaaaaagattaatttataacaaagctcacttataaaagcagacagtgccttttagtgcttaataaataataggcttatgtgaaagtatggcttcataaagttaagcaagaattttggaaaaacatcaaatggaagaagatgttgaactgtttgcacaatagacaactattttgtttttattttaacagaattgagagaaaaatggctgactacaacaatagaataactgttagctgttatgatgggaaaatatcttgatactgctagtacagtttccttacatttttagtattttagagtttacaatgtgttttctcatatattacatcattaataaatgtaatattaacaatattatattatcttgtgtccttaagagatagataggaaagaaatttgttttgcaagtcagcaagtgaaggaacatgccagtagttagttgctcagctagtatgcggtgcagcttgtgttcaacatagattttctgcttcaatagccagtgtctctctacctgtaattttagatagagaatttttggaattatattgggataaaatgggtcactcagtatagaagatatagaaagagagattacattaactaagtaatagatattgttttgttctgaattatttccatatgcatttccttgtctaaagaaatttcacctgcagtctcctttaaaacatgagctggagcatgagaacattccatgttcctttaaaacatggaattctggagaatgaggagatgttggaaatcatctgattcaaccatttcattttggacataaggaaacagagatagtctataatggatgttttattgctgacagctttttttttttctttttttgagacagggtctctgtcacacaggctggagtacagtggtgctatcatggctcactgcagccttgacctcctgggctcaagctatcctcccgcctcagcctctcgagtagctgggatcacagctactgtgcatgccaccacaccgggctaatttttttgtattttttttgtggagacagggcctcactatgttgcgccggctggtctcaaactcctgagctcaagcaatctgcctgcctcggccttccaaagttcctgacagttttgagcaggtggctatgtacttgttttcctagaagtttaaaagtaaggaaatatattcttttcaaaactatttcgatgttcgatgttcaagtattggctatataatgttaaggaaataaagatttttaaaaatgagttcattttgcactttgataagaaagatggattgggtcatttccatccatattaaaatagttggttctggtttttgatttataacttaatttggtttgattcttaacagtacaaacgttaaattatgtgttcattgaacccagttctccatacccacatgtagttttttatcattatatttaaaaggacataatagctccctaagaaagaaactgaaaggagtcaactaacttaacagactgagttgtttaaaataagaaatatgtatatatttttaaaaaatttaattcaaagaacatgtattgaatggctgtcatgcatcagagatatgtgctaagcagcataaatgtaaaatgcagtgttgcattttccatgggaaacaaggaagtacaaatatgttgttctgaggaattttagtcgttcacacgagtctagcgtgagactaaattcaaacagttctggctttgccacttaccagttatgtaaccttggcaaatccttccacatctctgtgtttcagttcccttttcagaagatagggttggaattagtctctctctctctctcaatctacacacacacacacacacacacacacacacacgcacatgcacacacacacacacacataaggttgttgtaggagttaaataagttaatattgataaaatggtaaaaacaaagcctggcacatatctgctatgtgggttggctactgttgttaccgttaccactattggtaggattattctcccaccttgattgagtgtggatcaaatgagatgatccacctgacatgcctagcacagtctcatgtctcttggttgtggtgatggcatcataatcttcattatctttatctctgaagtaacccttacatcttaacaaggatgttcacattacagtcgcccagagaatttttccaaaggattcatgcccctgcagactttgactcactggggttcagatgcaccctggtcaccccactgcgaagatgccataaactcctgctttcaacagtgaaggagaaaataaatctttgaaattttccctggggttgttattttctctgagtctcagcttgaggaaatgcaagaaaaaacttcccttgaccagtggggcttgtgatagaagatcctgtaggatgctcctcaatttatgaagccttttctggattatagattaggctctgagatggcccctaaaaatctagttaacccacaaagaaactgatataatgctgattgacataaaacctcatattaaaaagaatcctattccattgccagaaactaaacaaagcaaaggaaagaagtcgtctttactgtgagtgatacaggaggaaaaacaaacatggttgcttagtagaggatggaaagaaatactgagaattttaaatgtacttctggaaagtatacattttaagaattatgctttttggtgccatcagttttgagtctaaactcaccccccaaaatccgaatttagtattcttggtataaatctagtattaattatagccggaaaaaaaaagttcttgattcttggctcaaaaattttataaaatgaagaattttcctttttcttcagggtaaatgttgcaagagttaaagaggtagagaaaagggggaacttttttagttgaaaacattatctgattgtgtatttactctgggttcagaattttaaaagtctagagtgtagctgcacctaccctggcatcctgcaggctagggtggttgtaatatagaagtacgggaaatgcaatttgctctgtagctttattctaggattttatagccttccttttacactttacacatcgtgaatgctttgtaggtcatgaatgctttttttatgtcttatattgtgacttttttaaaacaatgtaaataaaattctattgagtggctgcaccataatttattcagggaacccactatggttaggtaactaggttgttaccaatgttctcatgataaataattctatgatccttatacatcattaagtgcatcctgattatgtccagggtacgttattagaatagcataactggaccaaaaggaccagaacaatgaaaagctttttaaatttttaaatttttttttttattttttagacaagagtcttgctgtcaccaggctggagtgcagtggagtaatctcagctcactgctacttccacctcccaggttcaagtgattctcctgcctcagtctcccaagtagctgggactacaggcgtgcaccaccacttccagctaatttttgtatttttagtagagacggagtttcaccatgttggccatgatagtctcgatctcttgacctcgtgatccccctgcctcagcctcctaaagtgctgggattacaggtgtgagccaccgtgcccagccaatgaaaagcttttgatatttattgccggatttccatcttgcaaggtagcacctgtttacataaccactaccagcttgaatgcctgatttcttgtatcctcacagacaataggcaataccaattaaaaatattttatgaagttgttagatgaaaatcataaccctgttatagaatataaacggaaacctagtcaagttgaatgatttacctgtgtgggatcaaatattctatcccagaactgtctgaatttcagatactgagaacccagtcactgtagtttctaaaatgggatgcaacaaatacagtataataaaactagaagttgtttgaacacagaagaaggggcagtaaaatctgaatttaaaatgtcagagaagtgttagtactaatatggatcttgaggagtagatagaattttagtagagcagaaaactctgcgaatagactgaatgagtaaacttgttaccagaatgcaaagtcttgactgggagctgtccacgttcttggcgcaatgaacaaagaattgaacaaaatgcacaaacaaagcaacaaaagaatgaagcaatgaaagcacagattttttgaaagaaaagtacactccacagagtgggaatgggcttgagcaggtggcccaaaagccctgattgcaatttgctttagggattttattaaactaaaaaaatttggtgacacccctaggtacccttagaggcctccaattggttacaacaccctatatgaaagaaggattggcctgtgaccaatcataggctgaagtgaagccttggcttgcgaccaatcagaggctgaaggtaagctttggcctgcaaccaatcagaggcatttcccatttgtaggctagggtagagggattttgtaaagaggggagtctctggcctcttctcacttgggcatggagagatggggttttccttttggcccaattccaagaactcagccatgacttggccttaggctgcctgtctccagaccctattcttctgcctcagacatggagcacaaaagtatgctgattgtattcagagaacattgggtacttgtccatcataaatgtctacaaagttcattcatttacatttttatattaataaaaaagttgcccttttgattgccagctatgtatgccagatctttttgactgtttccaaaatttagttcattttcaaaggaaaaatatttgtgaatattggagatactcaaacacagacagcatttccaaaaaggaattctaaaaaagaaattgcataatatttgtatctttaaaataaggacataattcttcagaatgcctcttttaaaggaaacagccttcttttggatgtaagtcagtttggtatgggagtgacaaaaatgttatacttttatgttatgacttagttgatgagggaattacacaatatttcaagcaaaaatgaaaaataattcacagtagaagtcagtctgtctagaattaaattatagatttgtagaacattagagtttatggaaattgtagaaatgaccaatttccttattttataaatagggaagcagtgccttaacatctatgtagagctttgctcttaaagtgctttaatatattttttttgtgctgcccaaggtcacacaacccactggtactccatatttaagctcccaggagattactgtagtatctttcactacatcttatgtgcatttatttttgtggaacttgtatttaactttgcctggtactataattagctatttatttctttttgaccttctgaattgtaaactcttgaatttgggactataccttgttttctagttctgtggacaaaacagtatttgtaaatattgaataaataaaccaaatttcaatttttccttagatttaaaaattagtacagtaaagcagaagttctatatactttgactttagtttttttcttttcaaaatagtcttattgatatataattcatgtaaaagtcacttttaaaatgtacaattcagtgcttttggcatgttcacagggttgtgcagccatcactataatctaattttagagcacttttgtctcttcttaaaaagaaatccctcacactcatgagcagtcatttcctatttcttcccaccgcactgccccagccctaggcaaccctgaacactttctctttttaatattagattgacagtaagattttgaaaccatgggattaggtaaaagtcatggaaatataattctaattcattgtgataaatttactactttatcttagagaatttgatagttttgagttttcttagtactatctagggcagcttatgttaaatgctatgtaaatcatatctataaaatatgcacagtaatgtacttttaatagaaattatttagaatacagtacaagtaaagtataatgggaaaaatgctgaatttggaatcacaagatctagatttgattccttacttgtttgatcttatgtaatacccaagtgacatatcagtcctcagttttgtcttctagacagtgggaataatttacattccacatattttagaaagctgttataggaccagtgtattaatgtttatgaatttgctatgcagagctggagtattatggaaatcgaaatattaaatttcctatgaataaaaacaacaaataacaatcaatgacaatatttacctacatttgagtttctcaccatgcactgctgaaatgcgttttgaaaacagtgactaactcaaacttctgtgtgtctcaactgaggcggaagaatgttgaatactaaccaccttaggtctttctgcaatgcagggtcagttcatttttcttctttcctggggcacacagccagcttccatattgaggtacattctctgccagtaaaatcatactatttccaaacaacttagattcaaactggggctacataaaagggtccatgtcttcagagcaggactaatagcccctgagtctgcagcatctagtcaaatgaagtattttgaagtctttattcaatccagaattagggcagccataattttaaaaatctatacattagtaatcttagatgctgggaaggcttgaagaaggaagatctttcttgaatttcaataataattaaacattctggtaaatctcaagtggctttgcataatatgttttttgagagtgtgattttgataggtagtgaataacctgaattaatgaccataatgactgagtgctgttttgcattaattcttgaaacaaaacctagattgcttcattacatggcctgtctttgtggaagatccttatacggtgtggtggtaaagaaaggggaacatttgctctattttgaagtaattgcttctaatggaagcctaatgacctattatgcttatttctaaaagctgagcagtaagcttgataggaagctagagaaagattggagaaattatgtcatataaaccaaaatttcaggaagttgcatgtggttgagaatcagtacctcattagacaacttaataattcaatagtttacttatgccaaatgtcatccttactttaaaagctggagtgatttctagaaatgtgtccacatccttgcgggttagggtacggggcagcttctggccagctgtcgtccaggtgtcttatggtttttccgagtttcatatgcagatcaaacagggcagtgagagtagagttttcctgtgggtattgaaatggtaacatttaataacctatggtgactttggatattctcaagtttagcttcctgattttttcaagatcaggagacagaagcttaaaagagttaatcctataggattaattagtagtggcaatgaccaaactgcgatgatatggatatattccatttttgggtttcatgggactgtactaccaaagtgtattttatatgtttctaatttggactattgacatcaaatgaatcaaatagttggagtaaatgatttacttgaaggtggttccaaaaattaattaatgaaatgtatctctttagataaaacacatatggtaacatcttaacagctgttgagtctggttgtcagtatatgggtatttattttactcttttttcaattattctgtatgcttgaatatttttatgataaaatgtcttataggtaacaacaaccctattctaataaaagcttgtcagattacttgagcccttgcatactttactgttgagcatcataaaagaacttgaaatgcttttgtttttggattcttcatgtttcaacttcagatggtgacaagtgcaaaatggcttaaaagtgccttggctaggcacagtggctcacacctgtaatcccagcactttgggaggccaaggtggacagatcatgaggtcaggagattgagactatcctggctaacatggtgaaaccttgtctctactgaaagtgcaaaaaattagccggatgtggtggcacatgcctgtagtcccagctactggggaggctgaggcaggagaattgcttgaacctgggaggcgaaggttgcagtgaaccgagattgtaccactgcactccagcctgggcaacagagtgagactgtctcaaaaaaaaaaaaaaaaagtgccttaacttacctggcaataaacatttattgagtctgcagctttcattcatttagctcatttacatttaactgaaacacatttaaaaattcattttttccttttgcaaaagctaggcatgcctactataaaagtttgcaacttttcaaagcatgaaatatgtagagttgataccctcatttattatattttactaattcctgtagagatgagcaacaaaattgtcctttatgaaagctgtcattctctaaaattcgatatagtaggaaagttggtgtgtaaccttatttaacaaggcttgcaactgataacttttgttgagacaggcatgggggcccttcttttggtgttgacataatatctttttgtctttcttattcatcaaggttagtagaaagttgtcaagtttctattcttaagctctagaactatcctggtctttatctatgaaagaagcataaactttgtcaaaggaatgatttactcataataagtcaatgtgaagcccattcataactatacctttttgttttgcttttctcatttctctgagtcattacttaaagctggtgctttataatttgacttaatcacatatggtgtgattcttttagcacacatactgttgtttttaaatcattacattttaaacttctttatatctagaatttttacactgccagataacctgaattttcccctgcttatctggtgaaagaatgataggaattacaatgtttgaaacatagggttgttccttatttactgaaaattatatggaacaacatatatcattctggcttccaaggatgaatctgtgaacgaaaagagtcaaactctgtaatatttgaagagatttattccaagccaaatatgagtgaccatggcccatgacacagccccaggagatcctgataacatgtgcccagggtgatcagggtgtagcatggttttatacattttagggagaaaatagacgtccatcaatacgtgtaagatgtacattggtttggtccaaaaaggcgggacaacttgaagtggcttccatgtcgtaggaggattcaaagattttctgattggcagttggttgaaagagttcatctaaagacctggaatcaatcgaagggagtgtctgggttaagataaggggttgcagagaccaaggttcttattattgcagatgaagcctctagttagcaggcttcagagagaatagattgtaaatgtttcttatcagacataaaaacgtaccagactcttaattaattctctcctggatagggaaaaagacctggaaagggaaggggattctctatggaatgtagattttccccagaagagacagctttgcaggggtatttcaaaatatgtcaaagaaatatattttggggtaaaatacttacatttctttcagggcctgctatctgtcatgttgatatcttgttactagagagagtctgttttgtcaatcataaggtcgctgtattaatgttaatgctagtcagctgtgcctgaattccaaagagaggaagttataatgaggcatgtccaaccacccattcccatcacggcctgaactagtgtttcaggtttactttagaatgcccttggcccagaggagggatccattcagttggttgggggccatagaattttacttttggtttccaaatcagaatgaatattgctagactagaaataactcaaaggttgttggagaattttaaaatgtatttatttatttatgacatctagtttgtgctcttgattaattgctcttgattaacctccctcgtctttaaattaaatcaaaattagcaaatatttattgcggtctaggagaaatctcatttaaggcacaaagcactgtgtaaagcagtagaatgttttctttactaataaaggacagaaattgaagaccaggaattaaccagcccatgtatttcctgatatatacctgatttagtacaggtgtatttggggaaatggggtggttggttagggctggaagaaagtgaggaagagtactcaattaagtagttctcttgatattattttatattgaaaaaatctttaagaggttaaacaaataattaaggtaattaacgaagcagtgagggacacactgggttggaggcgggaggttattattctggacatacctttaactgtgaggagtgaaatggatatgtcaactatgctgaaacttgttttttttaaatctctaagttgattttgtaaggtataaaaaatgttttttagaaaaacctctgaatgtcaaagaagtataatgacagcttgaatatgcatatacagcaaatcacttataattttgtttggcaaatgaaaatagatttcattagctttaaaatagcatttacacttttactcttggatatattaaaaagaaagtgcacattttgtaaaatgtagtagaaaggaaggaagaagaaaataaaacttaccagttaaccatactattcagaagggaatattattaatgtcttactttcatttcactcttcttttctgtgtgtacacaggcatacccccatcttatcacacatagctttactgtgctttccagctgtagcatttttacaaattgaaagtttgtggcaaccctctgtgaaacaagtctatcagtgttgtttttccaacagcatgtactttgtgtctctgtgtcacagtttggtaactcttgcaatatttcgaactttttcattattattatatattattttacccagtgatcagtgatctttgatgttactattgtaattgttttgggcacctcaagccacacccatataagatgctgaacttaatcgataaatgttgtgtgtggtctgactgttccatcaacacaccattcccatctcacactttccttgggcctccctattccctgagacataacaatattgaaattagaccagttaatatccttacattggcctccaagtgtttaagtgaaaagaagaattgcacaatgctcactttaaataaaaagctagaaatgattaagcttagcaaggaaggactgtccaaagtcaggataggtcaaaagccaggcaggcctcttgcatccaacagttggccaagttgtgaatgcaaaggaaaagttcttgaaagacatttaaagtgctactccagtgaaaacacaaataataagaaagcaaaatagccttactgttgatagtgagaacattttagtggtctggatagaagatcaaaccagtcacaacatttccttaagccaaagcctaatccagagcaatgccctaactctcttcaattctatgaaggctgagagagttaaggaagctacagaagaaaagtttgaatctagaagaggttggttcatgaagtttaagaacagaaaccatcttcataacacaaaagtacaaataataagcagcaaatgctgatgttgaagctgcagcaagttatccagaagatggagctaagataatagatgaaggtggctacactaaacaacaaattttcaatgtagatgaaacagcagctttcaattagatgtcatctggcactttcatagctagagaggagaagtcagtgcttaacttcgaagcttcaaatgacaagactgtcttgttagtggttaatgcagctggtgactttaatttgaaaccattgctcacctaccattccgaaaatcctagggcccttaagaattatgtgaaatctattctatctgtgctcaataaatggaacaacaaagcctggatgacagcacacctgtttgcagcatgatttaatgaatattttaagctcaatgttgagacctactgctcagaaaaaaagattcttttcaaaatattactgctattgacaatgtactggtcaaccaagagctctgatggagagtaatgctattttcatgcctactaactcagtatccattcttcagcccatggatcgagatgatattttgattttcaagtcttattatttaagaaatgtttcataaagctatagctgctaaagatagtaattcctttgatggatttgggcaaagtaagttgaaaagcttctggaaatgattcactgctctagatgctattaagagcattcttgattaatggcaggaggtcaaaatagtgacatttacaggagtttggaagaagttgattcctaccctcatggatcattttgcggggttcaagagttcagtgaaggaaataactacagctgtggtggaaatggcaagagaagtagaattagaagtggagcctgaggatgggaatgaattgctgcaatctcgtggtaaaacttgaattgttggaaagttgcctctaatggatgagcaaaaaaagtggtttcttgagatggaatctactcctggtgaagatgctatgaacattatggaaatgacaatgacagatttagaatactacacaaacttagtaaagtagtggctttgagaggcttgagaagaacaaatccagttgtgaaacaagttctaatgtggacaaaatgctaccgagacatctttcatgaaaggaagattcaataaatggggcagacaggaagaatcagtgaatggagcagacatcattgctgtcttattttaagaaaatgtcagtcaacccttaactgagcaaccatcaaatcagggcaagaccctctaccaacaaaaaggttatgacttgctgaaggcccagatagacaatcgttagcatttttttttgcaataaaatattttaaaattaaggtatgtacagtaagtccttccttaacattgttgataggttcttggaaactacgactttaagcaaaatgtcatataacaaaaccagttttatcatgagtcaattgatataaagaagagttaaattcctacagcattttttttttatttttcttttgagactgagtttcactctgttgtcaacgaggctggagtgcaggggtacgatcttggctcactgcaacctccgcctcccaggttcaagcaattctcctgcctcagcctgctgactaactgggacttcaggcacgcaccaccagtcccggctgattttttttttttgtatttttagtagagatggggtttcaccatgttggccaggctggtcttaaactcctgacatcatgtgatccacccgccttggcctcctaaagtgctggaattacaggcgtgagccactgtgcccggcctcctacagcatatttctcatcacaaaagatcaccaaacttctaaataaagaccaaaatacttctaaaacattgaattgtaagctatgcatacatttaagaaagactagtaaatacaagtgagatacttatttacccagttttaggtgaatcaatgagtgatgtctgtcatagtggtgggagtagattaataaaggaacaaatgtttgcaaagtgaaaattctcagtatcgcctcctcccaccatgcaattccaaaacaatcacaaacaagcactactcactgaacactgaacactttcagtgcagactccatacagacaggggccctgactggaagcattgttttttctcatcaatattataatgaaagaatgttgaattaaatgacattgaatgaaacaacattattctaggacctgctgtgtattatttttcttagacataatgctattgcacacttaatagagtagtttagtgtaaaatagcttttttatgcactgggaaaccaaaaaaattgtgtgactcatttgctttgttgtggtgatgtggaacgaaacctgcaatgtctctgagatacgcctgtatgcatgtaaagcatctttgcacaaatttagaattgtcttttatagaattccttttgtttttatgaattttttttgtttgattctccctaatagtactttataagcatatttgtatttctttaactattttatgtcatatttttagggcagtggtaaacattctgttgcattttgtgttctggacaaatagctttctgattttgatcttataaggttgcaatgaattttttatgcatatcttttactgtaacaaatgattgtgttttgttaggataggtttctctgtgtatgtgctggatcaaaggttatacattgcgaggtggctttccagaaaggctgtcccaatgtctactcctatagcatatgagaacactcatctcgccatactctgattagccttgaattttataatttttatatctttgttaatttgagcattttatgcatcagtgattacttgtaagaattttttgttatatttattgaccctttgtccatgacaaattgtttatttcctttgaggtggtatacgtgtgtttgatgtttcaacacgtggttaacatctctttgatgttaagaaatgccaattactaggaagcagttctgtcatcgaagtaatgaggtatatttttccctaagtatttgagaacaaaatttcagtctttatcgtaaaaactttcgatatttcatgaaaaaagtagacattccaatgatttattaaaaatacctagtcattgatatatccattagttcctaaaaagaaagcagaagttacaagaatgggcccagcattattaaaataactagtatttttaagggaatttacttttatattttaattaattcagaaatggtctagtcaactcttgacacagcagtggtatatcaatactcagagcctcatatgatttccatcaaataaaatgtttgaattataggggtgtgtttgaaatatgatgctttccagaatatgaattctacctctgcatcctgtctccatttttctgcttccttgtaattccagatccactgggctttaaaattagatactgttttacatttgattatgttactttcgaggtctatgagcccttttcacatctaggcagtagaaacagtaagtcatatctctgagctcgtaaggtaaaccatgcatggccatgtcttacccagcacattgcctacacatgtataaggtatgccatatatgctgtagttatactccgtgtggccttctgaaaagccatataggattatgagagaaaaagaagagtgtgaagtggggcaacttccactcaattatgaatgatgttgcctgaagaaatcaattagctgattttaaggctttaaagaattaaaaattgcatgttgttactatacttcataaaattctaggccgatctgcaagattatgaaactgactttagactaatataatttgtttaaactcaggagctttgtataaatgaattattattattcagctaatggtgtgttctttctatcatgaagaagttgtctttttctgtcatgtgtctccccagtacaatatgtggaatactttgtaattttttttcaactttgaatattaaagtttgatagcataaaaaggccaggcgtggtgactcatgcttgtaatcccagcactttgggaggctgaggaaggtggatcacctgaggtcaggagttcgagaccagcctggccaacatggtgaaacccgatctctactaaaaaatacaaaaattagccgggcatggtggcaggcatctgtaatcccagctactggggaggctgaggcaggagaatcacttgaacgcgggaggcagaggttgcagtgagccgagattgcaccgttgcactccagcctgggtgacaagagcgaaactcggtctcaaaataaataaataaatgaaaaataaacgacaaaaaaaaatcactaaagtttgcaaatattttatctgagcctagtctcatatttatggaagaatccacttctcacgatatatcgttggcttccctgcagctctctgttgctattgagtaaaactctattgccttgaaaaagttattctaattactaatgaacacagatctctctttggaatgtcttggtcattaccccttggatcttaggctaatggtatcacctttgtaccaggtcataggaccttctcagttaatcctattttccatgacagttatatatccaaaacagcacggtacaaaatttttaacaaaattaaatttttcatgcatcaaaattttatagcacatctgccaaaggtttgctatacacagaatcacagccctgatatccagcattggcatataataggtatgcaagagtacttgatgagatgaattaggatagaatagaactaccagtttgctaggcagggcattgataatagaacttcctttgctgtttcattatgaaactccaattccaggtctgttcccactcttatttcattgtgaccgaataacttttccattaccattcagttttgacaagagataacctgtcaattatttgtataaaattacttagaagtgaatcaatattctgtttattgtgtcacctctactttaaaacgctacagtcctatttcttgcagctaatctcagaatctgttaacttcagtgtgggtgccatttttttttttttttggtatttcatgttttgtatctaacaactgaacttaatacttaagtataaagtaagaaatcttcatttcagattttcatagtataaatgcaggctaagtttcctgatatctgggatatttagaaattaagcagaagaaattattttgaggattttatgacagctttttactcttattttaaattctccttatctttctttgtaaatgtttgcatttttgagttactaaaaataattttcaagttttgtacctgtcttagtggcatttatgtccatactgcaaaaactctttcttggaaatttaatatagtatatgttttgtgatttttttcatgtcttaacattttaatttgaggttatttgcttgttataaccaaatggaaatatattctaattgtaccttgtcgacctgaaatgtgacaatgcagtgattggtgatcataaatgaacttagttttattcagtactatttgtaaaacaatgtttgacattgggaagttaaacaactgatctctttgttattttgatgtgatgacatcatcctacacaaaacacaacttcaaatcatatgcagcttatccatgcacagatgtaattaccaatacaaaccaaaagagagagcaagaaagagagcgagctagagggtgtctatgacctataataattagcattttcagtaacaacatctgttgctgacaatattggcagtagcacaggaaaaagcaatcattaaaattagctaatgctcagtttaagtgctacacaatgtactgacattttcaatattttcattagttttgcattttctcattccagtaagtatctgttttcaagtttgcatgaatgccttgtattatattaaaaatgtttctcagaccttctctcaaattgatctgggtcttaaagcagtatttccagtgggtcaaagtagcactgatgcaaactcttagaaatatagtatccaacactctcgaattggattctataaatttgatcttacataatttagatactgaattagaaattctccataacctgcaacacacattttcctaaaatctcattgtcttagctttcttgagtttttatcctggaatttctgtttgaggtgtaagtgccaatattaactttaaaaatttagtgaagtgtaagtcaattagaataattttacaggtgacctgcaattcctcgctcagagagagatctgttacccaggatgcttcaggtgaacgcctgtaaggaggagagaagtgaggggctgtggctccaccacatgatgtccttggcctcattgtacatcctttacccatttatttgctggtttgtaaatatgttaaagtgaaagaagaaaagtaattttctctttaaaggtaaaactcactagtgaatcaacatttgaatcatttactaagatacataaacaaatatggagtctgcaaaattgcttatgagaatcaatgttgagccagaaattatgtttctgcaaatattttgatgagctgaaatattttctatgtatgtcttgttaatcctgtctttaacaaactggatctctgttgaaccctattctgggagatagtgtgtactgtgaaagtgatttctgtggcccagtttggaaaattctgcaaattatgctttcctttggagctgcacgatgcacattatatttttaaggctatgggaagttctgctatttaactttgttcatctcaatattctctaaacatcttctcatgtcaatattttctaaacatcttcttttcttctgaaccaacttttaccatggaaataagtttaggaaatgctctttctgctataccaacatttcactgataatcttgtttgagaaaatttgcaaaaaggaccataggtttcactgggtaaaggctatttgtctgattttttgggcactttgaaactttgatgacattatcctggtgggcttgtacactagacttcatcagtacacttagagatggacactcatcatcatgatcaaaattcaccaaaaacttctgtataaactacagtacattttttcattattttggtagtttcttgtccaaagactgttgtgcccatgaatctgtataacttagaaggtcagagataaactggaagagattgaaacaagaacaaggactgatgaaataaccttgctttagagtgaccttgttttgttttatttgggactgtctcagcattagcattgaaatcctcttgctctgagaaacccctcagtcccagataaagcaggctggtcaatcactctactgccttctaacacaaatcttgtgttccccagatttcattttcatctctccacactaatgtgattgttaattttgtgtgttaacttggttaggccatggtatccggatttttgttcaaactagatgttttatgcagttattttttagagatgagattaacatttaaatcagtcaacttctagtaaagcggattatcctccataatgtgggtgggtctcatccaatcagttgaaggccttaatagaaaaagactgacctcctcagaagaaaagggaatcctactagcagatggcctttggacttgaagagcagctcttccctgggtctccagtctgctgacttattctgcagattttggatttgtcaagcctttgcaatcatgtgagccaatttcctaaaataaatctcatcagcaaggtggtagaatagaagttatcgggcctcattctctgttcccctctctcccagaaattcaactaacaactatcatcaggcaagaataccattgtgaataacccagaacttgagacatccacttgaccacagaactgagaaaagctgtggctgaacaataagcggaacagttttctttgactgtaccacccctcccccaagctgggacagtggcacacacagagaatttccctagacccatggtttctacagggggaaaagtgaattggaggaggatattccatttcctcgccattttgggtccctttgtgggagggagatatgtgaaggacatgaaaaagttcttgtgtggctattttagaaagtacttgagataggttttatctcagacatccacacacgacctctctatgtgctttgctggctgcaatttgtttgggtttgagaagagtaatttcatcttggtatctgcaacttttatactacaaagtaaaaacctatagtagttgcacaaagtataaaaagaaaggattcaaaacatacaaccacagaaaaccagaaaaaccacaaaggaagacagtacagaggaagaaggaaacaaaggatctaaattagaaatcaaattccaaaacggcagtagcaattcttacctatcagtaactgccttgaatgtaaatggattaaattcttcaataaaataaccaagactggctcaatggatggggaaataaagaatagattaaactctctattataaaaagatacagagtagccaaatggattaaagaaaaagtaaggtctaatcacatgttgcctagtagagacttgctttcctaataagcatgtacatagaaagtgaaggggtgaaaaaagatatttcacacacatggaaacccaaggagagccaggggagctatacttatatcagacaaaatagatttaaagtcaaaaaccataaaagatacaaaggaggctatcacataatgataaaaaggtattaattcacagacataattgtaaacgcatatgaatgcaacattagagagcacctaaatatataaagcaattataaaatgacctgaagggatacgtagactgcagtgctaagatagcaagggaccacagcatcccactttgaacagtggacagattatccatacagaaaatcagtatagaaactttggacttgaattgcagtatagaccaaatagacctaacagcacattccattccacagcaacagaatacacgttcttcttaagtgaacataaaataatctccagaatagatcagatgttaggccacaaaacaaaccttagcaaatgtaagagtattgaaatcatatcaagtgttctttcagatcacagtgggataaaaccagaaatcaataacaggagaaatcttggaaaataaacaaatatgtggaaattaaacaatatgctcctaaacagccactgggtcacagaaaaaattagaatgaaattttaaaatgccttcagacaaagaaaaatggaaacacagcataccaaaacttatgggatgcagcaaaattagcagaaagggggaaatttatagcaataaatgcctatatcaagaaagaagaaatatcatgaataaacaatctaatgttacacctcaaggaacaataaaaagaagaacaagctaatctgaaagtgaccagaaggaaggaaagaacaaagatcagagccaaaataaatggaatacagactagaaaaataaaagaaaaatttcaacaaaactaagagattcttttttgaaaaaaaaaaaatcaacagaccattagctagactaaccaagaaaaaaaaaaagacccaaagaagtaaatatcagaaatgaaaaaggagatattacaattgatactcccaaaatacaaaggatcataagaactgaacaattatacagcaactaattgaataacatagaagaaatgaataaatttctagacacacacaacctatcaagattaatcatgaagaaggagaaaacctgaacagaccaataataagtaagaagattgaatcagtaataaaaattctcccaccaaagaaaagcccagaattggatgactcctctactgaaatctaccaaatattaatgaagaactaataccaattctaagcttttctagaaaatcaaagtagacagaatacttccaaactaattttacaaagctagcaatacaaaagctagacaagcccaggcatggtggcttacgcctgtaatcccagcactttgggaggccaaggtgggagaatcacctaaggtcaggagtttgagaccagcctggccaacatggtgaaaccccgtctctactaaaaatacaaaaattagccgggcgtggtggcacttgcctgtaatcctagctacttgagaggctgaagcaggagaatctcttgaaccttggaggcataggttgcagtgagccgagattgcaccattgcactccagcctcggggacaagagcaagactttgtttcaaaaaaaccaaaccaaaccaaaccaaaacaaacaagaaaacaatagggcaatctccataatgaatacaggtgaaaaaaccctcaacaaactattagcaaaccaaattcaggagcacataaaaagagtcatttaccatgatcattgggatttatccccaggatggaaggatggcccaacatatgcaaatcaataaatgtgatacatcacagtaacaaaatgaattacaaaaaccatatgttcatcgcgataaatgcagaaaaagcattagaagcatttgaccaaattcaacaccctttcataataaaaactctcaacatattagctgtagagggaatgtacctcaacacagtaaaggatgtatagacaaacatttagctaacatcattcccagtggtaaaaagttgaaagcttttcctctaagatcaggggcaaggcagggatgcccactatcacaacttctgttcagcatagtactggaagtcctagccagagcgattagggaagggaaagaaattaaaggcattcttacaggaatggaagaaatgaaattgtctccatttgcagatgtcatgatcttctgtatagaaaaccctaatgattccactaaaaaacttctaggactgattaataaagttgcaggatacaacatcaacatataaaaatcagcagtgttttcatatacctatgacaaattatccaaatagaaaattaagtaaacaatcccatttacagtagcaacaacaacaaaatacttaggtataaatttaaataaagaggtaaatgactgtgtactgacaactataaaacgctggtgaagaaaaattaaagaaaacacaaataaatggaaagatattctgtgttaatggattagaagacttcatattgtgaaaatttccatactacccaatgtaatttacatatttaacacaatctttgttaaaattccagtgtcattttttacagaaatagaaaataatcctcaaatttgtatgaatccacaaatgattctaaatagctaaaacaaatctggagcaagcaaacaaacaaaaaacaaagctggaagcctaacattccttggttataaaacatgttataaagagactgtaatcagaacagcatagtactgtcataaaatcggcatgcaattccacgttgatccatggaacaagatagaaaacccacaaataaacccacacatttatagtcaactgatttttgacaaaggtgccaggaacacacaatgggtaaaggacagtttcttcaatgcattatgttggaaaaactggatatccacatgtaaaagaatgaaagtagacccctatcttacaccataggcaaaaatcaacttcaaatggattaaagacttaaatataagacctgaaactgtaaaattcctagaagaaaacatggggaaaaagtttcctgacattggttaaggcaatgatttttttaatatggccgttcaccagcaaaaataggcaaatgggattgaatcaaactaaaaagcttctgcacagcaaaggcagcaatcaaagtggagagataacctacagaaggggagagaatatttgcaaaccgtacatctgataaggggttaacagccaatatatataagcactcaactcagcaagaaaacaaataaactgatttaaaaattgacaaagtacctgaacagacatttcccaaaagtagatacagaaatgatcatcaggtacaggaaaaaatgcttagcatcactaattacttgggaaatgcaaagcaaaaccacaatgagatattacctcaccccagttagaatggctgttgtcaaaaacatgaaagataactggtgttggagaagatacagagaaaaggaaaagaactcatatattgtgagtgggaatgtaaattagtatagccattatgtaaaatggtatgaaggttcttaaaaaggtaaaaatagaaatacatacaaccaagtaatcccacttctgggtctttatatccaaagaaactgcaatcagtgttaaagggatatttgcactctcacgttcattgtagcattattcacaatagccaagatatggaaacaacaacaaaacatccattaacagatgaatggataaagaaaatgtggtatatctccataatggtatactattcatcctttacaaatggtgtaaatcctgtcatttgtgatagcataaatgagcctggaagtcattatgtaaagagattaaagtcctttgtaaagaatgataaatactgcctgatatcacttatctatggaatctaatacatttgaattaatagaagtagacagtagaactatggttatcagaagcttggtgggtgagggagggagagaaggaaggggaaattgttgatcaaaggctacaaagtttcagatagataagaggatttatggcaaaccaaggagagacatgaatgaaaagagtggctaccaaccaaatcaacaataatgtgttatgtatttcaaaatttctaagagaataaatttgagatgtcttatcaagaaatgacaggtaagcaaggagatgaatcggttaattagtttgattgatcatgccgtgttgtatccatgtatcacattgtatcccataaatgtgtaccactatggtttttcaattacaaaacaaaaacaaaaacactaaatgcatgttgtatgatttcattcatatcacattttagaaaggcaaaattatggttatggaaagcagttcaattgttgacaggggcttgagaattgactacaaagggacatgaaaggactttctagagtgttaaaaatgacctatatgctgattgtggtggtggtcccgctactgtatacatttgccacgactcatcagattgtgtacttaaaattttattttaaattaattatacttcaataaagctgacaagaaacccctccccaaagaaaactgaggaaggaacttataaaaaatagtgatatgattctcttgtattttgtaaaattaaatatatatacacgcattaaaatgtgttctaatgcatgtatgcaaacatatatattttcaaaacactattttattttatcttttcccatactaaaagtactcatcagattgtcattgatttcttctttcctcctctcacctgtgactgtgggaaagaatgattctctcattatgagtcagagccttttttttccttttctgaatttatagtaacgactcaacactagaagtctcagcagcttggtttgcctgtcattaattttaccaatggttgcaggtgtagcctgaaagaataggtataatgctggtatgtaatgctttctcctgcttctaaaaggtgctgtggggaggtgttgaatgagattcatggtggtaaacaagaatataaattcaaatattatcttaaaacagaaacagtaaagcatggagaaaagatccagctgattctagaaagagcaaatgaagaagaaacaagagtgaaaagagtggctaccaaatcataggaaaaaatacaggagtcccaggaccttcccccaaggacagattcctgggaaggtttccagtgagtttttgaacctaaccgctaggttaaatacatccctttagtctcagctcatcttcctaattaagtacaaattcgaaaataattgtaaggttttctcagatatgtgatggattacatgtcagttgcatcacattcttcaagcaaagtaaatgaatgaatgaacaagggaatgaataaacaaaaggagctagatattccctgaacattgcaagcttcctttggcctgtggtgcttccattaccagcagcacttcagttagaatgatccctatgaattaacttgtaaatgaggaggtcaaatgtgcttttgcacagtggtgttaaatatgtggatgaataaattctttcttgtactttgggctatggagtctatgtagggttagaaatataggctttttctaagttgttctcctcttaggaaagttatttacatgataattaaagaagtttagaagcaattcctgaccttaaacaaagataacgtgtagctttcaatatatgaacctttaagaaaccctcaacatttcaaaggcacaaattagagcattagtctaaataacaaacccccctctttcccgatattcatttatagggtataaaatacttgacagaaaagttgagatacagaaaagatgctaaatttcatgaaacattgttatgaatcaattacagacattttagtttatttaaaacagtttgtttgtaactgttcagaaatacttacattgaaagaatgtccacaaagcactagatctgtagtttcagtggagagtcagtattatatattataatattataaaatgacacacttctcaatggcgcagcttcctagaagtcatttcctatattacttggccataatcactattaattcagtttcataaatgattggacatgatcttttaattctgagccttcataaatatgatttcctctgtctgtttagactgttttctttaggagtccacttgtctaacttcagttgccatctcaggcattacttctcctgggaagcctatctcactgcctttccctttagacacctggactaggagtttctctgtgctcatatgataccctttaggactttttcattcagttagtttctgaatcctttagctcaaaccagaacactctaagtcacgcttgattgctcattttttcacctaccctatgtattcctatttgttgtacctcagctagcacattggtctctgcctccaaagtatattcttaatcatctgtctctcttcattttcatggttaatccatcaaagccatgccattttatccagacaaatggagtagccatctaagtgttgtttttgcttctagtatttgaagcaaatacataacataagttatggaagcaaatacataacatgacataaaccaagtcatgtcagttctctgcttgaaacaacccaaaggctcccattacacttataataaaatctaaaccccttacgctgccctaccaggtcctacatgatcaggcagggccatttgtctctctgacattttaaaaatttttaaccatcactcctgtcccctggcccactgtatttggctcttttctcttccttgtacataccaagccttcctaccacaggacctttgcactagtgtctcattatcttgaaacagttttcactgatctccatgttgtaactccttctcggcagtagcattggaccctaaggatgtacaatgttttatactgtgtttaattcagttactctgaattagataagcagtgggccttaacagcatacaggtgaaatcttgaataatttaacaagtattgattctgaactattgttaaataattcacacagttaattataattaccattattgcttaagaactacttaataaagcagggtttgtggctagaatttaaagacaatttgttggatacctttaatctatagaaatgtataataaagatgagagaaataactgttagcgaatcctttggattaagctacaagccattataatttgcagtagcaagccttgtaatgctaatgacaaatataagtcagtttgtttcctatgcactcatggatcagtggttacttcggaaatttgtgttttgtctgatagttttttttttttttgaaaagcccttttttaaaaaagattttaaaaataaaggtgaatttcacacaatctaaaattaaccaaagtgaacatctttggtagccttttactttgatttttatgtatattattatagttatttaatagcctctaaaaatacccagaatggcttaccacttccttttcaagaaaagaattctttagtctccccaaatcttatgcccactggctcattgtacagtctctctgaattctatgccagttccgctcttataaattgtgagcctgtgtttcttgtgccaggttctattccaggcgcaggtgggcatcagtgcagccagcccgccatagcgttctaccacctggtgtagaaatctgttaggaatacgggaagactatttgtggcctttattgactatcctttgcctttgaatccgtgagcagaaatctattattgaataaagtcccatgaattcaattcaaaccctgcattattgattttcaagcagaacttgtgccataatactgttatactgtagttggttacattcagggtcaatagaaatgatttcttgagatatcagtggataattttcattgggattagtcaggaatgtgttctgtcttccatctgtctgcacattgtgagttcttaatgatttgatgcctcttttggctgaattatatccaccataccatcactctggtgagcaaaaagagaagcattctgtattatacaaatgatatgtttagaaacataactaagaatgtttttaatcacccactggcctacccatccaatccctgctatcaattaactattctgaaaccatcatcatgatttcacatgatatttcctctatttaaagtagtgtaactgtaagtcacctcaatttggtatccaggtttgcgtttggcaataaattcctcttggcagcttcagcaagttatatttcttaatactggatctgctgaggttatgtttatggagaccagaactatgagtattgatttatgtttgctttgaacatcttccagtctaaagtcattgtggctatgctttgttgatgaactgcaggagattgcccttgggattgcattgagtgaacttggcccctgtacttcttcagatcatttcaggagagttgaggtggacttctctttaggaaggtgttcttttttttcagctcttcgtaaatgtccatcagtcttgctctgcatagccaagctgttgaagcatgatcaccttgcattgaataagctgcacagagctactgttctaccggggagtatgcttgcaggggagcataatctcaaatttactgctacccactcggtaccatgcagagcttgcttgggagttcagggaggattgtttgaaatgggcagttcaactattcttccagataatcaaaaaagccatccctcgatttagcagaacattgagaaatcctttcctttgactgtattgtattgtttctctaaaagcttgctttgattaaattgcacctgggtgtttaaaaagagaatacatgtgagtgttaatgcacttacattgtaattcagatggatcttttttgcaaactaaattaaaaggtacagagaccattcagagaagccatctgtcactatttgaaagttataattagggtcataatttttaatgtcattgtcatacattggaaaatggaagctttgggatatccactggaggttttacctctcctctacaatgccacactaaatttggaaatttattcagctgaaattttttcaagtttaaatattatatttactttttattgatgatactactaagtacagtgcttccttgagtgtattccttaataaatatttcttcaatttgtttgaatattttgccacaaaccagtctttagcttgacatttgaatttaatcttccatgtattaactaggcatgtacaaaacacatgcttatttattaggcatgcactaactgtactttggttacaggctaaaagactttagagttggttttcaaaatctatttgcttcaaagaatcttagtagtcagtagttaaccaagaaactttaaaaaaatgagccccattttaattttatttacccatctagctattcatttatttgacagatatttatttttgtgcctactatgtacttggcacaatgataaccttttcccagttcttttactctgttattattgtttaaagtttggaaattaaaatactctatattatatgctatattagttaaagctaagcatggtgctgtatcattaaacacaacaataacagccaaataaagttagaacacaccaaatatgttttatttacatgcaaatatttaaaatgatatatttaggtatagtatttaacaacttttatgttcctcacatcagaatttatattctttcaacaagagcctttttaaagataaggattaaattgaccatgcataactttgatgtgattaagctatttgatcttttaaatagaatcattcgattttgctgacacttagcaatagcccattattttagatataatttctttgtgatcatagtaagtttagagtcatagatgactccctcgaggtcttagtagcatattatgaatttggtatctatgtgattaaataagcacaacaaaattcatatcaaattggtcgataaacacatttttaatattgtgccagactatcattattaatttttaaatcaatatgtagtagtatgaccacaatgtcatattcattagtaaagtacagctgttttttatgccatcaggattatttggcatttaagcagtgccttctactttaaatgatgccattatcctttgaggactctgcctatcaatttggtcagtctagaaatgcaactcattatagaatgaagctgaatagttactgaagcagaatacaactttacaacctcttaaaccagaatatgggagaagcccaatttacctttaaaacttttgggtgtctacacagaaaaaggtgttaatgtgccttgtgaaatttctcaatggtgaatacattttttattctatgtgatttatttctggagatgtacattaatctttgtgaagttgctgtggaatttggttgggtttgtcaaaatgtgtcaaaaatgtgaaatatcccagttctactaattttctaacacaaagttagatggacaaagttagatgacaaagaagaagacaaagttagatggactccataggagagaagaggacttaaaaatgatgccttaatatctgcccccattttgaaagtgaaattttgcggataatgtttctattgcagttgagttagaaataaggaagcattttaaaaccaggtggatgattcaacactagaccacccaggaagggcattccttctgtaataggaaaggtctttaaacctggagtaccacatcacatgtaatgtgtaagtgtggatatttctggagctctcccagatatccagtgtgtctgcatgaatgtgtctctctttatcttttttgttaaggatgcaaatggagagttatatattggattcctcttgcatcactttagatgccttctgtttatattgagcctggcttatttggagttagcttgtaaatttaatgagatcattgtgatggccatgattgcagaatggaaaatgtcactactatgtgccagtttgcttaaatcatttttaagtacccacctgtgctgctaaactctccatttgcattttattggctactatgtttttgctccagagcgggttcctttaactctgatgcctgggtaaattaatcggggtgtgcatgccattgcccttttagcttctgctcctgttctaataaaggctccatctgcttaattggtagacttacaggcctttcttatttcaaaaaatcactttgaaaaaaagcatagcttctcaagggaaagaagaaccagaactcttgaaaaatgtattatttgggagatgttaaatttctgccatcactgtgctgagatgtatgtagtcaatgagaaacagcatccaagataatactggttttcttactactttttttccatctcttgtacatctctatgtctgtatttcatgaaaacctaccttctctaataaaggtgtggtgagctggggacaagacaactctggggatttacctgttatagacaaactctttactttttttctttttgatctggctgccttcttggtgatattactatgagaatgaggagggaattaaggattattgtaaagtgaaatagcagctttgaggtctgaaacactgagggagaagaaggaaaagaagagacatggtaaggattctaaggaggcctgaagatatctgggattcccattctttttgtccacagcatacttaggttggtcaggtgtaagtgaggagagcttgcatagtaagagcagctccagtgtggtattagtagggttaatgattgagtgtgtgatttacagtattggatctaagggtatcatgaagtcagactgtaaccttggacaaactagttaacctctttgggccccagtctctccatctacaaaatgagagtaattaatggtggtattacctcttagggttgttgtcaagattaaatgagctattacaggtaaagtgcttagaaaaacgcctatttgtaatattcatttttactaataactgttattaggagtgggaatagcaatttcagtgagttataaaacattgattatgaaccattttagagaacgatagttgttttattgctaatgtgaacaaaccatactgtatatgaaactttttatggttctccagagaaaccatgtatttttttctgactttgtacctatccttttgcttggatgcctttcttctagaaagttttactgatccttcagggcccatatcaaatgtatcttatcagtgaattgtctctcatccctttcagacagaatgagtttacgccctatcttgggctcccatagcacttatctcgctatgatgcaattctcttctcagatttgtatattctctccttgatggcaatgcagagtcttctcatagtgttaataataacatatgtagcctgtgtatgtgaaacaggtggatgttgctgatacttaattaggaaaggtatagtgattctcatcgtgttcacaagtcagactctccttatacctcaatcactgccgtatcttttaccttgcatatgagacccccagtataagagtgtaataactatctgattcatttgctagtaatgctgaagggaattgttaagctgatctgtttggtttatggaaaagatgtttattcttcctacgccttctcttttttctcctttgcctcctccttttgtccttttccacctcctcttcctccttgtcctcctttttcttccttctctctccctcttctcctttttttggttataattagtttatttaaagctcttgcttatttttgctcatccttaatataaatagatcttcattgtattcgtgacatgttttatcacattcttcatgaaattttaataaacagttgaatattttctattatttatacatatgtgtaatattactcttctcaaatataccattgaatgagtgttttatcttacaatagatggtatccatttttttttgttgtttttttttttttttttttttggagacggagtcttgctgtgtcgtccaggctggagtacacgatcttggctcactgccacctccgcctcccaggttcatgcaattaattctcctgcctcagccacccaagtagctgggattacaggcatatgccaccatacctggctaatttttgtatttttattagagatggggttttaccatgttggccaggctggtatctaactcctgaccgcaagtgatctgcctgccttggcctcctgaagtgctgggattacaggtgtgagccactgtgccaggctggatggtatcttctaatcaagaaaagatataagtatttttatgacatcaaatttaagaataatagccagttatatatttgtgggatcatgtgataagaaaaatatattggtttactattttagatggaataataatgtgtcttttctgatatctttacaagaatgttagaaatcatctgtattgtaatgttgttttaccttatccaaggggaaataaagcatgaacatttataggcttttatttataaatggacttttaaaatatgttttctcacaaagaggaaatttagctctagaaaacaggaaaggattgtaggaactcccatctgcattggaaagtgactgtcactctcgtattggacaatgattgttgcagatgatacctgtttcattctggatcacctttgtttttaaaatgagacataactaattaacagaagagcaagattattggcaactccattaatattagtatagagacagtgctagcaacatggcattttaaagaattacagtggcagttctcccaatcagccagatttcttccagaaaattataaaggaatctcctagataaacttattttcccactggtgttactttatcagcctaagtagtagctctgtaaatagaggactgaacacttgagtttgggtcctgattttgtaattagctgtgtgaattggatcaagtcgtttagattctctgggcctcaatttcttcatctgtaatatgagaaaggtcgaaataattgatttagcaatatattttatcaatcagaaatattagtgatgtcagtgaagcttgtgtatataaattcattttttcaatcatttaaggaacttagatataaaatacacctttaattcacctttggaaattttttacaaagtgttttatttgcaaatgacagtgatagtaagagttaatgtttaaggctattttgtaaatgactttaaatgattctaagtacttgttactcttaactacgctgtttcattcatacattgaaatagatcccctttggaacactggggaagattgaagattgcttttaatttcattatggcacacagaatttagtgaagaaaaatggtagtcctctttcagatagattactaagtcagctgtttggaagtcttggtgtaaaaatgtcttagagctttgcaagttacagagatagaaaatgtatttaattttaatatttctaattcactatttgctttgttagtatttagatttcagtgcttaaaaaattattcacgggattttttcccttcattcaacaacaggttctatagcacatcttgggaaaattatcctgcattggtaggggactgaaagacaggaagatgaaaaatacatgatacctttaataatttttgaattttgaattttggaattttagagggcagataaaactatatctctggggcaataaaagaagacaagtagaagaaagtaatcattgagagagaggaacaaagtcttacagtaattcagatttgggagattatttctatttgggaaaattggccaccaggtagatgttttatgctgggttcctaaaggtagaaatggtgggaaagaaagaaaatgacattgagggcagaggggacagcttgattagtggcttgggaatgggatgaagccagtgttgccaagtagtgtctgttaaaaggagcatattgggaaaatgaggacagaaaggtaaaattaggtcagataatacaggattttgagttcttgtcaaagaatatgaacttgagtctagatttgagtatattactgaaggtttttgagcaagggagggcattactgtgctttagaaagattaatctggccacaatttataatgtaatacagaaaagtaataggtggaaagaagagggagaccaggcacgacgacagtaagagcttagacaagagtcagccaacaaccgaagaatggaaatgtcactgaaaatggaaaagcagaagtagatgtgggcagtttgaattggtagaaaatagccactgatacctggttatcatgggtgtgcgagaggggagggaacatttggagatacttccaaaatttcagttcagaagatcagaagggtggccgggggccattaccaggaagagtgaagtgagggtaaggttgactggggctgggcagaaggggcaatgggaaggagatgaggagttttcggcttcattgacatcctggcagctaagtcagctctccagctagaaatgtgcagcaggcagtggtgatacagtactaagataggataggaagtcaggtctttacgagagcatttcagtaaatagccttaggaacttagattaaaaatcaatgcttgatgaggcagtgagtctagatcgtttttgacagtgaaatcaaataccatgaatacgttgagggagtaatgagacagagatttctttttagaaaagagagcggaatgtgttttctctgagggcagagtcagaagagaggacaagatgaccattataacagaggaaaatagtgcttctgaaattccatttcactttccacagcagtggctaaaattgaaattaaggcactctaatggctactaacattgaattattggattggcaataaaggccctaatgaagtactttcattaggaagaaaatatccacacgtctggaagaaatagtgtgatgccccctgtaaagaaaccagtgaatgtaacgtttcaaatatggagcagccacagcagacttctgtaattctaggtcaacaatgaattaatagaatcagtttcttgttaaaataactgtcttttgccttcatcaatattttagatacccttactggctacctgtcttatggaaagctatgtaattatactattttgagttggatttttatggtttatgctttccatggaaatttgatgggataatctgtttgtgaggtatttatctgcatatttgattccttaacttacctgcgacttcttgactttgttggttttcagaattaaaaacttgaaagaattttgtttattttggcatgtaaagaatactggtctaaaatcacaaccattagaattcatttagatttttcaaaggaagtggttgaaaagccggaggactgagataaattggtgccatgttcagtgagaagctggcaaatttatgaaggaatgtgctaatgcaaatacttatgaattgatttgctctacatattttccctagggccccttagtcctctattacttattagaatctttaccttctgtaccacagaagtaaacctaaagcacagccttactaagattgtttttgctttcatggggccagttgaatatatttcatcttccttttatgtgacaaaaataattgagaaacatcaaatgatgtttaattgttttgaaaacataaacaaaactggagattttataaagccttgttctaagcttgaaaagaaggaaaaaaaatcagtttctggctgaaaagtttctgttgacactggaccgatcaaacagttttctttcagacaatatttctatagctgtatcacagaaattaggggctgacagtgaccagtagtttattttcattgcctcatactttcaaagaaagcaaatatggacttgtatagttattaattaaaaatatgttaagcagtgatgggtgtttatttaaagaattcatgcaaatcttgatttacatttttaaactagtctattatctctcaccttttcagtttgtttaccatggtactgcaaaaattatttcaacaaacatctgaaaaactctccttatcacagggtcagtaataaatagtttgttatcccaagcatggctttcagagacgtctgcaggttttctgggcacaaagtatcactccaatctcctttaaatcagtttccctctcgcaactggtcaagggccagactagagaagaacccaaatgacattccgacctcaaacgtgaatccgctttcctccccgcctttctgcatttctccaattctactccaccttcatgagttagaaataattcctcttttaaggcagaaaaatcggtagatttggttacagtgggtttgcacatgtccacagctgcctacaggccactcagtttcccccaacactgagattgctgcctctgtagcaagtttgtgttgtggcttttcttttttcttttgagacggagtctcgctctgtcgcccaggctagagatgcagtggcacaatttcggctcgctgcaacctctgcctcccaggttcaagcaattctcctgtctcagcctcccgagtagctgggactacaggcaagcgccaccacgcccacctaatttttgtacttttagtagagatggcgtttcaccgtgttggccagaatggtctcgatctcttgaccttgtgatccacctggtgttgtggcttttcttatacacaaatcacagtctgcgtttgtgttacctgcatgtctcttttaggcatttcagtttgcagcctctggtttatatcttatgtctttgtagatcattgagaaataagatttgatatatacaaacaaaacactgacctagttttaggccccattcagtaaccttttgccctacctgtgtgtgtgtgtgcactacgcggcagatggggggttagggggctggggaggagcatggcacagtgggaggatgaatgggataggagggtggggtggggtagggttgggggtagagttgtctccaagaggaagatgttgggtacagttgtgctttgcacaagggcattacatctaaatggtgtcattcccattgtaaaggccaaagcattgtcaaagggagtaatagctgttacattcatttatcggtttactttctgtttcttcatgtgattcagataagaggcgtttttaataatattgataacccttatctttctgtctttgaattcattgctctattttgtaactctgttaatatgatctttttaaaaactatggtgaaatatacaaaatatggcattttaaccattttaagtgtacaaatcagtggcattagaaacatttacagtggtgcaactatcaccattagccatctctggaatttttttattatctcaaacggaaactctgttcccattaaacagtaattccccacttcctccttccctccaatccctggtaatggccactctactttctgtacctgagaatttgactactcttaccttatacaagtggaattatacaatatttgtctttttgtgactggcttatttcattagcataatgtcctgaaggttcatccaggttgtagcacatttctgcatttccttctgtgtttttttttttttttttttttgaggtggagtctcgctctgtcacccaggctagagtgcagtggcatgatctcagcttactgcaacgtccgtctcccgggttcaagcgattctcctgcctcagcctcctgagtagctgggattatgggtgtacaacaccactcccggctaattttttgtagttttagtagagacggggtttcaccatgtcggtcaggctggtctcgaactcctgacctcgtgatccacccgcctcggcctcccaaagtgctgggattacaggcgtgagtcaccttgcctggccaattttcttcttttttaaggctaattattatgcatatatcacattttgcttatctctttatcatctatgggtacttgggttttgacttcttggctattgtgaataatgctgctatgaacattggtgtacaagtatccgttttagtctctgctttcatttctttggggtctatataaacatgacgttttaatcagatattttattcacctctcaaagctcttgttccagtgttcacttcctttgaaaaatctgtatgaatatagtattcttttattattgtactcctgagaggagggtgttagccccttttttttgaaatgtgtgcagaactccagtgcttaaaacttccaccagaaaccattggtttctatcccacaagaattccactgaaatgcttctctttggaagccctactgagctgtttaaactgtgtttctttagaacttccaacattttcagcttttccttgactttttctctaatagacatgctttagttaaagctccttcattctgagttgttctgtgaactagatttcatggtttactaactcatatcctaaatagaatcatccaaaagaacgcatagaaacattctgttgattccattttggttggtatgtgactattaagggttcttacagtatggtgaatctcagattcctcagggggctccctgaggctgaggatgatagatctgacgattcacaactctcatctctttgggatacattggtcattgttacagagttaaactgcccgggcagataggaggttctggagttgagggctggtttaactgatcagggcatttaacctgtgtggcattggacctgtaaaatatgacaaatctttgggctggaggaataaggttctgcaactgttaaatttgattaatgattaccctgtgtatggaaaattgattattacattggtagctctctttatgaaattttcttttattctgagcatggccaatagcagtacttatccacattcttgaaaatctttccctttgactgtgacatacaaatcttcattgcttaccttgaatcttaatatcatgcgtgagcaaagtgttagcatatttgcttatttgctcttacttatttttcagaaggtgctacatagtttaaaaaaaaaaagcaaaaaggatgtgtagtaaaaaatctagtgtactgcgtcctaaatgacgcatcatgaccatagactgtcaccgcccttgcaagaggcagccaccgatgccagtttcttgtgtgctcttccagagatacttgctgtattgtcttttattttaaagtgtggcatacatacaggaaagtatgtaaaacatacatggacagcatgaagaatcataattaaaacaatcactattccaagttattgctgatccttagaagctgtctgtgcctccttgatcagatcccccttcttctctcaaaaagtaacctctattctgagtcttgtgattccatgtccagcaaggaagcagggatgttgcatcctaaatgcctaagtgtttaagtctagagactaattcctttaagcattgttggattgttcctggtgcttttgaactccaatgtagatgttgtcatgtaatcactgtgctcctcatctgagctgaaactttgcttctgctttagccatggcatgatttagatatgtgaaagataattccatctcctttgtaatttaatttatttgtgtcattttaggcatattgcatacctgctaatgtagaatggagatctagaatatggaagacagtttaaaacattttaaagcattcaaatgtggcattctggccgggcgtagtggctcacgcctgtaatcccagcactttgggaggctgaagcaggcggatcatgaggtcaggagattgagaccatcctggctaacatggtgaaaccccatctctactaaaaatacaaaaaaaaattagccaggcgtggtggtgggtgcctgtagtcccagctactcgggaggctgaggcaggagaatggcatgaacccaggaggcggagcttgcagtgagccgagatctcgccactgcactccagcctgggtgacagagcgagactccatctcaaaaaataaataaaaaatgaagtggcattctgattgggagttactaagcatatatattataggaaggattaacactcaaaaggagagcttagtcttgttaattttcatgctttgctgagggcctgtgtattagcctgttctcaccctgctaataaagacatacctgacactgggtgatttataaaggaaagaggtttaattaactcacagttccacatggctggggaggcctcacaatcgtggtggaaggcaaaggaggagcaaagtcacgtcttgcatggcggtgggccagagagtgtgtgaggggaactccccttcataaaaccatcagatctcgtgagacttattcactattatgagagcagcatgggaaaaacctttccccctgattcagttacctcccacaatacgtggggattattacaattcaaggtgagatttggatggggacacagagccaaaccatatcatcctgatacaaaacaggtcattaataaatatttattgaatagaattgagctggagagtttgttatatgcatatttaagttactctgcataccattaatatgtttcctcggtttgtagtcctgaagattaggcttgagttcagtatttatctgcttatgtgtcctgtgctgcaactgtcaccctccttgtccctcattcagccctgctctttcacaataaccaccccaagaagacttttcagatttttttttcatctgcatgtaaaaaaaagaagaagaaagaagatacttttattattttggttttggttcttctctcttccctgctttgccttcccttcatacatgcagtggtattagcggtcatgtcccctgaccttggttgaggcaaagcagagggtgtcatatcagttgcagtggaaagatccttctctgtccttgtctgtagctgaacctgctaagtgatattcccttctagtatgaggatggagtacaagtttttgaggttgcattgctgaaggtaaaaccaaaagagagagagagagaaagagagagtgagtgtgtgtgtgtgagagagagaggtgtgtgtgtgtgtgtgtgtgtgtgtgtgtgtgtaactattcttttgaagatgacttggaactattcctaagtaacctcctgtctggcattcactaatttcacctggccaactccagcaatgctgatcttaggatatcttattgtatagcttatattccaaatattggaggaaagagagggagtttggaaagaagttttagtttagagagctcttaaagtactcttggctcatcattctttaaattccaaaaatgactaatttgtggggatacataattaaggaagaaaaggttttgtgagggaaaggagtagcagggagtgctgagagcttggcgtatgtattggaaaattgtggtaacttaacaggtaatcaaggatgttgagagaggtgcttgtcatcatttcaaaagagcgtagaatattttatttcattttgtctactgtggatcggttctcctctcatttacttcttttcacatttcatatttgggagggctttgggctctatcttctatttccttctattaaaaaaagttttataagttattccacttggcattcggaacacaataatgtcatacttcactgaggcatactaatgctctggaaagaaagaaaaagaaggaaaattaatttagagggaatggaggctaaattttccatggtgaagaaattctgaccttttctgagttatcgtaaaagactgacattgctaccctttggatgttaagaaaaagtctttcagataccttggcttgtaagggacctgggaagcgccagggtccatcaaaaatgtaaagacatttattagaacatgcatatccgaaagctttctgaattctgtggggaccatctagcttttacatgatcttgagggaaccaaagttgtactgagaaaacccagtttcctcttaattccatcctatgtgaaaacaacttaagtctcaactgcactaagttatgaaaatggatcctctttttttaacatttggtttttggttattcatattgtctatattctgttctataattgtatccaagtgttaaaatatattttataaatatactgacactgaaaaagaaatcaaaagctgagaaacgtttgtgaatatggctggagagtctcagtaagatgggggacatctcctcaaattgaagatctgggaagtaagtaatagaaacttacagacagattgaggtgcagttttttttctacttttttttcctgaaaatttcagaaatatgagaagtgaaataatagcaaacatgactcagacctttataaattgtctttcttgacagcagagatgtacaattttgtaaaatattgtcctcagtcttgaactgcagaaactcctttctctgatacctgcggtcttatttaatttttacatcttaacagcaagagcatacccgtgatttgttttcacaaatgttagaaatactgtgtaagaatagacttatttttatattgtaaacttttactttttttttttttttgagactgagttttgctcttgttgcctaggctggagtgcaatggcaagatcttggctcactgcaacctccgcctcccgggttcaagcgattctcctgcctcattctctcaagtagctgggattataggcatgcaccaccatgcctggctaattttgtatttttagtagagacagggtttctccatgttggtcaggctggtcttgaactctcaacctcaggtgatctgcccgctttggcctcccaaagtgctgggattacaggcatgagccaccatgcctggcccaacttttacctttttaaagtatgtttttaaacaaccaataatatttggcataatttagtattttgccagtgcttcattgcttatgtgcaatgaggcatttaacaaaataaattggacatatatatttataattattttacctattccgtcagatagtacatttcttaaggagtaaggaaacttgaaatataactcactacttctcctttttttttttttttttcctgagacggagtcttgctctgtcacccaggctgaagtgcaatggcgcgatctcggcgcactgcaagctccgcctcccgggttcacgccattctcctgcctcagcctcctgagtagctgggactacaggcacctgcaaccacgcccggctaatattttgtattttttttagtaaagacggcgtttcaccgttttagccagaatgatctcgatctcctgacgtcgtgatccgcccgccttggcctcccaaagtgctgggattacaggcgtgagccaccgcgcccggcctgcttctccattttgttcacaaaatattttttcctcagaagtgtggcattgaatgatgtattgttttgtagtgagtacattatctcagtgaacacacaatttctttcagatagtcaccagagtagtcatcaaaaggaaaagcaatctaagtaccatttaatgggctgcactacactaatattctatttgatgaattaactgcatgtttttagttatctgttagactagttttcattcttttccttcccttcggtatgataaattcttttaaaatggttttattcaatcccaggaaactgaaaatacttgaaaaaataatattttgcaatttgtcagaaaatatttcctcactacttgactggtaatctcaagcatgattagtatagtgtttcctatgagctagaaggtttttggattagatgtgcaggaataggcattctgcctgcttttaaatgtctagctgcacagctgagcaaaaaagcccaacctggcagtcagaacaggctgcccaggggaactcctattgttcagccccattcaggcaaactataagatcacgcatagtgtccgagccggtgctggtgcctagtgagaacatggacagtccaggcatgggatgtgtggatatgctgccttcgcagtgatcaagaattcaggattttagagcccagtaaatagctcatgagaacttgggtttagaaaatctgaactgctgggccaccctgaagtatcttgaattgaggagcttgggtgaagaagtcctggtatcagttgggggcccttcagatgagctgccaccttgtgactgtccgtcagggtcatcttttggccatccctggttagcgttgccatgtgggtgacaactaggagactttacttgaatgttcccacagatgcatggctgggatggcgtaagttcttttctgtttctggcagcaatggctcaggattagggtttatgaggttaagattaacggagacaatagaagagaatcttgacttgataatatgttttttattttgtaaaagctttgttgcaatataattcatattccaagtaatgtacccattgaaattgtgcatttcagtggtatttagtgtatttatagagctgtacaaccatcaccaccctgtagctattatctccgcatccctacttctccctagctgctggaaaccttgggtctactttctgtttgccattctgagtatttcatataaatagaatcctacagtttatagtgctttaatgactgtcttttttcacttaggatcatgtgtttaaggtttgttcatgttgtagcttttgtggtactttcctttctcttcattgataaataatattccactgtgtggataggctacattttgtttgtccactcatcagtcgatgggcatttgggttgtttccatattttggctattccgaataatgctgctatgaacatttatgtgcaagtttttgtgtggttttattcctcttgagtagaactgctaggcctgttaatatgtttttagtcttttgtgtatatatgggaatattgtcacctagtatgaaatggtttttaaaggcaatcaacaatctaaaacctccagttatttgtgtgtttttttttttttttttttttggagacatgagacagggttttactgtgtcacccaggctagagtccaagtagtatgatctgggctcactacagccttgacctcctgggctcaagcgatcctcccacctctgcctactaagtagctgggaccacaggcacacaccaccacctctggctaattttcctattatttgtagatacagggtttcgccacattaccaaggctgctctccaactctgaggcttcagtgatttgcccaccttggcctcccaaagtgctagaattaagggcgtgagccaccatgcccagcctgcaatgtccttttctgaattcatagacttctcagtattacttagcagctagcctttttttttctttttttttttttttcttttcttttttttttttttttttttttgagagggagtcttactttgttacccaggctggagtgcagtgacacgatatcagctcactgcaacttctgcctctcgggttcatgagatcctcccacctcagcctcctgagtagctgggactataggtgcatgccaccacgcctggctaatttctgtatttttagtagagatgacgttatgccatttggccaggctggtcttgaattcctgacttcaagtgatctgcctgccttggcctcccaaagttctgggagtacaggtgtgagccatcgtgcccagcctaggcccccctgctgcctttaaaaaaaatttaataattcacattattgaaatatttaaacctagtcattctttcctttggctgtgacttcttagaaaattattattttttttaaatatatgaatgtggtgacttttgacactgtatttgggtgtttatttataatttatatgtatgaattttaagtaccctagaattgagtgtaatagtgatagtatttttaaaagtggaaatttttaaggtatagtatgttgcaaatttttaataaaagtttctattccatcgaagtgtaagccgtcatgatttgtttcatactttcttatgcttgtaattagagaaaatgtggcacatatacaccatggagtactatgcagccataaaaaatgagttcacgtcccttgcaaggacatagatgaagctggaaaccatcattctcagcaaactcacacaggaacagaaaaccaaaccctgcatgttctcactcataagtgggagttgaacaatgagaacacatggacacagggagaggaacatcacacactggggcctgtcagggggtggggggctaggggagggagagcattaggagaaatacctactaatgtagatgatgggttgataggcgcagcaaaccgccatgacatgtgtatacctatgtaacaatcctgcacgttctgcacatgtatcccaggacttaaagtataataaaaaaaaaatagttttaagctggtttctctaagaaagttttcctttgataatgaagataacaaagaagatagattttagcagcagaagtattcttttcctcatatttccagacattttaatacatatttgcagacattgtaatagtcatctttatagctcactccagtgctatacattgggattatagttgcttgcagtatagcatttacatcttccttattcttttttcttcgttcattctctctttcttgaactctcattctctctctcactggtcttgtgaaagaacatgattggatttctgctttgagctatctttaagtttgattacaaactgtaacagagtagccttgaggttttttttattggtaactattttgtgatgaggtggttgaaatcgtgcttctttcttgatttttgtttgtttgtttgtttgttttttgagacggagtcttcattgacacccagcctgaagtgcagtgatgtgatcttggctcactgcaacctctgctgcctgggctcaggaaatcctcctgcctcattctcccaagtagctgggaccacaggtgcatgccaccacacccggctagttttttgtatttttggtagagacagggtcttgccatgtggcccaggctgctcccaaactcctgagctcaagcaatctaactgcctcgtccctccaaagtgctgggattacaggcgtgagccactgcgcccagccaagtgcttcttgatttctatcatattgtgatgttcagaatctaatgtagttatgtggcccttacgttactctgccctgtactatcttctttattattttacattcatttatattatacttctaaattataaaataaaattatagtttaatataaactatatataaatctaatatagatttttacactatgaaataatgcacgtttcttgaaagagcaactatagtagtagatacatgttataacgtgcaacgtctcctgccctgggattcttcctaagtaccacacccagaataaccactgtttcttatacagctttccagaaaattttatgtatttttatacaagcacttgtattcacatacacgttgtttaaaaaaaaaaaaagaaatggtgtttttctgtacgtggcatatgtttcaacatcttgccttttcccctccaccctaatggacattgggtaatgatgtaactaatttctgcttttctgttagctttggcagccagggagctccaggctcatttacacttgctgggagccctgtgctcaattataattgcctacgatagcctccactttctgatttaatgttcttctttttctgaatttttaaaaaaatctttttaaaaagttttattatggcttctttacgtgagccttttaaacaacttgagtgaataggaggattcaggaattatggctcatagaagagacatatttaaccttatgcatcagacattgttagacactacgctgtatttgtatagcttcagtgtttggtagctctagatatcaagatagtatttaggaaattttcttttccaacatgttagttagttctgaaataccccaaatggttaatgtagtttataaactccgaaaagctttttatctaatgagagcactgttttaaaaaaaccactaatgattttctagttgaaacatttgaaacaattttgaagtacaggggacttttctttaaaacagtgctcattatactcggaagataagctcttgagcatctgtcatccttgttgatgtattcatactgtttttattctttgaaatgtatttaaatagaaaaaatagttcatgttttttgtcattctttcagactgcagtgttttgttttgaatgtggtgaaattggttttattcctcttgggactgcttatctctagggcctggatgcttcctttaaatagggattcacaggtagtaaatcattagaatttttgtttaacagtgaaagaagtcacttaacataggtctgtcatagttctgtctttgtcactgtatgtagaatttcatagtgatacaacatccattttcttagcaaaaagttaggtctagggtatatctgtttggaaaattacatcagaattgattttcaattaatcaaagttactaaatagtgctctgagttaccagtggtatttaaaattaattttggaagttgcacacatactttatgtgtattttctttttcttgtatgagagaatgatatatattaaattgtagttattgcttataatccttttagaaggcaatggggctactcaaggaggctgaggtgggaggatcgcttgaggccaggaattcaagaccagcatgagcaacataacgagaccccgatctctaagaaattttttaaaaaaagttagtcaggaatggctcatgcctgtagtcctagctacctgggtggctgaggtgggaggattgcccaggacttcaaggctgcagtgaactatgatcttgccactgcactccagcctaagggacagaatgagactttgtttctaaaaaataaaataaaataataaaaataaaagaaaaggaaggcaatgatgttctgcatcagtgacaacagcatgggcattgccaagatctttgatgaccttactgcttacctctccccagattttacataattttatcttcctgtcccattgtacactgacaatactctccttcaagtgtcctcacctcttgatttgtcatatactcttaattttattgctacatttggccatttttttcactttttttctttgttcactttcctttgctccatacttaactaattttccagatttctgtccttaaatctctttcattttcactggatatactcttcccaggcttcccaggcttctgtaacaatctatttgctttgtctccatcccataactctccctgagctctaaattattatatgcaactgctcactggacatacaagttcgtgattcaacagaccctttaaaactcaaatctgtttcccttagtatattcccttgtttgttaatcttgctcagttacccaagccagaaatttaggtatcattcttgaatacattgtttctcttcctttccacacccgatcaatcaaatacacagtcttattgcttcttactttttttttttcttatcttattgcttttattttcagtatttttttgaatcatgaagctgtataaacagacaaggtgatctgtgttgtgttagggctgtctgtgccatgttgctgtgggagtttctatatggaagaggggcattaacaaagctttgaaatgccaaagcagactttccagggaagagcgtctgcagataattctgaagaatgtgttgatagtatcttggccacagggccatgaggcattatcaggggcaggagagagggaggctattcccaggaaaggctccagcatgtgccagagatgatgcagacaacattaagatttgaaaaaatggcccagtgaacaaagtgtttttggttttgagagagagagagattgagagacagagagagagagagaaaccaagggatcatgatagttatagtcaaatagaggaaggattatcttttgaaaatgtgttggttctgtgatacaagaggaagctaagacatatcgtggaaacatctcccccctccaccttaatatcaagaacaaattgtggaatctaatgttaatgagaagtagttccccactgtgtcagatgcgcaaagagaaattggaatatacttatcaagtatattatagatggaattgaattattgtaaagagtagattagagaggaccgccaaagtccagtcccaaacatgatacattaagtgtatcccttagtataataccaaggaaccccaaaagctttacagtgtctaaactctattttacgtcttcctaaactgatatcgtacattcaatttatatatttctgtactaagatcatgaatttagagtttattgagaaattgccagaaaaaaatgtgttaagtttttatcccttaaagagtatctcataacttacagatttgagcagggaggtatataatcaggagtacagtttatgtttgtttattcaaagctctgatctcatgaaaattgctatataaatgcttgttttaacaactgttattattaggggtttgtatgaaagtctgccaacttggtcccaatatttatattataaattaaaatgttttgaaaagaactgcttctcaactgtgatcctcattgtttttgaaacctaaaatatactaatttttaatttttgtagttgaaatagtttttaatgccagcagtcttttggttatcagtttcatttgaagaccagaagttcctgaacaaagaatatttatttcagattaataagtaaataaagtgaaataaaagatttttttcctttgaaattgaggaagatcagttattagtagtacaaactgtgcactagattgtatcttagggttcctaactcattcttaccaatgataataactctgaacccaagaatatctgagacagttctcaattaatttaaaaagtttattttgccagggttaaggatgcacctatgacacagcctcaggaggtcctgaggacatgtacccaaggtagttggggtacagcctgcttttatacattttagggagacataatacatcaatcaatacatttaagatttacattggttcgatctggaagggtgggacaactcaaaatggagggacgggtgcttccaggtcataggtagatttgaaaattttctgattgcctattggttgaaagaattattcaatgtagaaaagaatgtctgggttacaataaggggttgtgaagactaaagttttatcctgctggggaagcctccaagtagcaggcttcagagagaacagattacagatgtttcatatcagacttaaagtctgtgttgatgttaatgctggaggggtgtaatgaggcatgttgaccccctcttccatcttggcctgaactagtttttcaggttaactctggaacgcccttggccaagaggattggtccattcagatggttaggggggcatgtagagttttattttgggtttacataacccattatggaaatgattccttggccctaaggtaattatagattctggatgccatgcttatattaagtagataccaaaatgctacttttagagtttgagtttctcttacgtttttagaaattcaattgagtagaactcgttattaaggaaaaaatactcaagacccgaataatattgccatgaataaagcggttgattagtgattggttgactttatgcttttcagttcacagaaatattgctgaggaatcttgacacaggcaatgcaagtgtttacatgaatatgaaattagcaactatatttagctataattaaaatctagtaaggtatgtaaaacctgtttgtctttgactagaacttattccaagttaatgagatctcaaacaaggcatagagtgtatgtccctttttgaaaagatgatgatattttcttaattactgtctgtgtttgggctggccaattttgacccagttaaaaagctgcaaaagcgtggtctgaacttctctttttattatggctaattttcctttaatttagactacttatacaaatacccagtattatgagccagcaaaattaacaggtgtggatttaatatgtagtgtgggtccacagagattatattcgttgtataaagcctaattttttgtcttagttgtccttgtcatgtttagatcttatttcaagccatttctttttcattttctgataatctgatttcattgtcaccttaatatcttctttttttgtgtttgcaatcttttgtttttctaactctaatcccaagaggcaaaagtaatacattttgagggatttttgagaagttttgtgcttgccttccccttgttcagataagttgtgctgcaaatggctccattcctcctgttttgtactagtgacaggaaagttcgtctagagataaaatgtcacaaatctgtccacctcctctactctctcaggggactctacaacgtcacgttttcttaactatttaatttgtaatgccttctttattttggggaaattacaaaatagtgacacagtctccccagcccaagaaggaggagattttttttccccagtagggcggttgttttattttgactatatagtcttccctagaattgggggaataaatattggtatggttttttaatattgatttccctgggtagattatatttctgactgtaaaatatattattggatgtgcttctcaaatagattttacataatcagagaaattttgaccatgagcctaatttaatacttttttgctccttctgagtttacataaactttttatttttccatggagtttatcagaatcccaaatcctctgcttcagtcttcctttcatcctgatcttcaggatatttttcctggagttattattgttattttatagtatctatatagctactattttatagtagtatctactattttataatagattgtcctggaaaacctaccggtgcatgagagaaaagttcaaggctaaacttaaaggtactgggtagtcaacagctcatgtctctatcagaaaatgatggagactagaaagtaacatacatgagtggttatcattttaaaactagagaaagagtcatggaagttggtaggggggactttaaaggtgaaagtttagattatggtctatcagagaggaatggaaaataatgtattttaaggagactgtaagtatccaaagtataagttaaggtttaaaatattacatttgagtaaaacaagaagaaaagagtttaacgttttcctgtaagagagtaggttgtattggatagtcatgttgttcagatttttatttattttgtaaatagttttgttttgttaaaaatttgtgttaattgggccgggcacggtggttcatgcctgtaatcccagcactttgggaggctgaggcgggcagatcacctgaggtcaggagttcaagaccagcccggccaacatggtgaaaccccatctctactaaaaatacaaaaattagccaggcatgggggcaggcacctgtaatcccagctacttgagaggctgaggcaggagaatcgcttgaacccgggcggtggaggttacaatgagcccagaccatgccattgcactccagcctggacaagagtgaaacaccatctcaaaaaaaaaaaaaaatttgttaattttgctgaggtggtcctgagactggatcaaaaattgcagcactatattcttctagaaacatgcacacgttttttaaaattgctttacctgcacaattgagttcatgatatttctgtcgtgtcgcatttgtaatgtagttaattattttcatcatcttcctgaaaaaggcaaaatcgatgggaaatttttcttcttaatattgaatcacgtatgactaatttatatttacttttgcaaagcagggaaatatatgaataagaggcatgaatccacaattgctgaagcaaatcaatacatgtgaaggaaaagcaaaaccctatgtaggcctatgtagaaaccttatgcacagaactaaatgcttgttaagtaaaaattcctaatccttatcctcttatgccattttaaattaactctaaaattagtattggaaaaatctccctgatttgttcaaatggctgatgcttacatgtcattttggatccagagatgcaaaatataagagcttcatacataggttcaatacttttctaaactgaattgggtttttgaataaaataccagggtattccaaatgaatgatttttatctgactcattaagaagtgaaaataaatattttattatacatgtaatatgatttagttttacaaactgttaatatcataataatctcaagaagttctaaaaatggagataattatgacagccataaaatataaagtatatggaattatatatttggctatatattagtcatatatttttagggcctactttatatttttttccctggcagtgttttagttacatttttccacagtgtttttctaaaaagaaattgtatcattttgtaattcttagtttgtcagagaaaccaactttatctcaacttcattaaagagtaataataaatttgaatttagttgatgtaagagttgccagtaccaaaatggagtggtttatgccaagcagtaataaaatggagccaggaggccatgaagtaagggagcacacacatgtatgcctatgatggaacttttcccaagaaattcctcagaaccatagtattccagataagctgcttgcacaaggaagtttgcctaacaagagctgccttcatcaatgagctaatgtggattcctgtaacaagctcctggaaccagtggtctttgtttcaaaacagttcatgtggactttttttctttcaaaagcttccccttgcttcagcctctttgcatgcacctgtggtgggccatagcaagcataacccgaattgcaatttcttgctattctcaataaactctttgttgtggagagttggtccctctattgtttattttaggttgagattagcatagaattttgtaaagtcctggaggtatatccatgccagggattaaattggattctattcccaagtaatttttgttcttaaggacactctaaggaattatttgtgtctgctttaattattaaaaataattttgtttattcagttcaatagaattgtatcttttaaaatacttatagtccttagatactgttttgttataaagtattttgttttgaagatgtctttaaattcactggcttcaaagataacttctgcattattccttgggctttcctcttagttcaatttagaaggaacagagaaaacacaaacatttaggtaaataatggaaataggattcacgtcataaaacgatactttgcaaaattgacaaggtggcaaacatacaggtgatgttagttttttgattaataacaagagacagaatctgaagggttagaggaaatgcataagaatctgaaaaaataaaaggatctggagaagacacccttaaaggtgatgatcaagaagtctgtgttgtataacggggctgttggggctcaaggagaacaaattttaaaagtggcaggaggtatggagaaagctgtgttggtgatgtgagtattatgggcttctcaaagcatggttctgactctggcaaaaagtgggaggtcagagcagagttggctgcttgtaatgggagtgggggagaaagcaactctttaaaaaaatttatgtcaaaatggtattcagtggtccatcacattgaatcaacacacctttattgaaaacatattatttagcacacactctaggggttcatttctcttattctctgaacttgaaatccttttcttgttgatctttcatatgggtcactaaacagattctattttacctgattaaataaatggtaacaaggcctaggtctactccttcgattttactgtatacttacttaacagttcactttgtcagacttctaccccctctacaagattaagaaaattagtggttacagtgtcatgcaattctattcggcttgaaaagttattgaggcatgtttttccacctttttaaccttcatttatttagtagaagcattcccttaagtgtatgatgagtcaacactggttttgcctgactccagtaaagtcaaagcattatttaatttaaaatgtgtgcatgttaagttcctttctttgcatttaattggagacttttttccacagttagctcaccaaaatgttactaggttcctctgtggctgtctactatttgaacagacaagcaactaattagaataacagaacaacatgactgtcattcctccattcttacaggttatttttaaaaagagattttgtttaaaaagagaaaatatgtattatattaaggaaatataagatccatactctccttgaggcattttttcacttcaccatgccaacattcctttattccctatcataataccgatcaagaaatgggaggttttcctaagtcaagaaaacctctcacacataaaaattcaaactgggaaagcaaatgtatcagggggcggcttttaatttgacaaaagatctgctacattacaaaagaatttttctaaagattactttatgtagacaactccctcagtgtaccgaaaatcaaagaatgttctacattttaaacacattttaaaatgggcacacctgttcctaatattcttatgtaaatggacctatttacatgtgagacccaatgtggtgggtaaatgaaaaccagtgtgtgagttactcaagtttgttaatgatgttagaaatatagtcaaaatagctcagtctgctcttgctatgctattttgtccagccaatctctcatcctcccttcatcctaattccagaagagaggataggagtaaaagcaaaatcttattacaaaaaacacactctggaaagaaagaaaactgtattggataatactcagtttggtatttgttttctcctgtctagttcttagtacccttagaattgagataattcattatttgtcactcaggtaggtttcgagtgaactgatatatttaattagatccttaaagcccataggatttatactggtcatttctgtcaattgtgaatctgctcatacttgttcttcatgaaactatggaataatttttcatgtattttcatgtgtcaatctgaaaagaaacttaggttctccagaacagaggagtttatttgaaaatagcagaggattataacccagaaaatgtgtgctgagccagatcacaggcgcatcaaggagactgggaccaaagggagacttttaaagacaaagagaagtcttcataaactgtttgttaaaccagaaagatcattggttacaagagcttgctgtaagagttggcgacaaatcattgttaaagacgtcattactagacagatgtccttgtgcaagctgcttatctggagctttgcggtctaggggaatttccttgctaaaagtcctgttacaggcaaatgtgcagtaaatgcgggaatgtctcctataaggcctttacaggcatttgtgagtgagggctcccccttcgtggccttccaactccatttgctagggtttgacataattgattccattttggtatcaacaactttcacacatggatagttcaaaatggaagctcctgtaaaataatactttcatatgtattttttcatggtgtctagtacctgtgccacatagtgaatgcctgaataaaggaccacatgtattacagttgttagattttcttagggaccctattgtttaaatgacttataataagcacttactgtgtgatggtaaacactatgctatttatgtcacctatacttcttacttaacattaacacaactctacacagtttggaatattgttgaaataatcactttatagctgagagtagagcatgtatgggttaaactcttgcccaaggtcagacagtgagttgacttgtgtcttcccatgttgtcactgatgcgtcttctcctttgctggctcttgttccctttattccttcagtaatatagagaaactacagcctttcattcccaatagagtgaaaatacaccactcattcattatttttcaattatagtgcaaggacgagcagtttaccctaatatccatttcttgtttggttgggaaattcaccaacagagcagaaaagcacagtggggagagacctcaggggaaacacatacaactttgagataaaccctgtttttgttttaatgttaaaatttaacttttaatccctttgtagtatttacacaactgtcagtgaaatgataaatcttctagctcatttcacaagagggcagcactttcttttaaaatttaaagtatgactaaaaaaatacaatcaaattaacgttttctatcatgaagttaagcttgaatgatttacaggaagatgggagcctctctgtcctgggggcaatttatgagttaagatgagtgcagatctgcagggtaacttgggatccttagaaaatggaacgatggattaaaatcaagccctagaatttttgacttgcagtttgaatttggagactattttggtaactttgtaaatgtgtaaaagtctgtcaagatcatgtctttcttttctattatggcaaaacatgaagagtgaatcattttaatatattcaaattgttttgctcatatcaaataaaaagtatttattgagcaatggttttatgtttaggattctataggtcatttgaggaacaaataaatttaacttttttcttcattatttaaagagcttaactcccttggggtgacaaggaagggaaagcacattggcaaaacaacctgtaaacaagccaaggcaacatgtaaataaggtacagggtaacagtacagcataatggagatggccgatttggatagggaattgttgaattagggttttaatgcagggctttgagtagaaggtggaaattgaattggtcctcagtgggtggataaaatttgaatagatttaaaaaaaacaaaacacgaggaggctattatttaagaaaatagaatcctgtcaacagagaaaaagtacaaagtgcatcagggcatgctaggaaagcctgttgtttagaacattgtaggaatgatgcctggtaggtaggataaggctgtattgtggcaccttgaaagttaggagtcagggctgcactctccaataccattgccgctggttgtatgtgactatttaaatttaaatgaattaaaatcaaaatcaaaatgtatttccccagtcacatcattagccacatttcagatgtttaatagccatcctattattgaacaacacaaagatggaatattttcattatcacagaaagttctattggacagcactgcatcacagtttagttatttgggggttggaatatggagaatcattaaagaaacagggaatgatacgacagtataaagaatgtttgaattttaaatctgtaagccgggaacttaaagggaacttctttttttttaatgttaagtgttttcgatggagcataaacagaacttgcaaggtataagcattttgtataagtgttctaaaaactgtcatatttattttttattttaaattagctactagtatactagctttaatgaggaaatagaaggtgagctaaaggaagtaactttttcattagttttcaaattcagttaggtttgtcatgcagcatacagaactggagaatacagagagactggattcaggaatgatgacgtgaagaaatcctgtgaggagatgtattagctcattctcatgctgctaataaagacagacatacctaagactgggtaatttatttaaaaaaaagaggtttaatggacttacagttccacatggctgtggaggcctcacaatcatggcagaaggcaaaggagaaacaaaggcacatcttacatggtggcaggcaagagagcttgtgcagaagaactcccctttataaaaccatcagatctcatcagacttattcactatcaggagaacagcatgggaaagacccaccttcatgatttaattacctcccaccaagtccctcccacaacacgtgggaattatgggagctacagttcaagttgacatttgggtgggacacagccaaaccatatcaggaggtggaagagaaaagaagcaagaaatatcaaaaaatattaagatattttgatatttaagtagtgtgtatatgtgggtgtattaattggtgattccaacttgttttaaagtttcaaagttgtttgagatgatatgtatgagataatttagtaattcaataacgacttttggttgtctactatatggtagagactgttgtaatttctggggatacgtcaatgaatacaatagagcattgctattttaggaatggcttcactgatgtgatgaatattttattattcaatctggcttttaataattactggtcataggccgggcgccgtggctcacgcctgtaaccctagcactttaggaggccaaggcgggcagatcacaaggtcaggagtttgagaccagcctgaccaacatggtgaaactctgtctctactaaaaatacgaaaattagccaggtgtggtggcacgagcctgtaatcccagctactcaggaggctgagacaggagaatcgcttgaacccaggagacggaggttgcagtgggcccagactgcgctactgcactccagcctgagcgacagagcaagactctgtctcaaataataataataataataataattactggtcattgataaatctttatgtaacctatttatattttattttaaaattttattgttaataataaccagtgttaactcataacaagttttctttgtggtaaaaaatgaagaaatattttaaaatatcatacacttagcttctctcaaaatattaggtttgtgcaaaagtaatcacggtttttgctgttaaaccaaccgaaataataatactataataatatatttttagagtttttatcaatttttttgatatatatgaaaactagtggaaccctcacctctgaaaaagtcaatgcaggcatttctggtatacatataataataagaaagtcttaattgtcctgtaactaaaactatctaaatctcaataaatttgtgttgaaacaaatgcgcaattatatagtactagtgaatgtctttcttgataagagtgtttgctcaagtgttagaggaatattctacacagaaaaatcaaggttcagacaagagttccagggtcaagcagctagataagtgtcataaaggaaatcatgacacaggtcgtttgatttcgagagtgttattctttcttttttatcccatgaaatatatactatagggccaggatgaaataatacagataagtaatctagtttacatgtaacatcaatgaatattttctcatacaattaaaacattttctgtattgcttttcagactatcatagtagtagaatgatctgactcaatttttagtgaggaagttatgttctgatgacttaagttcttatcatcctgaactacatatagtcttttctataccaatgtgtagtgttgtcagtttgcgtgttgtaaatatcttcttccagtttgtgtcttgcctttttattttctttacagtatttttttttatttcaataggtttttggggggcaagtggtgtttggttacatgaataagttctttagtggggatttctgaaattttggtgcacccatcacctgagcagtgtacactgtatccaatgtgtagtcttttatccctcacccccctcccacactttcccctgagtccccattgtgttgtacttttaaaggctcttttacttcctaattattccatattctgattttaaagttaaaacactctccagattaaattctagatggaaattgtactttaaattcctttgtttagcaatttcaaatgcagagcttgagatgacaagacattgcaaagtcccttctactgtggcttaacttatccctaaacaagaatgtggctgatgtcagtgtcagatggtgcttcacctgtggacgttcatttcctttaatattttgttacagtaaccttcatggcacataaagcctcctgtctctgaacctgacaaacagggtccagggaataagacttaatcactatcacaagaaaatcacgggaaagacctgccctcacgattaaactataattttctttttcacttctgcaacttagatccatgtacgaaggtgctattcacattgcagcatctctttagacactagtagactctggcgctttcactctgccacagtctaggtgggatcacttaaacctacttgaaagataaagcgatgcttcaattgcctggacaaatcaggccagacattcattttcaagcgttatcaatggatttttataaacattccaaaaaactttagaccgtagtatcacagtattagatgacaatagggatactcgtttccttgggaagagaatagctcgagttatataatgcctgtttagacacaaagttgtcctttaagtaagcaggagttactagttataaagtaacttatgacaacaaaaaggctttgttctgtctgtcccttagaaaagcttaccattgaccagcccactgctgcagaaagcttgtttctattgagggctggtttggtagtgttagaccatctggcacctcaaaacttctgaaacttttaaaggcaaaaataattgtctccagtagcattagctttcaaatataatgatgccaccctttttggaataggtatctactcaggaaggtaaatgtgttttacttgggtattttctatctaatgatttaattttgtatgaaaatagaaacacaggctgtggtgaaattttcacacagtataaaagattgaacattgaaatgtttcattctagacactcagctctccagtccctcccttccaggtcgccattattgctgtattatagatctttacagaaatattatctgtatctcatagattgtacctgtacataactacatatcactccccccctttttggcgtatacataggatatgtacgtgcatacatattagaggttaattatttgctcttagaaattatctccctcttggccaggcacggtggctcacgcctgtaatcctagcactttgggaggctgaggcaagtggatcacgaggtcaggagattgagaccatcctgtcaaatatggtgaaatcccatctctactaaaaaatacaaaaaattagccagatgtggtggcaggcgcctgtagtcccagctacttgggaggctgaggcaggagaatggtgtgaacccgggaggcagagcttgcagtgagcggagatcacgccactgcactccagcctgggcgacagagcgagactccatcttaaaaaaaaaaaaaaaagaaattatctctcttttccatagttgtacagcatttcattatgtgagtctgccataacttgtttacccagttaccttttcatggacatatagattgttttcagctcaataagtcaagtaggacttattgagcatccttgtacatatgtctgtacacatgtttgcaaattcctagtgatagaatttctgagtcaaaagttatatgcattttaacatttgatgggcattgttaaattatcccttaccctcaaatttggcagattctaataatctctaggaaatgtaatgacttaaagtaaaggaattcttcattttgtaatcagcctactgatttccatgaaaggtgcataatacattgtctgtgttcaccgtctatgtagaactcattgctcagagcaaacatctgaaggaagagagataacggtacagaaagtaaatatgactggaggggagaaaatgtgtgattgtggtgtgtgactttttgtgggaaaccatagttgtaagtgtgagtggttcatgtggttaagtattaactggttattggtgatattagtgaagatggatcatgattagggagttgaagtaggtttagagtgtgattttgcagagaatgcagaatgggttcctaagtaagaagatgacagggacatggttcagagttgaagcagtagctccacaatgaatggattagcctccaagcatgagagaaatcccactgcttagtattatacacaaaagtatagctgatcgcgtggggttagtttgaacttcctctgtgtttacccaatgttcagttccttaaatatgtattcagattatagtaacaatgccctcctggggaaagtaccagctttttacttgtgactgaaaacggcgctttcaattttgatttgttttgacattttagttgctgttattaaaatttgtattttaattttggcttcaatttactaaatctacatagctgaagaaaactggagaaacctttataaaaccttttgaaaacctttaagagcctttttcccagagccctgtggatttagttgcatatgctacaggcttgtgctgtcagtagacatctggaatttgaggcttggcctcctgagattgtttccctcttgtctgatgctgcatattttttaggaagaatatggtttggaagcattaacttgtcttggcattatttttagtcacctaataaagtgccgtctgaattgttaaatatttagaaggttgctgaaggctgactcctgcacctggttggctaattcagaagcaaatcagctggtatttctcttcctgaacccctaccccacccacccattttcctgaagaagaaaaagctctttgagcctctttgaatgtctattggaatcttttggttatgtgttatagaaaatatattaagtattgaatctttttcttatgaatcctaatttttatttctccatgaccacctgtaaaattatcaaagtagatggcattatactgaagagacaaacattaaaaataattctttgcgtacaaagcatagtgcctgaacttcctgggataaaaggagagttttccctttcatcaggggactcaggcctccatccttagattgaactttttgccctttagggctgtatattaccttaaatagctaccagctgacacactttgctgcaggctgatgttaacttgaaagtcgaaatgtatggactggtctctccctaatggaacttcagtggtagaagacaatgaattgaaaactcagatcacgattagggtcttgaagctattttatttttgaattctaaatcccaagttagaagggttatgaaaaggagaattgtgtatatttctttcacaagaaataagttggatctttctttgagtcagaatgggcttacaacaaataaacttttctccccatgccagaaactcctcattttagtaatgaataagccatgatgtagcgatttatgtgtaatcacctattgaccttccatatgcttcactttagaggctcctaagaagcttttcttcttttcttttctttttgttctttgtgttggccaatataaagagaaacctgttagaatttacatagaaaacatacttgatctttacagttttaaaaattgtctttagtgggaagggtgccttaagatccactataggagtaagatgtaaagttcttatttgagctgtaaagaatcttttattgccttaataaaattactaaataggtcatcttttaacaaattatatgaaatatagtttttaagtacaaaacatttgtaaattgtcctaccctttgaaagttgttggcaaagccatacctatagctctcttcattttggcattggaatgtggtttttattaagcagtttagatttagattttcttgagtccattgctgagttttcctgtgcttctctgtggttctggaactttttgctttctcatgaaactctatgtctatgtttgaaacatggtttatttagctagagattcctgggttattcagtgttgatctgatacagggattggtagtgtcaagcatattccacctactgaggattagtgaacaatttatttgcacattggcttaaattgggaaaatgtcaactacttcaaatgtcatcatctaatttattaagtctctctggtgatgtattgcttacactggaggcatctattttttgttttaataattacaggattacaggtgataatgtatcaaagaggtggttgataaaaaaggactgtagaaatgtaggtatattaccaagatgatattttgtgtactgactttaaactaagaaagtactctttgttttgagacaaagtctcactctggttgccccagctggagcgcagtggcacgatctcggctcactgcagcttcgaccttctgggctcaggtgattctcccacctcagcctcccaagtagctgggattatcgtcatgggccactacatctgggtaatggaaagtacactttatcttatagatatcaaacacaaattcatgatgaaatgtgctcacttttataaaagcaactcacatttacaagtcttttaatgtatcagttatcaaagagtgcaatacttttgagtaatatattagatatttagctatttgaatttcacagaatgactttggatatttacatgaataatctatttgactttaacacttaaaaaacaacatttttagttgctttcttgtgttttagtgagagtatagttaccctgtgattaaaattagttaagaatttaaaaaaaatctttcaaatgatcccatattcttttgatgatctgtttttgaatatggatccactgagttttgtactctttcttcgaaagaagctgccatcagctgggtgtagtggcttacgcctgtaatcccagcactttggaaggccgaggcaggtggatcacctgaggtcaggagttcgagaccagcctgacgaacatggagaaatcccgtctctactaaaaatacaaaattagccaggcgtggtggcgcatgcctctaatcccagctactcgggaggctgaggcaggagaatcgcttgaacttgggaggtggaggttgcgctgagctgagatcgcgccattgcactccagcctgggcaacaagagcgaaactccatctcaaaaaaaaaaaaaaaaaaaaaaagaggctgacatcatagctagatttgtcaatatcttagtttttgttgctgcataactgtatataagggagttttcggtaagtgtcatcgtttctaccttagcagaggatgtcagttctgagaaggtagctgatacaaaggcaacagtttctggatattctactctcgaattccacaggagaacatactcttgttcctttctcctgtccaggactcaggtacttatcaggctgataaaagttcccatgctcttatcttttgggaagaaggcctaatacaaaggataccctttcttttccctcatctttatgccttgtgtttaaccttgggtgtggatacaagatatgtgggactctaacaataacatatcattcttgtcttgttataagagccctttaaacagaaagggtctactttagagaaagactatggtattccctgttgttccacggagtttttgtttaattcacccttctgatctgtgcatgggggaatggaatggcgtgtttgcacatgtccctgatcccagccatccagcaccctgggtggtagctggaagtttgcccagctgagaaagattgttctttttctctcccttttttatttatttatttttttgtgtgtgtggtggtggtgatggtgctggtgctggtggtttcttttgtcttgtatttatgtaaaaagtttatttgctgctcttgaaagatctcagcatgtggccccagagtctttacagaccaggttccctgtggccactttctctgtaagtttcttcaccacagttctgatggttggtcttcatgctgatgtcagtgctgttttgatccaaactgtagattatttttacctgtgaatttctgaataagcattagattaacacatttgtttttgaaatcaaatgtgcgttgaggtgaaacacgttctgctagaaagctcataaagccattttgcccctggggacatacaggtttttatgaaaaaataatgaaaatattttaaaagcttgttaaaatttgtatagatgggcatatgtaaaacacatgctatttaaatactgatatgaaaataagttaggaatgaaatagaaagaaaaatgatttgcaaatccaaaaaataataccaacattgtatactgttccctgatagatttttagtttttctggttttaaatggaatctcttacgacccatgattaaataagtgctaacggtattgatatttaagcaactcattagccctttaggagatgcatattctgattttaggggttcccccccccactttggtctatgccctgatgcaaaaaaagtaaacttacttatattaaaatttacattattctacttgtggtagtgtcaccattataagcactgcatctttatgatgaaactctgcctacaactagagaaacatgtttcaaatggacatttctgttatactttattggtatactgtatagctatgtaatgcaaaagcaaaatcacatttgccttggaatgatatccataatatcactacaaagaatttataatttggattggagtttttttctttaaagcgatgacacttaaaacttcctggaagatggtgtttctctgagtgccagtagtaatttaacatcaaaatggaagacacattcaatgtagttattactcacattttgagtacagtagtttctctcattaagttttatgtcagaaacaagtaaattccctataagaaaacagtctgaatgactttcagcggcatcaaagagatcgaaacactttaaaactattttcttcatcagttgcctgctaacacctttttgaaaaataaaattaatcaacgcgtatttccttttgtgatttgtattgttttgtacattcactcccttttcttttcatgggttggctcccaactggaacatggaacctgtgatccattcaagattgagacaatgtaaaagatagagaactgacttttggggcaggcaggcctccaggaagtgggagtgagctttcacttcaaactgggtgaggggtggtggaaagggaggatgctgattaaaataataaacaactgctggaaagagaagttgattaccacactgctgtcagatcagccaggggagctgccagagcccactgaggctgctctcccctgccacaaagccggcagaagggactagatttgctgcgagagcttttctctggacagacagaacaccttttaaaacaagtttagttctgttgcattgacagcatcccttaggccaggctgacctagggaaatggactgaaactagcttggtggttaccatagcaacccaggctgctggtgtctgggagagtgagaaccggtggcctcttgtcctgtgttttggtgtttcttcagctaagagtacactcctccttcgaactctacataagtcatgctctttgaaaactggctctttacccaggattttttttttttcgttctgaaatcggtctgaatggaggaagttggtaatacttggctttttttttttcttctctcatgcaagtttccaggatatagcttctttttttgctgtatgtaattgagaccaaactctaagcttggggccctggagagaacagttgtggcctgcaggtcattagtgaggtgagcagaagggaatcctggacttcccagagaaagaggagaccatgccagcctcgtggaacacagctaccaggaaatacagaagcaggtctattccttgcgaactccgaagtccatgaaaaaacggacccacagtggggtggctaaaatgtcccagcgcaagctgccgctgctgctgatggaccatagctcaagggcaaggcttgtaaaggattttacaaaggattttaaagtatagccagaaaagatacggtgtttagaagttaaacgctgttgtctgaaggaagtttgccggaaagatgtaggcttcaagggctactggacaatgattggtctgaacttcaacttacgggaactgctgacaaaatttgaaaaggtatgcagaaagcaaacttcatgaatgtacttttttcctttctttcttgccttttttttcactatacatttagatagatgctctattgactctttggtggtttagtataatttataaggaatattcaattttgctgtctcctttaaagatgtttttcaagtaaagggctaattagcaattacttcctttggtcaggagggcttctcatgatgcctgtcacttttagaattccacatcagaagaaactctttgtactcaagtcagctggtaatttaactgaaacttctttggagaaaaaaaaaagaaaatgaaaataaaataaaaatccagcaaaaaacactgggtattggtgccaaagtctgacttcgtaggcatgggttctgttctccatacccctcaggtttatctgtccagccactgcctgccgtgcactgccctgtacagccctctgcctggggactcagctgtgggtggcagaagtcgcttcacagtgacagtggcacatctgacctcaggctttttatctgagcgtgtctgttttaaacatggagtgcttgcatgcactgtgaagctttaatgcttggattattaaatgtgcgtgtagctcttttttccataggaaggctcctggcacaatctagatggagtctagcctgccaaatactaccttacatttatagttaaaacagaaaacctccacatgcgtgtatgcgctcctgccctctttagcctttggatgccaaacaccaatcttcttccaatttccagtctttaaagaaaaagaaaggcagaaaggggtgaagtcctccctcacttggtatgtaagtcaattattaatatttaaaaagctgtgctcagtggctttcaccgtgaatgccccatggatcattgcaagtacaaatactgtagaagcgggactggattgagtcattaaaagaataatgggctttttcttacaaaccacaattgccagagggaaaagatgcaacatcatgccatctgaaaagtttggaagcttttccaaaacaattgcagtcactgcttgccttttgatgataggaacgttatggtgggatgaatgtggagagagaagaatttagctctttgctccctcctggctgcagttgcttctcccaatctctctctgcacctctactgtaatgtaaggattaggcttgtaacacagggcggacttcgacctctcgctttaatatgtggttaagcatctaaattcctgagagtaaaagacggttctccctcagcttgctctccacttagaaggggcggggaaggcaaggaatatcttccttatggcagctggtaacagcaggtgacaaactttatgaccataaagaggtctgttagcttgttttgtatagatttgtctgtttcttcctttaaaggtatagagcatatgttacatgaataattcattacttagaccccctgagaggcagtaattgtgggcaatagctggacttttgtattgtaattgctgctattagtcttaaaagtctaggtcagataccaggggttcctaacctgcctcagcttcaagccattttattggcagagttagaagttctggttatattagcatgtttccccttttaactcccatgtcttagtatttgtcttattcctattttagtagttgaattgacagtagaagatatctactggctttttcctgtcaaaggcttgatttgggatttttattattattattatctatttatttatttatttatttttgagacaaaaggcgaactcaaagaaacagtcctgatgtaattctcagtctgaagttctccatatatgtgtatttttgtgttaggcagttttataaaaacctatgtgaaagttgatctctttggccgtattttacttctaggaagttgtcgtacatgaatgtattctttccaaagtgttaataaaatcctttgcgtattcttacaaaatctgtctcatatattgagatgttgcttcattggtttattggcaggaaaactggaattacggaaaagtatcagtacctcacacgtctcaaatacaactaaccaccttcccccaacaaagcaataatgccatttctagggaaagaccaaggcctactgctataatgcagaagccacaggatcccttcagaagctgagtaacagccattctacacgcagaggtagagtccctttaccctcaattctcagtcctgtctcttcctcagtattagtaacctgtttctagagagaatactagccttaacgatttaccacttttcatatcagcagttgtcattgttcagtctgaagtttaggtgaccacagtagaaaggggattttgctgtattcctgaaggaatttcaggctttaagaaaacgagggtccactgttggactagtagactcaaatcctgatacgcttagtagttgaggccaacagctgagcagcaggccttccaatggtggctaatctggaaagttatagactggtcagatcattaaaattcccaggtgaaagcagaccttcagcataactttaagacagcagtttttttgtgaaggtaaattgaaagggatattttagttgatatttttgaattttggagacatccagtggttttgtgatttttactggatataagaatgtttggcatgttatactcatataagaatgtttggcatgtggttgagcaccttgtctcagcatgtgtgatgctgggattgtagtttcccagcacaggcaggatgggcaatttcttacattgggtactgatttctagtcttctagaaccagaaagggcaaggctaggagtctcttgcaggcaggaagtattatgttcctacaagatgacagctcattacagattaggaaggcccaattggagggaaccatgccaactcgagtggtacctaaagaggaagaacttcttaccaggggaggatgaccccataccaagatgtgcctgccagcaagcaggtcctaatcatctaacaaagtgataagggatgagaagttgtggccatgggctcaagggtgactatgggaagagttcacattcaaagttgactagtccaccaacacacctctctgagatccagccaataggtagttttatttgccacgctgattttaattaatttttttccctgaaagtacttcctaaaggaagtatctcatgactttagggactattaacatactgtcatacttaagccatttgcattgtgtactgtatttcttttgtttaatagtcacagaggatagtgtaatggccaattttagctcagtgacattttgagtgactgctgccttttattaatttattcagacctgctactgaatggttaatgataatcgtagttctctaagggattttttgatgtatgtgtctgctgtgtgtgtgagtgccgttctcttagtaccattctcttggtgactccttgggcaaagatgcttcctatcataacaacacagagagaaaccactcaatgctgaattactttatggcatttacctcctttcacatgactctatcttttataattacaatttgaagctatattgtattgctcagtttgccatatctcattttaaaacaaatgtgtcctcaataagatatagtaaacacatttcaaagtctcctcatttattccctacttagcaaatatttgtgaagtatgtaccaggtgctagtctaagtgtatagatggagaagacattgatcttatggccgaatgggaggatacagacaaggacattttcaatgacaactgcataattaagcaaaagtagatgaaattataagagtaatgatagccctaatctcagtacttgtgaagtctctcctggagaaattacatttaaactgagacttaacagatgagtttaagttgaaagaaggaaatgagattatataccaatgtgtgtgcatgtgtgtggcccatgggtggacttgtgtcaggggaagaaattgggagctttcagggtaacagggactgctttgacatgggtcagaagttgagaagctgtgtgccccaggcttgtagttttaaacatttgaaatgcgataatttttctctgggttttctgacctgttcagttttgattacacgatctgatttgtttgttcagttttcatcacactatctgagtttgttccacttagtaatttgactgttttctactctgttgtcttactttttttttttttttggagacatggacttgctgtgttgctcaggctgaccttgaactcctgggctcaagctatccacccacctcgagtcttacctatatttatcatcacagataataggaaaagaacattattagcatcgatttcttaattcagaaatgctgctgtagacctgatgataccacctctattgtcagtcaaaaatgtgattcaatagagtgattaaaatctgtgagattagctgttggaagaaaatttatagaataataattaaaatcaataaattaattgaataattaatgacaattactatcccagaaacctcacaaactgtttcaaaacatatttacatatgacataacctttgaagatgatgttatttgcctattctattattatttaagtaatatatatatatatttttaaaatcatgattcctcattttcaaaacctaaagctctggcagtaatcctgctgagctcctgataataattctgaaatctagtctgacttttgaaaggaatggtggatttattttcctctaatgattaactttgtttagttaggctgagctttgggacatgatagcgaaattgttctaacctcatttcttcttcaccttcaggaaaggggtcagaactccttcagaaaaaaacatcactgttgccacataaggttaagtaaatagttggtgcaaaaataaaccaaaattattttaacaagaccaaagaggatgaatctagtctagcacccatttagttgttgaagacttcctggtggtactgttctaaatctctgtttcctgtcagagatttcagacagttctgtttattataatgtgaggaaatatttttgcttacatatttaagcaaaatatgttttattttcatgatgttttattgatttgttttataatgtatatcacataatttgtttataatgttttataatcaagctactacttgtagctttataatcaagtagtagcttgactgtgaaacattataaacaagttatttgatatacattataaagtgtttacagttatatctctatgggttatatcattagagaaatgcccagttaagggcaaaacttgtagtcaaatactaattattaaataagtaaaaagtaaataaataaatgttttcccgtatttgtgaagtttatcttgatctgaatagtgggtgttgtttacagaaagactaaccacttatcagtgaacctcagtgagcttttgtagccatcttctggagggctgttctgagggtttgcatcttatgcttttgatggtgttttatttagagaaaagtgtgtagtcctatttttctaactcctggcttttcttaaccttctacattatacttacattgttttaaaatacttttcaagtgaatccttaggacattgcttctgccctgttttcaaatgttagttcaactgcttgaatatcttgccatggcccctctgtgcacatgactggcttatgttaaatgcttggaagagcattgctttgtgcttcaagatggattacattcccataactaattatcagtaaccattttgtgctgtttaaagttcagaagggcttgcaggtgacagaggtaagcatcagtagggccaagtctcccagctgtgcagtgagagccagccctctttcatggaactttaatttattgtagcatttgacgccacatcagggtcatgatctgacagcctcccatgctgacatcctgagtttcaaatcagtgcatcattgcatagtgatctacgaagaaacatgattcattaactgcatttatttctaaattttcagtgcaagcttagccaggactttgcagtgcaggcttctaaattattttaagttcccccattaaacttttcaagtgaagaaattgcacaaaatgattactacatttccttccaatttttcaattgtttggttttctcctagcactatagtggccaatttgccagtcaatcaaaataaacctattaatccactcatacattgatatgtgtatctatgtgtcatctatctactctgtttacattaggatccttctatgtaacagagactgtgaggatacagaagaaatattaagatgattttctgttttgaggcactctgggtatatttggcaaagttaatatgccaccaaatgtcaaataaaacaaaataatgtctgtggatttccttttctttgatcacttgtggtttgattttcttcccaacttttgatgatgatcatgtgtggaagggttttccacatactgaaaattatattccaacatgaacatatgatcactggtagcacagttaaagaaaggtttgtggaactgcttatcatccttggttgggccagctatgcagtcctgtttcattcccattcgtcgtggtagctgggttggaaaacacatcgcctgatctgatgtgagaaggcgaattttctttatgttcttggaacccaaatgtcctgatgttgcgtatgctcttgtgaaacttagaaaactatgcatcttaatgcaccactactacttcttcttcctcttcttcctcctcctcctcctcctcctccttctacttcttcttcttcttcttttagaagaaatccccctctgtcatccaggctggagtgcagtggcaccatctcagctcactgcagcctttgcctccagggctcaagtgattctcctgcctcagcctcccgagtagctgggattacagacatgcaccaccacacccagctaatttttttctatttttatgagagatgggattttcatcctgttggctaggctgatctggaactcctgacctcaggtgaccaacctgcctcagcctcccaaagttctgggattccaggcttgagccactgtgcccggccttttactttttgcttctcttcaatgtgaaaggaatcaaataggtcaaaccacatcaggatgttgtagtttgaagttgtcttgtgattttaggtgtggttcatcgataatgatgtataggaacttaaacaggaaatttgaagccaggttctccttggcaatagagagcaaagaggtgccttgcttgtcgtgtcattgagcttcctgagaaagatggctaccttacagatatatagcgtaagcataaaatcattgcaaaacactatctgcacacctttaaatatgtctctttagaggtcttaaaatgcacttcaggacacaaaaatagaacagttgtatcaggagatgacaccaaagaacttttcagcggaacttccctttttctttttttcactgagaatttctatttggcacatctcaaactatgattataatgagactgcaattttctacacataatgttgcacagcctgagaaccttgaatcattatctggctctgtttcccagctgccctattcacttctcttctgcactgctctgggatagaactgccagtgaaatgcaaaagattcaacaatctcagagtttttattcagcggttaggcctaattctgcaaactgcaaaccacactttgcattggaccagatttggttttgtcatttgggtcagataacctcagagatcaatgggtttgcaaatttggaccataaatcttgcaggagctgtctattaaactttgtgttcatctcacccagtctctaaatctgaccctattagtgtcatgttagacatctcaaatcccatcagaaataatactaggtcagtgctgccaattcacctcatgtaactgacatcttcctaacatgctgattggagtagtgaggtgcaaaaggcccttccttgggtgtttctggttagtggaggtctatgggtgattgaaaaacaagcacttagatgctggtccctaagcctggattcttggtagaatgcatgggtgtgcttactaggagtgaattttaaataaagaaaagcattctgagtatttaaagtattcctatgtaaattttcaccctgcttatttatttataacaagagaaacttacaatgagtgaggctgtcttagtcagtttgggctgttataacaaaatgccatagactgagtagcttataaaccacagaaatgtatttctctcagatctggggactgggaagtccaagatcatggcactggcagattcgatattctagtgagggcctactttctggttcataggtgttaccttctaggtgggtcttcacctgatggcaagggcagggcagctctctggggcttcctttataggggtagtaatctcgttcatgagagctccacccatgaccttatcacctcccaaaggccccacctcctaataccattattgtcagggttaggggttcaaaaaaaagaattttgggaggacacaaatattcagactatagcagagtcttataaagaaaagcttcagagtagaaggacaatagaactatggtgtttaggagtttgctctcctttactaattcagattcattgcctgaaatgcaagttttttatttctgcagtgagctgttttactgttcattaccaatgatagccatggagactcacaccacatcttcatacccagctctggtccctgcttttctgtttgtaattcacacttacttatgatacattactggctgtcatgccagagttagctacaattaggttgcttccattaaattcaggaggaaaagataattgccaaactaatatggatagttatgctgacaattttataagggaaaagtaggaaaaaaattggatagacactctatatcttaaatttgttagatttatctaataaaaagaaactttgagtttaactttttgaaaactcagagaagtatagagatgaaaactaaacttatctgtaatcctcttctatagaggttacactatttttgtttatttttgtagtcctattgtgtatgtgtcaaattatacacaaatgcatatgccaattaaagtatgtacttttaaaaatgaaattatcataatatatagttttatatcctgttgttaaaaatattatatcaccactaatatattatgatagcttccactcttttactctaaaaacaatcagtgtgttaaaacatttttatacataagtcttcttaagttagataattttaacatttttatggctttttaaaattgcagtagttttggggggaacaggtgatgtttggttacatccataaattctttagtgatgatttctgagattttggtgcacccatcacccaagcagtgtacactgaacctaatgtgtagtcttttatccctcaccccacctcccacccttcccctggagctcccagagtccattataccattcttatgaccttctgtcatcatagctcagctcccacttataagtgagaacatacgatgtttgattttccattcctgacttacttcacttagaataatggtctccaactctatccaggtttctgtgaacgccattatttcattcctttttatgcctgagtagtattgtagtattccatggtgtgtgtgtgtgtgtgtgtgtgtgtgtgtgtgtatacatatatgtttacattttctttatccacttgttgactgattggtatttgtactggttccatatttttgcaattgcaaatggtgctgctataaacattcctgtgtacatgtctttttcatataatgacttcttttcttctgggaagatacccaagtatggaattgatggatcaaatggtagttctatttttagttctttaaggactctccatactgtttttcatagtggttgtactagtttatgctcccatgagcagcgtaaaacttccctttttaccacatccacaccaacatctatttttttttattttttaattatggccattcttgcaggagtaagggggtatcacattgtggttttgatttgcatttccctgataattagtgatgttgagcattttttcatgtgtttgttggccatttgtgtatcttcttttgggaattgtctattcatgtccttaatcaagtttttgatgggattatttgtttttattcttgctgatttgtttgagttccttgtggattctggatgttagtcctttgctggatgcatagtttgtgaatatttttcccactctgtgactctatgggctgtccatttcctcttctgattgtttcttttgctgtgtagaagctttttcatttaattaagtcccgtctatttataattgtttttgttgcatttgcttttgggttcttggtcatgaagtctttgcctaagccaatatctagaagagtttttctgatgttatcttctagaatttttatggtttcagatcttagatttaagtctttgatccatcttgaattgatttttgtataaggtgagagatgaggatccaatttcattcttctacatgtggcttaccaattatcccagcaccatttgttgaatagagtaactttccccactttatgcttgtgtttgctttgtcgaaaatcagttgtctgtatgtatttggctttatttctgggctctctagtctgatccattagtctgtgtgcctgtttttataccagtaccatgctcttttggtaactatagccttgtagtatagtttgaagtcagctaatgggatgcctccagatttctcccttttgtttagtcttgctttggctatgtggggtcctttttgcttccatatgaattttagagttttttttttttctagttctatgaagaatgatgatagtattttgatgggaatcatgtagaatttatagattgtttttgacagtatagtcattttcacaatatttattctactcatacatgagcatgggatgtgcttccatttgtttgtgttgtctgtgatttctttcagcagcattttatagttttgcttgtagggatcttttacctccttggttaggtataatcctaagtattttattttttttacagctattttaaaaggggttgaattcttgatttgttctcggcttggtcactgttggtgtatagctgtgctactgatttgtgtacattcattttgtattctgaaactttactgaatttatttatcagatctgggagctttttggttgagtctttagggttttttaggtatacaatcatgtcatcagctaacagtttgacttcctttttacagctaacagtttgacttcctttttacagatttggatgtcctttatttctttctcttgtctgattgcactgtctaggacttccagtgctatgttgaatagaagtgatgaaagtggacatccttgtcttgttccatttctcagggggaatgcttttaacttttccccattaagtataatgttggctgtgaattcatcataggtggcttttattaccttaaggaatgtctcgtctatgccaattttgctgagggttttaatcataaagggatgctggattttgttaattgctttttctgtggctattgagatgaccatgtgattttttgtttttaattctattatgtgttgtatcacatttattgacttgcagatgttaaaccatccctgcatccctggtatgaaacccgtttgatcatgatggataatcttttttatacgctgtttgattcagttagctagtatgtttttgaggatttttgcatctgtgtttatcagtgatattggtctgtagttttcttttttgttatgtccttttctggttttggtatcagggtgatactggcttcgtagaatgatttagggaggatttcctctttctctgtcttgtggaatagtgtcaataggattggtaccagttcttctttgaatgtctgatagaattcggctgtgaatccatctggtgtggactttttttttttggtagctttttaattaccatttcaatcttgctgcttgttactagtctattccgagtttctctttcttcctggtttaatttagaagggttgtatatttccaggaatttatccatctcctctgtgttttctagcttatgtgtgtaaaggtgttcacattgttcatggtagccttgaatcatcttttgtatttctgtagtatcagttgtagtatcacccatttcatttctaattgagctcatttatatcctctctcttcttttcttggttaatcatgttaatggtctatcagttttatttatcttttcaaagaaccagctctttgtttcacttactttttgtgttttttgtttgtttgtttcactttcatttagtcctgctctgatctttgttatttcttttcttctgctggatttgggtttggcttgttcttgtttctctagttccttgaggtgtgacctttccttgtctgtttgtgctctttcagactttttggtgtagacatttaatgctgtatactttcctcttagcactgcttttgctatatcccagaggttttgataggttgtgtcactattattgttcagttcaaataattttttaatttccatcttgatatctttgttaactgaaagatcattcaggagcagattatttaatttccatgtatttgtttacttttgaaggttccttttggaattaattcacaattttattccattgtggtcttctgagagagcacttgatataattttgattttcttaaatttattgaggattgttttatggcctatcatatggtctatcttgaagaatgttccatgtgctgatgaaaagaatgtatattctgcagttgttgggtagactgttctgcaaatatctgttaagcccatttgttctagggtatagtttaagttcattgtttctttgttgactttctgtcttgatgacccctctagtgctgtcagtggaatattgaagtcccctacaattattgtgttgccatctgtcccatttcttaggtctagtagtaattattttataaatttgggagctcctatgttaggtgtatggactaatccttttatcattatataatatcctttcttgtctctttagtttttgctttaaagtctgttttgtctgatataagaatagctactcctgcttgcttttggtttccatttgcatgtaatatctttttgtaatcctttactttgaatttttatgagtccttatgtgttaggtgagtctcttgaagacagcagatacttggttgttggatttttattcattctgccattctgtatcttttaagtggagcatttaggctatttacattcaatgttagtattgagatgtgaggtactattctattccttatgctggttgctgcctgaatacccttttttaaaaaattgtgttgttgttttataggttctgtgagatttatgatttaaggagattatattttggtgtatttcaagtcgtttttcaagatttggagcaccttttatgatttctcgtagtgctgatttggtagtggtgaattctctcagcatttattcatctgaaaaagactttatctcggcttaatttatgaagcttagtttcactggatgcaaaattcttggctgatagttattttgtttagggaggctaacaataagaccccaatcccttctggcttgcagagtttctgctgataaatctgctgttaatcttataggatttcccttgtaggttacctgatgcttttgcctcacagctcttaagattcttttcttcattttggttttagataacctgatgactgtatgcctaggtgatgatctttttgtgacgaatttccaaggtgttctttcagcttcttgtatttggatgtctagatttttagcaaaaccatggaagttttcattgatttttttttttcaaataaattttccaaacttttagatttctcttcttcctcaggaacatgaattattcttagatttggttgtttaacataatcctaaatttcttggaggctgttttttttttaattattttttatttgtctttgtcagattgggttagttggaaagccttgtctttgagctctaaagttttttttttctacttgctcaattctcttgaaactttccagtgtattttgcatttctctgagtgtgtctttcatttccagaagttgtgattgtcttttatttatgatatctatttctctaaagactttttcatccgtaacctgtgttgtttttttaatttctttttttgagatgaggtctccctctgtcacccaggctggtgtgtagtggtgtgaccttggcccactgcaacctctgcctcccaggctcaagcagtcttcccacttcagtctcccaagtagctgggaccacaggtgtattccaccatttccagctaatttttttgtattttgggtagagatggggtttcaccatgttgcccaggcaggtctcaaactcctgagttcaagtgaccctcctgccttggcctcccaaagtactgggattactggcatgagccaccacacctggccatgtttaaaatttctttaaggtagtttttacctttctctggtgcctccttgagtagcttaataatcagccttctgaattatttatctggcaattcagatatttcttgttggtttggattggatccattgctggaaaggtaatgtgatcttttgagtgtgttatagaacattattttttcatattaccagaactgcttttttagttccccttctcatttgaataaactgtttcattggaaagatctggaactcacgggctactgttcagattcttttgccccataagatgatcacttgatgtagtggtctcccccttcccctagggatggggcttcctgagaaccagactgcagtgatggttgtgctcttctgcgtctagccacccagcagggctaccgggctccaatctgatcctagggaatgtctgcaaagagtcctgtaatgtgatctgtcctcaggtctcccagccatggatagtagcacctgctccagtggaggctgcaggggagtgaagtggactctgtgggaatccttggttgtagtttggtttagtgctctggttttctcgaatgccagttatgctagcagtgaagttgtcatgtgaacagactcaggacttgtggttaagctgatgtgtggtaagcagtggaattagctgttgttttctccttctttggagcagggttgttctgttatgagttgctgtcataacttgagttggttggcctctagccaggaggtggtgctttcaagagagcaccagctgcagtagtagaaggatggtataatgttgccctatgttggccaggatgagtactcaggtcatctcaggtgatgggtaaggctgtaaaactcccaagagcttatgctgtcttgtggcatttgcagtggcaagttgcttccttgaaagggtctgtgaattcttttggttttcctggtatgttcctgcagtggttcttggagcgaaagttcacggtgtgagtctccagacgctgttctgtctgcctaagcaggagctgtgcattagacctgtctcctatctgccattttcctcaaaagaattttaagtctatggcttttgatatagattgccaaatgtttccccaaaatctgaaccaattttaaaaaaatttataataattctaattttacttaaactgcccccaaatgtattttataaagataaactatttttctttttttttggctttttcatttaatactagatataaataaattattgaaatttcccagataatgcatgcaattgttttggataaatcagtgggataatattttcttttatatttagttatcaaaatagattaagggcaagtaaagttagggagactgactttctttgtactttctttatacttagccagaaatttttctgttacagaagaattagattgttatttacatgccaaatatatgtttttcgtgcttattcccaagaatgatctttcacatcaataataaaataattaggttgataaatttaagaaccattttaaatcagataacttcacttaaatatgtgcataaaggctagatcttgtcaaaatttccctctcccctctttctctgtttttgtgtgtgcataagcctgaatatatcagttattctatgcttttggaagtatttttgctgacacgttaaaagtttgttttttttttaattatactttaagttctgggatacatatgcaaaatgtgcaggtttgttacataggtatacatgtgccatgttggtttgttgcacccattaacccgtcatctacattaggtatttctcctaatgctatcccttccctagcccctcaccccacaacaggccccggtgtgtgatgaaaccgttgttactagtttttatttcttaaagatgatgaacttgtatataaaaatattcttttaacattttagaaataaattttataagactgaaaggacaaactattagtaaatgtttcaaaatgtgaaaaacactttagttatagttatgtaatatcttagtgacctctgtaagatgtaatattttaagggaagttttacctatgtgaaaacgggagagtaagagtctgttggatattaggcaaagttcagtgatttggcaacaacagttgtataagatttcaaaaattgctaattgaatctgatataccaacatctaactagctggtacatgaactatagattacaatacattttttaaaaaaattgaggagtcagtgtattgaacaccttttaaaaaatttcaatttaagttctgggatacatgtgctgaacgtgcaggtttgttccataggtgtacatgtgacatggtggtttgctgcacctatcaacccatcatctaggttttaatccctgcatacattaggtatttgtcctaatgctctccctttcctttcgccctaccccccgacatcccccggtgtgtgatgtccccttccctgtgtccatgtgttctcatttttcagctcccacttatgagtgagaacatgcggtgtttggttttctgttcctgtgttagttgctgaggatgatggtttccagcttcatccatgtccctgcaaaggacatgaactcattcttttttatggctgtatagtattccatggtgtatatgtgccacatttgctttatccagtctatcattgatgggcatttgggttggtttcaagtctttgttactgtaaatagtgctgcagtaaacatacatgtgcatttgtctgtatggtagaatgatttataatcctttgggtatatacccagtaatgggattctgggtcaaatggtatttttggttctatatccttgaggaatcgccacactgtcttccacaatggttgtactaatttacactcctaccaacagtgtaaaagcattccaatttcaccacatcctcgccagcacctgttgtgtacttgccattctaactggcaggagatggtatctcattgtggttttgatttgcatttctctaatgaccagtgctgatgagctttttttcatatgtttgttggccacataaatgtcttcttttgagaagtgactctttgaatcctttgcccactttttgatggggttgtttgctttttttcttgtaaatataagttcctcgtagattctggatattagctctttgtcagatggatagattgcagaaattttctcccattctgtaggttgcctgttcactctgatggtagtttcttttgctgcccagagtaattgatagattcagtgctattcccatcaagctaccattgactttcttcacagacctagagaaaatgactttaaatttcatatggaaccaaaaaagagcctgtatagccaagacaatcctaagcaaaaagaacaaagctggaggtactgaagatttaaagactataattttcagaataataagaattttggaagcacttgaatttcttataatttaaggtgaaatgaactattttgcttgagagcaactcatctgtgaatataaagatatactgattcctaacacttgcattatctatttgcttttttctgtttaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcaggtcagaatagtcaatatcaaaataaaaataatggggtggaaggggtagatacttgtgatttttgtatatcagaaagagaaagcgcagccttaccaccacttctatttcatcagaaatagtttaagattttaatgcaaagcctgtttccttgagttatatagttcaagctctatttgtgtccaatactttctgccacctgttctagactattcataaatgttcatatattttaaatctaacaatactagtaacaatactgttagcaacatctgctaattactgagtgtttaccttgactaagtacttgttaggatctttacaaatgttactttatttcgtaatcaaaaaatcctagtaaggtgggtggtaacattatttcttctatgaggaaacagaggtttaatgaatataaggaacttgccaagttttggggctaagaagtgccaagtcagagtttgaatctagatcttttttactcttggcagtgaacatgttttgcttaatcatgttgttttttatgcctcattcaagatgtatttatagaaattaaatatctcttatggacactaaaatggaaaattgatgattcatgtctgcatttggagagagtaaaattaaataaggatgaaccttaggaccagaattctgactaggaaaagaccttgaaaattacccagagagacagtatgattagtgttattgggatcaagaatattttaagatcatatttaatagagagtggacagctcctaattatatataaatttagtgaatactggctgaaaaatatgttattgagcaaaaatctaaaagcagaacattggcaggaagtcctggatcagcttttgttttgttttgttttttgccttgtaccaagtgtacatcctttaaaccaaatggtcttgaatttgactctgacttcactatttactctctgatcttgaacaaactactcagcctctttgagccttggattattttatttacaaaatcagaatagaaatatttaacactcatgattgctatgaagatttaatggaatggtttgatagttccctaatctatgtaaatcctgcctaagaaagcatctagttaagtatttttatacataaaggggctcactggatctgcctcagctggtttcaagatttaatggagaacagaattttcaatgattacttatcataaatgaattaaaatttttttttctaagatgtattgaaaggtttttattcttctggagctcagagagtggaatttgcagttcctcttacatgtgaggaagggagcaatgcagcatggacatggatgctctgtgtaaagttcccattgggaaatacaataggtcagcattggccaactactttttcttagtaagagaagaaaattagggagttctatgtagtgagggattatacttttttaagatttgaattttcaactgcctagatcccatcaggttgcaactttccattcctcataaatatgaacaaaaatatttaaaatattaatagtgaaaagcattcactgagcatccagcaagtcatctatgccagcaacctaagaattccagagctggccctagtgaagatggtatacatggtgctgggattttcagaggttagagaatgacttatttaggaagaataatttaatgaagacctatatcataaacagatcattctaagtaaaaagttacagacaagaaatttttggtctttcttgggagttattgcctaagcctatcatgacacatttttttttaacctggaaagaaagaacttataaactacagttggaatattatgtaataagtaagttaacattatttttagaagatgggagaatatgcttgtggcagtggacttttgcattaaggtagatcagacattccagtaaaatgtaataataaattaatgtgataatgaattaaaataacttttactttgattagtcacctcaagagattcaagcacttattcaagcatgtaataaaaacttatttctgtgcttaaggcattgctattaataagatgtagtccctacccctagaggttcacaaatctgtttagattaaggtagggcccaaagcagagagtggttactctcacttcagatgatcaaagaaggcttcataaaagaggtcattccttagctgagccttgaaacatatatagttattccccagatagtctaggtgatgactggggaagggtaactaagttaggggcttgaaataacactgtgttgatatgaaaatcaatacattaagtctggctgagaatacagtttgctgctggtgtcatggggaaaagactatggctaacaaaaagacagaggtgtaagagacaagtcatgcacacctatgtgtaaccaagctcccttccattgtggatggaattgggagccttttgagtaacatgattagatttgggctttggaagaatccctcacacagctacggaggatgcctcggatgagcctgttctgaagaggggagacctggtaggagacactttcggcatctaggaaagggaagagagattgagcagataattagttcacgttgttaagacactggtgagacatccaggagaagacagccaaagccattagatggagatctgctcttcaaaagagagcagtaggtgaaatagacagacgggaggcggtgtccagagacaggtggcaggtaaccattgtgagttagttattagagaggttgaaacattagaagagggcaaagaagtccaagaaactctaatacataaggaatggtgaaggagagggaagcagcaaggaaactgagaagtccctatcctgaagagggatgagatccaggaatgctgtcgagagccaaggaaagagggatttctaaaagaagtgcataagtaatggtgcaagctgcttgaggaagtggagtaagatcaggcctgcagagtccaggagcaattagaagggctttggtggccttttgccagggccttttttttttctggttgagggagaaatctgattgcagaggactaaagagacagaaggggaggtgagtacgtggaaaaagaactgagtctactcagtctcgttatctcaaggaactcatctgtgaagggaagaggagggaagaatgcatttgctctattattatagttgatagtattgcaagtttataacagcttgaagctgtatctgtatctatattaacctgtccgtgcttttacagagattagatatggcttttaaaaatttttttaattttatttttaatgtttgtgggcatatagtaggtgtatatatttatggagtacacgagatattttggtacaggcatgcatgcaatgcataataatcacatcgtggaaaatgtggtatctatcccctcaagcatttatcttttgtgttacaaacaatccaattatacttttttagttattttaaaatgtacaactaagttattattgactataatcacccttgttttgctatcaaatactggatcttattcattctttctaactgttttatacctattaatcatcaccacttcctccccatcacccccctgccccaccaactacccttcccagcctctggtaaccatccttctactctatctccatgagttcaattgttttgatttttagatccccaaaataactgagaatagtcaatgtttgtctttctgcacctggtttatttcacttaacataatgatctccccttccatccacattgttgcaaatgacagaatggtggaatagtactccattttgtataaatacattttctttatccatttatctgttgatgaacacttaggttgcttccaaatcttggctattgtgaacagtactgccacaaacatgggagtgcagatatttctgcgatatactgatttcctttcttttgggtatatagccagcagtgggattgctggatcatatggtagccctatttttagttttttgtggaacctccaaactgttctccatagtgtttatattaacttacattcccaccaacagttcacaagggttcctttttctccacatgctagacagcatttgttattgcctgacttttggataaaagccatttttaactagattaggtaagtttagctaaaggcgtaaatgatctcttctttatttttatatttaaaaaatgaataagataaaattaaaatagcatgtttgttattacttggatatttataaaagataaaatagtttgttatttaatttagcctctgcatttgccaaaaatggtggcacgtggtatgtgttcagtaattgttagctattattattctcattgattacctctttgtttggcactaatttaaaatacacaggaattctctctaccctatgtttttctctcggtcggtaatgttggggatttctgagaaggtctcccaaaacagcttccccctttgctggctggattctgaacaagtatgaaacaaagtgtgctcaaggggcattcatcatgtggccaatagagaactcaaatgccatgttaattactgatagaggccaggttggaggtggtaacttagagtgaaggtgagtggagctgtcaaccaaaccccagaatgaggcagaatcaccagcagtcactgggcaaggtggcttcccaagtgagaaaccatacatggaagagtagaaaagaactcagtatcttcatggcctgtcgtcaagtggaccgtatgggctgagctaagcatgcccaattattctccctgaatttacagatcagattcgtcactctacctttgcagggactgtttcaggggtggagaagagaccagagtgtgcttagtgagaaaatccctccccaaggagtgggaggagtgttctcataacaaatctgtagaggcaatccacctcccaggctcctggctccttcattgcctactgaaagtgatcactgtggagcacactgttcagccctacttctctgttctttcctctcattcctttcatgcacaatctgctccttatactgccttctattgtgaacacattctcctatgtctcaaatatttctcgaaacttttccatcacttttctctctaaatgttgggtttccccttaattgcctacttcgcttgaaactcttttcaatagaggttaatttcctcattttcctcacctagcagccaatgagaatattctgaatctctaccaactgctatggacaccaaacggcctgaataccagccataaacatcaaatgtggtgccagaaaacactggctgaaaagggagccctgtcacacagggataagagggacaattgccagcctcattgtgactcattaagcattgcttctccatctttcaacaacatctccttagaagtgaatgcatccattatcctaatctttcatcatcttatttctgcttcttcctgatctatatataggacatgcttctacattcctcattaattcaagtgtccctttacttttttttttttttttttgagacagagtcttgctctgtcgcccaggctggagtgcagtggcacgatcttggctcactgcaacctccacctcctgggtttaagtgattctcctgcctcagcctcccaagtagctgggattacaggtggctgccaccacacccaacttatttttgtatttttagtagagacgaggtttcatcatgttggccaggctggtctcaaattcctgacctcaggtgacccactcgccttggcctcccaaactgctgggattacagacgtgagccaccacgcccagccccatttaccttttattctccatccttttctccactattattgttggtgccaatatccatattcacaactttttatattttgatttccaagtttctttttactttatctgtaaatgcctttatccctgttctaagtcccgtagaccttgtcacactgggagtcagttaacatttcctgtcatcttggcatccctgagataatcaatttccaggagatcaagggcagactgttttccagagtacacattttattttattacattcgacctggccatgtgcatctgaatgcaattggttttcccctattagttagtgaagagccctctgttgtatcaaatcaaataagaattgttttcaacctcatcagtaagatggctctccttcacattaaggttatgagtcctatccaggggggtgccttccttcattagcttattatatactggacctgtctatctactgttatttaactttacagttttatccagttcatttttattttttacttatttattttttaaaagttttacaatttcagtagctttaagggtacaggtgattttagttacaaggatgaattgtatagcggtgaagtctgagattttagtgcacccatcacttgagtactgtacattgtacccattttgtagttttattttttttatccctcactgccttggtaacctccccgacctctgagtctcatatgtccattatatcactgtgtatgcctttgcatacccatagcttatctcccacttgtaagtgagatcatgtagtgtttggttttccattcctgagttactttatttagaataatggcctccagctccattcaagttgctgaaaaagacattattgtattcttttctatggctgagtggtatttcatggtatacacataccacatgttccttatccactcatggattgatggacacttaagttggttccaaatctttgcaattgtggattgtgctgtgataaacatacgagtgccagtgtctttttgacataatgacttcttttccttttggtagatacctagcagtggtattgctagatcacatagtggatgtacttttagttctttgaggaatctgcttagagattgtactaatttgcattctcaccagtgtttaagcatccccatttcaccacatcctcattgacatctattgttttttgactttttaataatggccgttctggtcagggtaaggtggtatctcattgtggttttaccagcatttccctgaggattagtgatattgagtgtttcttcatatgtttgttgcccagttgtatatcttcttttgagaaatgtctaatcatgtcatttgcccactttttagtaggattatttgtttttgttcttgctaatttgagttccttgtagattctggatatcaattctttgttgggagattctggatatcaattctttgttgggtgcattgtttacaaatattttctctcattctgtgggttgtttttttgctctgttgattatttcttttgctgtgcagaagcattttagtttaagtaggtgccatttatttatttttgttcttgctacatttgcatttgcttttggggtcttagtcataaattctttgcctaggccaattttcagaagagtttttcctagaatttcttctaaaattgttaatggtttcaggtcttagatttaagtctttaatccatgttgagttgatttttgtatatagtgagaaataggaattcagtttcattcttccacatgtgactttccagtgttcccagcatcatttattgaatagcatgtcctttttccaatttatgtttttgtgtgctttgtcaaaatcagttggttgtaagtatttggctgtatttctaggttctctattctgcttcattggtctatgaagatgcttgatataattttgatttttaaaaattaattgagacttgttttgtggccttatgtattttggagaatgttccatatgctgatgagaggattgtatattcttcagttcttgagtagaatgttctgtaaaaagcagttcagtgcgcttgttctagagtgtagtttaagtccagtgtttcttggttaactttctgcctcagtgatgtgtctagtgctgtcagtatagtgttgaagtcccctaatgttaatgtgctgcagtctatctcttttcttaggcctagtagtaattgctttctgaatttggtagctccagagctagacacatacatgtttaggattgtagtatcttcttgttggattgatccttttgtcattatataatgaccttctttgtctttttttttaactgttgttgcttttaaagtctgttttatctgatataagaatagctactactgttcacttttggttgccattcgcatgtcatattttcttccactttaccttgaatctataagaatccttatgtgttaggtgagtgtcttgaagagacactttgggtgtttttatccattctgccactatgtcttttaggtgggaaatttagaccatttatgttcaatgttattattaagatgtgaggcactgtttcagttatcatgttgattgtcacctagacactttgttttctttattgtgttattgttttatagacccagtgagttttatgctttcagaaggttctgttctggggcataatgacctttcatttcaagattgagaactccttttagcatttcttgtgtggctggtcttgtattgacttgcatatgttgaaacattcctgcgtccctgggatgaaacctacttggttttggtgagttatcttattgatgtgctgttggatttggtttactagtattttgttgaggatttttgcatctatgttcatcagggatattggtctgtacttttgtttgttaggttgtttcctggtgttggtatcagagtgataatggcttcatagaatgagttagggaagactttctctttctcacctaacgcataaggattcttatagactcaaggtaaagagggtgaaaatatattatttgcaattgaaaaccaaaagtgaggagtagctattcttacattagataaaacagactttaaagtaaaaacaatcaaaaaaagacaaagaaggttattatataataatgaaataatcaaacaagaagatattataatcctaaatatatatgcatatgacaaattcctttggcatttggctgtgtgaaaaatactttatttctccatcatttatgaaacttagttttgctgaatacaaaattcttggctgacggttttttctgtttaaagaggctacaggtaggatccaaattcctgttagcttgtaaggtttctactgagtctgacttagcagtctgctaagtctgctgttcattcgataagtttttctttataggttacttgatgcttttgtctcagtgctcctagaactgtttcctgcatgttgacattagatagcctgatgactatatgctttgctgatgtcctttttgtagtgagtctcctaggactgctttgtgcttcttgtatttagatgtctaatccctagcaaggctagagaagttttcctcagttatttcctcaaataagttttcaaaactatttggtttttcttctccctcaggaacaccagtgattcttagatttggcccttttacataatcccatatttcttgaaaactttgttcatttcttttcattcttttttctttaattttgtttgattgggttaatttgaaagccttgtcttttgacaggcttttgacagaattttgacaaggctctgaaattctttcttatacttagtctaatctattaaaactttccactgcgttttgtaattccttaaatatgtattccatttccagaagttctgtttttttaaatctatctcattagaaaatttttcattcatatcttgaattgtttttataacttctttatgttgtttttcacttttctcttgtatctggttgagtaacttaatagtcatccttttgtattctttatctggtatttccaaagatttcatattgatttggatttattgctggagagctagtgtgatcatttggtggtgttaaagaaccctgtttggtcatattgccagaattatttttctggctccttctcattgcagaaaactatttattctaattattttttaatttattttttgttcgactatgtgttcttttaaatttctttttctctccttgaggatgtgattttaatgactctagtttattgtaacccaattcagctctgcatggtttcaggggtgaagactctgtatgagttccttggttatagagtctgtatgatggctttctcagatactcattgtagtagtaatgtgcttggtgtgtgagtgggttcactgtctcctgtggcattggaatggcagtggtctcttgaaggttatctcattccccagtggtgtgcacttatttattttatccagtatttcatttactaggttgaacagttcaggtttcaggccagtagtggaggtgtccatgagtaaaaaccaaacaggtgggtaatgtaatacccagtgatgcacagaggtcccagccttgacagaggcagctaggggatctctcagggaaatgcactgaggtcttttcagggaaaagggaggaagctacctcagccctcctgtcaggccagcaggaaagccccactacccagtcactctcctgacccagtttcctggctattcagatgacacagatacctctttccatctgtaggaatgctgatgttacatatagagagggactgtgactctacccctcatgtaagcctgaacctggaaggtacttctcttgtggggatgcagtcaccccactgttctagaatggctgtctacaggtgcacccacgccaagctcctgtgggagcagccccaggtgtgtctgcaatggtgggtgaaggagagaagtcccctcctccaagacccttcaggagcaccagggctgcctgactcttggggcagagctgcagactttctccactgagcccagcattacacccatgcctctgctgaaagaaacttcccacaggtggaaatgtctgggagtcaaggcctgctgtcttcattcttttgtcattcttttgtcccacgggttgctcccttgatgtggagcactccctctttcccctaggaggaggaatccctgagggccagactattgtgaatgctgctgctccactcagtctagcaacccatttggactgccacagtccaggctggtgcagggggaatgtctgcaagggatccagtgatgtgacctgtcctgaagtctcacagcagtgggtgccagcaccagctctgaggggggttgcagaggagtgatgtagactctgtgatattccttggttataaatagccttagtgtgttggctttctcacatgccatgtgtaatagtaacgaacaggtcacgtgggcagactcagggcctcctggttagccagggtgatgcaggtaatggtgacggccaaggtcacacaagttttccccttcctggtgtggtgttattctccttgcagatgctatcatggagtgagtcagttggcctccagctagaaggtggcacttggaaaagggcactggctgtggtggtactggtgggatttatgctttgccttatgttacccaggggaggtactctggtgtcccaagcaatgggaggggccatagagctcccaaaagtttctgttttttttttttttttttttttgtgtgtgtgtgtgtgtgtgtgtgtgtgtgtgtgttaagctaccaggaggagtgaaggggcaaaaccaggagggaggtgggtcaggcaagtccatgctctggctctccacaggcagacgcaagcagcagccctagtgggattggaggacagtttgctggctgctggggtagtgttccaaggaggagcacagctgcctctgctgcacagaagagtgcaaatgaggggggtgtagccagcagcagtaagacccacctagcttccctgcacttggcaaggcaggtctcacatctgcagcattccactaacagcaacagctagcaaagttccagccagtctgcactgaaactcaaaactgccccagatcataagccttcccagtggagatggaaactgcagggctttcaggccatgcccatcctcatctgcccatgaagcaggggcacccagctcctatgcccactcaagtttatatcatgaatttcagttgggagcatctcttaacctgcgacccgtgcctgagttaattggctgacctccacaaggtctcctgtgagacaggatcaggaatgacttcccttcatccctctggagactgggagtgcacacacagcacatcccgatgtggttccttctcatctactccccattgctcactacaccagctccggagctgggtagggttaaggccttttccctgacctggattgccaggttccccggtgggtgtgtatgtgctgtaggcagtttctccctttttcacactctggggacttacaatttttggcctggctcatgatatacactgcagcctgctgcttctttcaaagggtctgtggtgtctgtcagttttcttgttaagttcctgtgttgcttcttggaaataagttcacagtatgaatctttacacactatttcgtctttccaagtggaagaagcatgctaacaatgcttccaattcaacatctagggaaaaaaaaagttttattcagtttatatgctagatctacaatatttcaacttgattatttatttatttatggaacagagtcttgctctgctgcccaggctggagtgcgatggtgcaatcttggctcactacaacctccatctcccaggttcaagtgatgctcatgcctcagcctcccatgtagctggaaatacaggcacgtgccaccatgcccagctaatttttgtatttttagtagagacaaggtttcgccatattggctgggctgctctcgaactcctggcctcaagtgatccaccctcctcggccttccaaagtgctagggttacaggcgtgagccactgcacctggccccaacttgattatatttaaatgcacatcctaaagtattttcaactgtcaaattctccagcttttaaacatttattccttttttttcctgaattttcacatctttcttctaatcttcagttacttaaacccttcctcttttcagactccattaatcccttctacctagtttggagcccatcataagatacttcagcagtgtcaagagcttgaatttcctttccccttttaacttcttctatttcccagtctctgacattccaatgtccatactctctctatcccttgtctttaatcttggattctgcctagtgttgcactagaaagtgaaaaatggtaacattgatcctgctataatttgatactttctacttaaaattggcattgtgatttgcaatgattttctattatattcaccaccttgtctattttattttattttttaattatttattatttagatttcatgtttattttatttaacttttactttcagttcagggtacatgtacaggtttgttatataggtaaactagtgtcatgggggtttgttgcacagattatttcatcactcaggcattcagcctagtaccctatagttatttttcctgatcctctccctcctcccatcttccatcctctgataggccccagtgtttgttggtctcctctatgtatccaagtgttctcatcatttagctcccacttataagtgaagacatgtggtatttggttttctgttcctgcattagttttctcaggataatggcctccagcttcatccctgttcctgcaaagaacatggtctcgttctttttcatggctgcatagtattccatggtgtatatgtaccacagtttttcaatccagtcttatcattgatgggcatttaagttgattccatgttgttgctattgtgcatagtactacaatgaacatacatatgcatgtgtctttataatagaatgatttatattcctttgggtatatacccagtaatgggattgctgggtcaaatggtatttatgtttttaggtctttgaggagtcgccacactgtcttctcaatagatgaactaatttacactccaaccaacagtgtaaaagtgttcctttttctcctcaaccttgtcagcatctgttatattttgactttttactaatagccattctgactggtgtgagatggtatctcattgtggttttgatttgcatttctctaatgatcagtgatgttgaaggtttttttttaatatgcttgtcagctgcatatatgtcttcttttgaaaagtgtctgttcatgtcctttgcccactttttatggtgtttgttttttccttataaatttgtttacattccttatagatgctcaatattagacctttgtcagatgcatagtttgcaacaattttttcccattctgtatgtttactctgttgatagtttcttttgctgtgcagaagctctttagcttaattagatcccatttatcaaatttttgcctttgttgcagttgcttttggtgtcttcatcatgaaatttttgcccattcctatgtgtagaatggtattgcctcagttgtctttcagggtttttttttttatagttttgggttttacatttaagtatttaatccattttgagtttatttttctatatgatataaggaagaggtccagtttcaatgttttgcatatggctagccagttacccagcaacgtttattgaatagggaatcatttccccattgcttatttttgtcagctttgtcaaagatcatatagttgtagccatacagccttatttctgagttctctgttctgttccattggtctatgtgtctatttttataccagtaccgtgctgttttggttactatagacctgtagtatagtctgaagtcaggtatcatgatgcctccagctttattctttttgcttaggattgccttggctattgtgctcttttttggtttcatatgaattttaaaatagttttctctagttctgtgaagaacattattggtagtttaataggaatagcattgaatttataagttactttgggcagtatggtcattttaatgatattgatccctcctatccacgagcatggaatgtttttctattggtttgtgttgtctctgatttttttgggcagtgttttatagttctccttgtagagatctttcccttccctgattagctatactcgtaagtaatttatttttttgtggcagttgtgaatgggattgtgttcctgctttggctcttggcttgactgttgttgatgtgtaggaatgctagtgatttttgcacattgattttttttatcctgagacgctgctgaagttgtttattagcttaaggagcttttgggctgagactataaagttttctggatatagaatcttgtcacctgcaaacagatatagtttgacttctcctctttctatttggtagccctttatttctttctctttcctgattgccctgggcaggacttccaatattgtgttgaaggagtggtgagagagggcatccttgtcttgtgccagttttcaaggggaatgcttccagcttttgcccattcagtatgttgttggctgtggggtgttgtagatggttcttagtatttagaggtatgttccttcagtatctagttcgttgagaatttttaacctaaggggtgttgaattttgttgaaagccttttctgcatgtattgagataatcatgtggtttttgtcttgttctgtttatgtgaagaatcacatttattgatttgtatatgttgaaccaaccttgcatcctagggataaagcctacttgattgtggtggattagctttttcatgtgctgctggattcggtttgccagtgttttgttgaggatttttgaattgatgttcatcaaggatattagcctgaagtttttttggtggtggttgtgtttctggcaggttttggtatcaggatgatgctggcctcaaataatgagttagggaggagttcttcctcctcaattttgtggaacagtttcattaggaatggtatcaactcttctttgtacatctggtagaattcagctatgaatccatctggtcctgggcttttttttgggtggtaagctatttattactgactcaatttcagagctcattattgggctgttcagggattcaatcttttcttggttcagtcctgggagaatgtatgtgtccaggaatttatccatttcttctagattttctagtttatgtgcatagaggtgttcataatattctctgatggttgtatttttgtggggtcagtggtgatatccctcttgtcatttctgattgcatttatttgagtcttctctcttttcttctttattagtcttgctagcagtctatctattttatttcattttttttcaaaaacccagctcctggataagttgatcttttgaatggtttttttgtgtctcagtctcctacagttctgctctgatatcaccatgcctattttaaaagattttgatcctttttagtccccaaattctctctctgcaggtggccttttttttttttttgagagtgaggctatctgattgatactctttatgctacttggagtatttaatatgcattggttctgtatttcacattatgcttttattgcgctaaagttgatattaaagttttatagcataaaatgtcatggcagggaacatttgctctaatttatcataattttttaaaaagaaaatgtctgctaagatcataataacagctaatatttatatgctagatctaccctaagtgttttacaggtattaacttctttgaccatggtgtggccattggaacaatgtaataatatgtggctcaataccataggttaatatcttaaacgttatttttcattctctttggatagccatgattaaactttttttttttttttgagacagagtctcactgtgttgccagggctggagtgcagtggcatgatctcagctcattgcaacctccgcctcctgggttcaagcgattctcctgcctcagcctcccaagtagctgggattacaggcacccgccattacgcccagctaattttttgtatttttagtagagacggggtttcaccgtgttggccaggctgctcttgaactcctgaccttgtgattcacccgcctcagcctcccaaagtgctgggattacaggcgtgagccactgcgctcagcctaaactttttatatgctaaaatccaacatgctacatctcctttagcatctaaaacaatacatacaatgataaatttcacttcaatctgtacaagagaagaatgctaatgatttgaaacgtcagctagaagacaggctgtcaggaacttttattatattttttactcactggaaaaatatgaattggaaatacactaataagttctctgctgtggataacatgggtttaaattttcatgttaaacttatttaatttgagattgtcttaattaaatatccatttatcagcataatgatgtttaatatagatctttattaacatggtttcaaaggccagtaaaattgtcaaatctaatgaaaacagagttcaaagataaaattctatcttccctttcttttatgagtctattaaaaattcagggcacctttttaaaagcccgtagagaagattaacctttaacatcatcatttaaatctaatgttaccacattttacagtgtcattgacactatgtttagccttagatagttgcttttcctaaccatattgtgaaactactaaattttttttttttccaaatctaatagaggaactgctctcttttttttctggtttctctagtgtagcacattctaatagaactttctccaatgatagaaattatctatatctacactggttaatacaattgctgctagccatatgtggcctaatgagcacttgaaatgtgaccagtgcaactgataatctgaatttcaaaatttactcattttatttatcctaaattaaaatttaaatagccacatgctgctgatgtctactgtattggaatcacggctttggtgttcttttcagcaccgtcagactgaattctgaagacttgactcttttctcctaatatgtcttaattcctttcctgggagtaggaacaatcttttaaagttacttgttgttcttggactaataaaggtattttctttcattataacccaatttatagtttggagattttaccataaaccaaaatatatatatatacttttgtagtaagaataccaaattggacatttgattctgggtagtcattacacaacagaggatgggatatctgccagagtgggtgctccgtaaatgtttacttgtgctgagtaaatgaaaaactgtattttattttaaccaatgctccttctcacacttactcacactatttccttttatatctgtacactgggagaaggaataataacttgcttgaagatacagtttgtttgaaagttggaggcttttgctgatttaaaacagatactggtttgtagttacttccataattcctttctactgtgcttaaatgatgaagtaccatttttatgggtctttaccttctaacatgtttttgcattacattttttaagaataactggtcacttaaaaatacttatagagttgtaaaaaatgattcaattttaaaaggagtaacttgcgtaaaagatattctgtagtagacatcatcctaggttgataatacagtcaataaaagtgtttattgctttgtacatatcaaagtactaaaggagtgaactgaagcagctgagatgttagaataagtcaattgtctaaaaatatgaatgcccacagatatgtttgataaagaaatgttttatgtgaagattttgaaaatctggttgatcactagttatcaatagtcttagagaaatttaagttttaaaatgcttataggataattgagaaagtaccactaagctgaacgcaaatttaaagtttcttcttacaaagcattcgacctgttgcccaagaaaaggctttcatctttcaagatgaaagaattaaaatgaaactagaacactgaaggctgctacagaagcatgcatttatttgagcatatggtagtaatccactaaacacatagttataatctatttgagaataaccagaacagatttgccagacaaagattctggcagatcaacttgctttttactatgaaaaatcaaagatgcagagaagcacacatataccaatgttttctttttgatttcaaagccacttcagcatttcttttaaaaagtattgtcttcatcctcataattaatagatagtttttcagattctaaatactgtaagtttcagtaatcagtttcattatttctgtgcagtcaaagaagactgcattggaaaatatgtttgtgtgcatttcaatacaataagtgtttgcaactcaatttcaaaggaatataatgtgtgatttagttattgattattgagttaaactacagacgttgaagatgcaggatcaaatcatctgaaataaaagggcagggaacacgtataaatgttttgcacacggagacactcaagtgcttcttgattgaggacatctgatttctagctggttttgcaattaaaaatattggaaagaaattgcagtagctcagtcaaatttatttgctgcaaaatggcttagaactacagagaattttcagttaatataattgaaattatttagttctgctctgtgacaagtgaaattattagttatcagggaaaggtaattacatatttggcctaaagttaatcaatatgaacacagaaaagctggagctcaagcagaatcaggaccttgttaaccacagttttgtaaaatgagttcaattgtagcacctgtggaataaatagaactgatcataaatacaagaaaataaattttctaatcatactgttctcagagatttacaaaatgctttgaacttcgttctgtatttaaactttttttattatttcacacagcgttttttaatcagcatatgctgatgaaaggcagacgtgtgccttgttacacctctaaacctcaaagatcatgggcagtcacagtaattccatttccccaagttaaggcataagcccgcattcacagtctgccctctgggatgatgcaggattgagtcaagcccagttcgattccttgagtcgctggagttgtttctgactgatccatattttcaaatccagcccaccagtgggcctgaggctggataagtgggctttcaccagggccctaacaagagcaaaaaaggaacatgtgcatagatttatactcctattctcaagggcctttgctcttattggaaccttaaccatatcaaaatgtatttcctaaacatatctgtgattatggagttcataatctaagaatctgaaggtgcatttctgtgttaaatgcagaaattattattgaaacaaagacctcacctttaaatgagagtataaagtactgcagtgactttcgcccaactgttctctattcacactggtcatttgtcactagacattggtcaaccttaagccaaatagtatcctgtcgaagcaatgcctgattattttccaactttttgaagtaaacattgctattgttctgctttttggttacaacagaaggagtttttggttacaagagaaagtaacacatcagtaatttccattcctaaaaaagttaatcaagaccaggcgcggtggctcacacctgtaatcccagcactttgggagtccctggccggtggatcatgaggtcaggagtttcagaccaggctgaacaacatggtgaaatcccgtctctactaaaaatacgaaaattaaccgggcatggtggcacatgcctgtaattccagctgtattcaggaggctgaggcagcagaatagtttgaacccaggaggcagaggtcgcagtgagccgagattgcgccactgcactccagcctgggtgacagagcaatactctgtctcaaaaaaaaaaataataataataattagtcagtggtttttttttttttttttttttttttttggaaagaaaaatactatgagtctgttgtaaatccttaaatggcgtaaaaatagctaaaattaggtatttactgtgctcttagtggttattttcctctctctctctccatgtatagagataaaatgagaaaaaaatatatttggatgtgcgtatatactatacataaactatcaaaacttggtttataattgtacattctatcacggacatccttcttgaaagccttcgttttgtataggtctgtgttttaaattttgatagttattaccaataaatcctctgaatattatagcctattcaaaatagctgtttcttacaggaaatggatatatgtgtgtatacatatgtataaatatatatacttatgtaatatatgtattgtatatatgtatatcatacatatatatgtatatatagtatattataaatacatatatatatgtatttacaaggagtcagtctcttttgtggaagtaaacattacttggtcagataagattattatgctaaaggaaggtagataattttgtgaatgtaatttgcatttctaaatgtggttattattattattattatctctcaacagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggtaagtggataacctatagtgagtcgcttaattcaaattctagtgaggtagatatttgaaatacaattatagataagtatcagagttgaaccaattatcacaggattcccccccccaccaccgtctgcttttagttgccagtagacatttaaagtgcatacattgtttccatttgtattatcttcacatttaactaaatttttttcaaacactaccagtatctgaagtataatattgcttttagcttattatgaagtttatctaaatttctaataggttttagaatcataatatattgaggttttgggttttttttgttttttgtttgtttgtttgtttgttttaccaagtttcactcttgttgcccaggctggagtacaatggcatgatctcggctcactgcagcctctgcttcctgggttcaagcgattctcctgcctcagtctcccaagtagctgggactacaggtgcctgccatcacacccaactaactttgttttttttttttaagatggagtcttgctctgtcacccaggttggagtgcagtggcatgatcacagctcactgcaacctctgcctcccaggttcaagtgattctcctgcctcagcctcccaagtagctgggactacaggcacctgcaaccacccccagctaattttgtattttgtatttttttttttagatggagtctcgctctgttgcccaggctggagtgcagtggcatgatctcagctcactgcaaccttcacctcctgggtccaagagattctcctgcctcagcctcccaagtagctgggactacaggcgcatgccaccatgcccggctaatttttgtatttttactagagacgggatttcaccatgttggtcaggctggtctcgaactcctgacctcaggtgatctgtcttcctcggcctcccaaagtgctgggattacaggcatgagccaccttacccgacctgagaaaatttttaaactacaaattaatcttaaattcaaaaggcatcgagtcataaggaattacaaactatcttgtttgtgtttaataaaagtgaaaaataaggacttgtagtaaaaaaaaaaaaaagtaatgcagatgaagaccatactatttaaaatcattttatgtgttttacttttctgagccaagccttttctttgattacatttttatactgctcaaatttctgttcctatgcaaatgtatacttttactctgatcagccaaaagatatgctgaaatgttatcaactgacacattaatccttagatccttgtgtgattaaatttgtgccttgttcactttccattgatttctttaatatctctttatgcccattttcttgtatatacatatcatcttattttattgtatttttcactcctcccatgtaatgaaagttctcattctaaatctggtcattttaaggtgacactatgattctatttccattttaaaaatgacaaacacgaatgcacacatctcctaaaggaaaatgtcatttatgtaataagttgctttaatacaaaatgataagaccctgaaatttatttatttgctttttgaacccttgtgactagattatcaaaattaccatttgggtgtattttttttctttctactcgaagcaggaatatgatagagaaatagctccaagataagaaaaaggaaaacactgttgatgtatgatatgcaagataataataataatagaagatttaaaatgaccgatttaagaaaatcctattctctcctaactttttctaacttttacttctattaattattcatacagtagtccctttttgtgggttacagtattagggatgaaacagaataacacaaagctcttctaatagatgtgctctgtaaggaatacaagctgcttatggccatatgctaatagtgtttaccgaaatccacatcttgaggtatgaaatgattttcctcttctggccttagcacataaagtatgtatcagcctctcagtctgtcctggctgtattttggcctccctcccagcaaggtaacctggatttaggttgtgttttgctctatcttagagcactgcaggcagttgctctgcttcagtccttgagacctaagcctttaggtaatgaagataatactgataatgatggtaatacaattggttcatttattcagcaagtatttattgagtgcctaatatgaaccagcatattctggtcactggtgactcaataatgaacaaaaccaggttcttacctgattgtgagagatggacactagacaaataggcaataaatatatatgtcctacggtaataacaaaaataaagcaaggtcaagaagatacaggaggatgtgggattataggccaaggtgctattttatatggagaaggtcaggaaagtatcacaaattgggtgatttttgaacagagacctggagtgatgtagtaagcacttagcaacccctcttgaaagtagaacatttagggaaaggaggcagagagcacaaaggccacagagcctgcaatgtttggggcatatttgaggaatagctgggagaccaatatgtttgaaaaaatttagccaaatatggtagataggagatgaagctggggtggcgggtgggagaaagggattcagatcatttaggtccttgaatattctttcttaaggactttggattttactcaatgagagaggaagccatggaagatgtaggtatctatagtgctgtgatctaatattatgtaataatataggtaaattatgaagagtagaatatagaggagttcagcactatttcagtaacccaagtggtggtgaattggaaaagggtatagcaggagagatgatgaagagtaactgctttctgaagacatttggaaagaatcaacaaaatttgctgatggattagatgtgtggaatgagagaagaagagccaaagatgtcagaagtcaaagatttttggacaaagcaaatagaaaatggaagtaccttttagagagataagaaaactgctggaggagcagtctgggaaggaaatgtaagagctcgatgtttgacatgttaagcttatagatgtttaagctgttggatatataaatctgaagttagaagaaagatcaggattagagatgagttagaagaaagatcaggattagagatcaaaattgtcagcctgtatatcagccctgggattggatgagatcacctatagggagagattgtatgtgattgtaccaagggaaaaaaaatattctaagaaatgagccctgaggagccacaacttcagaggttgggaaaatgaggaaactgagaaggaagagccagaaggctagaagaaccaagagagaacagagtccaggatgccaaaggaggaaagtgtgttatgaaggagggcgtgatcacaaggatcaaatattgctgagaggttaaataagatgaggacagaaaattaatcatctcgagaccatcttgttgaccttggacaagaggtgttacagtggcatgatggagttggaagcatgattggagtagattcaagagagaatatgaacaaaagtacagaaaaccattttaaggacttttacaacaaaggtaacagaaaaatcagatagtagctgaagaaagaatgtagggtcaagtagtggttttataactcattgctgagtagtgaattatgaaataatatattaatattattttattattcagcatgttctatgctggtaagaatgattctgtgaagtgggaagaatcagtgatgcaggagagaggataccagctcaaacagtggcaggatgcaatccattgcacaagtggagcagtgggtcttaggtctgtctgactccaaatatattcatcatccatttaaaacctacttaccgaataacttttatgtcctagcaccattctaagcactggagatatatcctcacatttttgtttttgtttttacttgagtctgttccctcttttttgctctattatgtcagtttcctagcttagtttatgaaagaatatgaagccacctttttcaccctatctttttctttagctgccttccaaaaatggacaataaagaaatgaatattaacatattattctcaagaactaatattttagtgtataatgctagctttctgctaaattagtactcggtatagattagctgaataagttgattcacagaatttatacaaaaaaccctccagttatctgcttcctctagaacatgacacagtacagaaaggtgtgctgggtttggggtaagcattctttgtaggtcattgctgaagtcacagggctggaggattccttgattccttccagggtagccatcatgtattaataagtaagttagttgccatcatgtttgacattacccttacagaaaagaaaaactcgagggaagaaataaaagcttaaaagatgaattttctggctgggcgtggtggctcacacctgtaatcctagcactttgggaggctaaggcaggcggatcatgaggtcaagagatcaagaccttcctggccaacatggtgaaaccccgcccctactaaaaatacaaaaattagctgggtgtggtgacgtgcgcctgtagtcccagctatttgggaggctgaagcaggagaattgctggaacccaggaggcagaggttgcagtgagccaagatcacgccactgcactccagcctggcgacacagtgagactccatctcaaaaacaaacaaaaaaacccaaaaacatgaattcttcatattttctttataggttgtgacatttgctgttgctttgtgagtaaaggtttgaaagtccagtgtcacattttttaatgtgagacacaagatctgtaatgtagataatctactgtgaattgtgtgtggccatgggttttagggtgcactggaggcaggtaaggagggttgttggctcctcataggtgtgataatttgggttagaggtgtgagtgaggtactggtagtagaaaaggcactgagctagaatgagaatacttttatttaaaggctggctctgtcactgatgacctgggtgaccctgaaaaagtcatttgacttacccaagcttcagtgtatggaaataagtagtatcttagttcctttgggctgcagtaacaaaatactataaactgggtggcttataaacaatagaaatttatttcttacagttctgaaggcggagaagttcaagatcagtgcactagtagatttggtgtctgccaagggcccactgtctggttcatggatgatgtcatctcactgtgtcctcccatagtggaaggtagtcttttatatgatactgatcccattgatgacagctcctcactcatgccctaatcaccttccaaagacccacctcccaataccatcactatgggagttaggatttcaacctgtaaattttggtgacacatagacattcaaactgtagcaagtagttccatttctacacagaattgttctgacaatcaaatgaaatagtggaaatgaaagtaatttaggaaaagtaaagtgctgaagggcagtatataattttatttaattatgtatattctgtcaaaagcaaccttctttaccaattgccaagagtaatgttttaaaattacgttactataaatattatataaaatatatataattaacattaattcatactaatataaatctacattattacagttagggctaatgattatgcatttgtagatttagagcaatatttaaagaagtgtggtacctacccgtaattatttatcttactgaacatcatcagtcataattatcgaatagtctaagcatagtttaaccttagccttgcatccaagaattcccttcctaagagtttatttaatagtttttggccagtgttcgaacataaacctaagtctctaacttatcctgagtcttttcttgaaatcaaaatctcttatgggtgtgtaagagattgctctatatttcagggcagctttttttttttttaagtccttgaaaatgtccttttcctctgctgtcatattccattgatcaggaaaagtctttatttagtgtatattcatgtataatttagaattgtcaattactggactgaaagaaccctaagaaataagagtccagtcctcttatttacggtagaggaacatgagaggcacagtgtagtttaagcaaacctgagttttcatccctccttccctctcttactttcatttacttactatatgcctggcagtttattttattttttaaggaaaaataactttattttgaaaaaaaatcaattctctatttaaagcatacatgagacagcatctttcatttagtcctaaacttgattacgtattctcattataatattccaatgacattctgcaaatacatttcaagtatgtcatcatatacttattggtaaatatcaaacaaagctactgactgtgagggaaaattttccgtaattttttttacctacccagagatactcatcccactgtatatctgggatttttatgaacatttacaaattttaacaaaattcttttttttcccattgcatgcatcaatatgctaaattctccactacaatccaggtaaaatactgatagtgtgtgaaaacccagtgtattttctaatactgcccatgatagacagagtgaaattacagcataaagagtagccaggaacctatactgtaaacattatttggctccaagtatcttgcaacaaatagctactaataggactatacatagcacatagagcacagcaatcctggattgtagtatgcctgtaaaaccctttaaagcattttttctcaacctttttatcattaccctccttttcaattacaaaaattaaattcaaattaaattaaatagctttaactataaatttcttcctaatgagagaaattaatacaaaagattttgttgggtaggctgattttggaaggtcacaatccatatctaagatttttttcaccccaagaaccaatttttgttcccagttgagaatgtaagggttaaagttgatgaaataaattaaatagcctttaacattattagagagaaaaaaacctaatgggtaacaatggagattgagatagttgacttctagaccatctctgttccatacttgctgtatgatcagggaagaaatcatgtctctttattttgttgtttgggagaacacaggaatagcataaaacctaatagcttggaaaaatcacttaatctcactggactcagtgaggctattaattgaaagaattggtatagatcagttgttttcaattctggctgcactttcctaggacatataaaagatatcaatgctcagttatatttacccaggccaattaagccagtctctggaggatatgggctcaacctatagtgtaaatcagaatcacctgatgggcttgttaagccacagattggtaggccccactttcagagcttctgattcagcaggttttgggtggggcctgcaaatgtgcattatcaagttctcaggtaatgttatgctattagtctattgaccacactttgagaactgctggactaggcatttgtgtaagagtgaatgtgtgtgtgtggtgtgtgtccccaggtgacttctaatctcaaaactattcgtatagaaaatttcaataaggttcttttaagttctaggatactcagattttaatataataagagttgttaaacatcaagatggcttataaaaggagacctatggacaaatatcaacttcttggtcaattttcattaaaaactcgtttcttaaagctttttacagtatttttttgaaaattaactttttttttttttagctgcatatatgggtcttcacttcacttttcagtaaagataacttatttggttatcagtgtctgatcatttgataagaccaatggaaggtttggatagtagccagttatttttgaattgcttgaagagaatcttgtaaatttgtagtccagaggtaattctgcgattgcttcaatacttggaattgcaatagagttgtaagtactgattcttttacaagaccatgtataaaccaagaagtcttctgtattttccagtcccaaaactgaatcgataaaaaagagtgccattttttagataaagtgtttagaggctttgcctttggcctctcatattttcctttcttctctagaggctctgactcctcgggcctctgactcctcacgccttcatcccctctgagttcttctaggatctaagacaccagagaggtcctggtatagaaaaaaacacagtccctgtttacatgaaatttacattcaagggagatcctctgcttatccttaaacttagagttcctgttctctgtgttttgagaaatcatttcccaaaaggttatggctgagctgtgaactgcgcattgttatcccaaatctcaggttgtctttgcccagtcatccacttctgtaaccccaacttttctcccttggtgttttagtctgtcttttgctgctgtaacagaatgtcagggactgagtcatttataaggaagagagatttatttggctcacacttttggaggctgggctcacagttccagaggcggggaagttcaaatcaagggcctgtatctgatgagggtcttcctgctgtgtcatccaatggtggaaagcacaaaggcaagagagcgttcatgacagagaggagatggaagctgaacttatcctttgagcccactcctgctataactaacccactcccactgtgataatgacattagtccattcatgaaggtcaaaccctcatgacctaatcaccgcttaaaggctgctcctcttaatatcagcacagtgtcacttaaatttcatcttgagttttggaggggacattcaaaccatagtacttcgttgcaattcgggcaagcttttagttcatgtacccatttatttccaatctcttctttaagggaatacagaactcttttcaattataacattatgatgtagctttaaacagaacataaaataacttttaaaaccaattttttcagatatgttttagcttactgaaataaagttgcttctcttttcatttagtcttgtctattattataaattctgttagtattttttctgatctcctactttttaggtcttttcctttttgtaataaagtttaaaaatctttttagctacaaagaactcttgtcttacagctcaaaagtacataattagaatcaatcaagatcaaccctcagatggcttgatactaatattagccaaggttttttattccctaaaagttcccatagaaagaaagggaccttgtacttgatttctaattcattctctaatcttaaggtaatagtttgaattactttatttcaagcaacacaatactgattaatttgacgtaaactctcactgctaatttaagatgtctaaagaatatcagatggaattttgtgaagagacaaagaacttaacactaatttaattattccaaaaggtatgatctcataaatgcaagttttgaataccactatatacaacctttatttaggggttgatttatagaaactcatatattctgagtcttctgattccgaactatctttatatattctagtcctttatatgtacataaatgatttaatgactccttttcaaagttactctttgataatagtggtgccaatcatttcattccccatccatccacccacctatccacactattcaccaaatgtcttaatgttaaagttgatgcttctgtacgaagagcaataaggtatagcctctgcacctcagtgatatattttaataattcctattactaaaagccctgtgcttgtggtttgttggctgtatccagagggaatactttacatttaaatgtttaggtgatggctctgagatttcgccttagaatagggatataaagcaatgctttaaagcatctcctatgttcaaacacctagcggttatagatcaaatataaaaaacagaaaaccaaacatggcattgtgggctccaaaacatgacaatcattctacaggccagaaacaaagcagaaaagcaaactagctagtgatgttgatgctgctggaaaaatgtagcagaccctagtgatgagcaggcaggaagccccatagcaaagactcagctcaaaacccttctcttacacacagaaatgagtgattcacagattggcatcctttccttccgtagtgtaaatgccccaggcactgctattatgaaacttcagtgtattgttgatccttaattaaatgtgcgtactttcttgggtgttttaatcagtgtctcagaacattgatatattttcagcaacatcaataataaatactttgttcagtgcttcaacaatacataaacatttgagacctggggcctagcacatagtaaacactcagtaaaaggtggctgatatcttttcccataattgttgggagtcttttctgatagttttgatcatttttattttgtttaaaactatataggctacatgagcagttttaactaaataaaactgtattaatacctgttatttaccacctagtataacccaacagaactagctttcaattactatctagattaacccgtcaaattagacaagggtcaccttatagtctttgcaagtatcagtttggtaaacagcacactcattatttttttcgtgtaagtacatgtttaattccctcaaatgttaacataaattgctacttaaaaaatatgtagtgttttaaggactgttttaaaataaatggataggctaggcactgtggctcatacctgtaatcccagcactttgggaagccgaggcgggtggatcacttgaggccaggagttctagattaggctggccaacatggtgaaacctcatctctgctaaaaatataaaaattaggtgtggtggcgggtgcctatcatctcagctacttgttggagactgaggcagtagaatcgcttgaacccagggggcggaggttgcagtgaaccaagatcacacctctgcactccagcctggcaacagattgagactcccgtctcaaaacaaacaaacaaacaaaaaaaaaaaagcagcttactaataaataataaaataaatgggtaaagttgaatcttcccatctaatgacttcaatcgaatttttagaatcatttttgaagttttgaagaagctgaggtcacttatatgcaacttccctttcaagaatgtgagcttatcattcagtcaacaattacctataatgcacctacaatgtatatagtgtttgtaatgttatggatttactctaaccaaatgctcttgagtggataaaattgcagatgcagattttactgtacaatttgcacttcattttcataacaatgtaaatattaagttatgtaggagcaattatcagagctctaataccctttctccaatagaatgcatatttgatgttagaaaagcaaatctagaataattgaaagtgcatgattcaggtataatttcttgtttgtgtgttctttccctcagggctactctggcctttgcttaacccagtttatttcctatattcaagctttattatataagactcagaacatatctggccttaagctgaattgccaagaaacattagcaaacttgctcattaaaataacaaattctaacattgtctttaaaacaacaacaccctactgttaaatttaggctgtgtgtgtgtgtgtgtctgtgcacacgtaggtgtggtagaattttttttccctactaaagtaatcggagactctgcctgaaattctgtaattttgaggtcttgttgtgttagaaggttgcctacagtgggaaacttgtctttttctgaaattaaaaaaaattattttccaagttcctctccaacctttgccagtctgtgttgacttactccttattaaacgctcagctctttaaggcccattagtcaagctgttacttgtgtgcaggcctgaagcagcagttctgtcagtgagcctgcacctacctgcaacaccccatttggttgtctgcacctggacttgtctcctaatcataatatgtaatattgcaactttaccccaaagggccatagaatgtccatgtttagagggagaggtgagacagcctaataggtgtcactctctggtggtaaaattaagagtggatcacaaatgtaggcaagaaacagaggcctgtaaaaccaatgaacccttttgcaaaacaatcattttactgcctctgcacatatttagcccagagataatttattttatctagcagttcatatattcactcaggttgaaacttctatattgtacctgatgtttgctgcatactttgctaggtgccaagcatgcatgagtttgtaagactatttttgcaatcatggagctcacttcactctctagcagtgatgcaggcttgaaaacaagtactacagtagatattaaaagtgctgtaatacaggcatggacacacagccaaggagacatgaatcacgattatttgtgcttgggaagattgggaaaggctccacagagcaagatgcttttgagctgaaagatgccttggaataagtaagaaatcactaaaggtgttaccaaaatgctttagggagaaaatcctccaaattagccatggcatgttttggagtatgcagtagagtaaggggtgctgcttacctccttttgtgatgatacttagaataagactgaaagaagaaaatacaagttcagcacctaatccagtgccacattagaataggtactaattgaggatcccttagtgaaatatttgggaccaaaagtatttagatttcagattttttcatattttcgaatatttgcattacacttaccaggtgaccatccctaatcagaaaatctgaaattcaaaatgctcctaagagcatttcctttgagtaacaatattgacactcagaaatgtttggattttggtgtattttagattttggattagagatactcaacctgtattgcatatattagctggatgaaggaatacatttatgtgtgcatgtattttaaagagtacagggggccgggtgcagtggctcatgcctgtaatcttagcactttgggaggctgatgtgagtggatcacctgaggtcaggagttcaagaccagcctgaccaacatggtgaaaccccatctctactaaaaaaaaaaaatcaaaaaaatcagctgggtgtggtggtgtatacctgtaatcccagctacttgggaggctgaggcaggagaatcgcttgaacctgggaggtggaggttgcagtgagccaagatcacagcattgtactccagcctgggcaacaagagcgaaactctgtctcaaaaaaaaaaataaataaataaaaagcagggtgcagtggctcatgcctgtaatcccagcactttgggaggctgaggtgggtggatcacctgaggtcaggaattctagaccagcctgaccaacatggagaaaccccgtctctactaaaaatacaaaatttgtcaggcatagcggcacatgcctgtaatcccagctactcgggaggctgaggcaggagaatcgcttgaacccgggaggaggaggttgcggtgagccgagatcgcgccattgcactccagcctgggaaacaagagtgaaactctgtctcaaaaaaaaaaaaaaaaaagtacagggaaggatactattttattactatgaaaagcaaaagaatttctgtctcatttttaacattgatatttggtattctgattcaggcattattttttatgtcactggggtggaaccaaaatgaattttgtatattaactgctcattgagggatgttaaccaaaactttcaaggcactatgtaggagatttttttttaaattttgtctgcataccaacggaaagtaagcctgttttctgtctcctttttcatgtagttttattagtgctatcaaatttaatgagtgctctgcccttttttgctgtcattctgtaatgacttcagatccatatatgctgatttagctttgaaagcaagttgggaaaagagtaaattacattctagcagatttgtctcatgtttgcatcatttatttttttctgcttatattctccagtaagcagttaactgcttttttgaaaccaaaagctaaagaagcctgctgtaccagcaatacctctatttgttataattcagctaccctgcatttagggccagcttctcaggtgtcccatgcagtcacacagggctctgctcttacaaggtttctgcacttggcttaatgttcttctgctgccatcttgagattcttagtaatatttggacaaggggccctgttacactgaggtctgcaatcacatagccagacctgcttgcattgcgaagaacattaacatatatattctgacacatgtaacacaatattgaatgcctcttaaaacttgcttcaagcatctttccatctccttaggtaaggaagccatcctgagccccactctgagttacatgccccttgttgtaatttgtgatgtctctgtttgttagtgttggctgagctttgactaggggttcattccaagacctcacctttcctgctgacttattaactgttcctcggactctacttgacttctagaacaccgcactctcctgatgtttttcttacgtcactggtagctctttctcagtttcccttcctggttcttccttctctcccctgtcttctaaaattgggatgtgtcacttgtcaggccatgtcaccttctctgtattcactccttcttgggtttaaaaatgccatctatatgccaagcactcccaaagatatatccgtttacatgtcatctctacttgagtgtgtaataaacacctcacagttaatatgaccaaactggcttcctgaattggcccctataacatgttctacccagcgttctgcatttcagttggtaggaatattatttcagttgcttaggtaacaaataataatcacctttagtcctgcctttctctcattttcagtctgttaggaaatcctgttggttctctgttcaaaatatagaatctgaatctaccacctgtgacactcctctgtctctggaagtatcagtccagcaaccagagtgttcctattaaaataaatcaaactctgtaggggcttcctaacttattcagaggaaaagccacagctctcggaatggtctgcaaggccctgcctgatctgacctaccccctactcacaccttgctcatttcctctcttgctgttttttctctgacacactggtttcggccacactggtcccttgctgagctttcagtcacagtgccagcctgtctgctctgcccaaaatgccccttctttactcaacttctctacttgaactgcagctccctctgagcactccttctctctctctcattctctctctcttccccccccacccttttctacttctttctttttctatagcatttatcagaatctaacacaatgacttattttctatgtcttttttttttttttgcttggtactctggatgctcgataaaagttgaatgttgactgaaagagctatacccaagggaacatgtcctttggtgtgaatgttccttttgtctctttatttctcagtaattcttttttattcatttgcgttctaaagaatattacattttgaaaatattcctactttaaatagccaaatgtttaataaaggtaataactgaaatagaagtgtaagcaataatcttgtctcgagagctagaaatcatttcagttacatgacatatttgaaatgtaagcaaattaaataacacaatggcactttatgccttgatattgtagtcagttcagaggttatcttttctctatcttaatactgcctaaattttcaactcaagaatgggaaagatttttatttaagggaaaatgaattggcatacctttaattgttgagatagcttttaaaatatagcttttttttttttttagctgtatgtgctggatattgctagattcttccagtgtttgtgcttctctctgttgtaggaatttgatacctttgaatgctagttgagttgagattcttaacaaatgcagggagaagcttaaacatgtggagtctctcattcagtgactatgttgtcatgcattatattttataaataaatatagccccaagtcattgaagcaaaatataaagggaaagttttataattgttacaaatacaaaaaatgggcttctaaacacatttgtaattcttcataatgctgttctttgaaagcagtaatttattcaatgctaaatgagctcaattctagtgggcattcctttcttaaaagtataatttttaattatgaaaataataacatattacagagtttatgaaataaagaataaaaacatggccataattttatcaccataacaacccttttcattttgcattatttcctttttgcatatttaccttttgcatagttttacttgggtgcagagtttttatgtcatctttttcacttagatacatgtcatgcctatttcttcacattgctatgtggtcattatcacaataacttttcaaggttgcataatggcctctattgtggccatatcatagaacctaaatatattccaggtgttggagatttaagtttctttcaattttttaaaaatcataaataatgttataatgaacacttttgtgttcgtagcttttctggatcattttcttaggatatattcccaaaagtgaaattcctgtttcacacaatatgaccatagtaatgacttttgatatattgccagcctactttcccaaatgatcaaaccaattttttgcctccagcaatgtgtgaaagtgaagctttaccataccctggcctgtgatttctcatttttgttctattattagtgatccttgtattgttagcagtaaaatactagtacttcatagatgtatagaaatttagaaaacagttttggaatatcagacacctgagtcaaggttctctccacaaagaggaagaggagaactggtttgatgtttgggttagtcatgcctagaaggataggagaaaagctctccatggcttgttaaacacattagttgaagaaatttatatttgtctgaaattagtgtgtgtgatgtcatctagctgaccatttatacctccttagagaattgttttgcccttttattctggaagaaaccggttcacaaaaaaaccgctgcatttatttctttgctttctaagaatctaaactgatatgagtcttgcaacacagttttctgcttatgaaatattttggctttatcttggagaatcacataattccatttttttctttttctttttcttttcttttttctttttttttttttttttttgagacagagtctcgcccagttgcccaggctggactgcaatggctcgatctcggctcactgcaacctccgcctcccgggtccaaatgactctcctgcctcagcctcccaagtagctgggattacaggtgcctgccaccacacccagctaatttttgtatttttagtagagacggggatttcaccatgttgatcaggctggtctcgaactcctgacctcatgatccacccgcctcagcctcccaaagtgctggtactacaggcatgagccactgtgcccagcctgagccactgcacctggcccatttttttcataattaaataatttatcccttagaagagttaagtcatctactttcagatgttcctgcaaacggagggctttgttctggcattggtcaaccaaagctctaggtaaaatggctagaaccttcctctacaagtaagagtgaatagaggctttggaaagaaattcagtctgagacaagagctgagaaacatggtagaattttagattagcatgattttaatagtaatgggctgggagtggtgctcacacctgtaatcccagtactttgggaggaaaagtcaggaggatcacttgaggccaggagttcaagactggcctggtcaacatagcaagactctgtccctatttaaaaaaaaattaattagcctggtatggtggcatgcaactgtagtttagctacttaagaggctgaggcagaaagatcacttgagcccggaagttcaaggctgcagtgagctttgatggtgtaccagcttgggcaacagagtgagaccctgtctcttaaaaaaagtaattttttattctacagcactgaatagtttcaaaatatcttttcattcactgtctcaccagtgaagttagtaaaatgagagagatgattaacacgcagagaatttaagggacaaacccaagtaagggcccatgagcacaggatgagtaagggtgtgcctgtgtggtatggactggactgtacctaaggctttggctgcaaatctttgtctggttttactttaccacagaacagtatttttaacatctcctccttcattcatacaaaaatttattggctttccgctatacctgctctggcacaaatttcagccttccatgagggctcagtctggcaccagagtcaggtttgcaaagaggccatggtgagggagtgtggtgaatgctggatccccgtgagggaaggctgcagctcatgctggtggtgcaggtggcactggagccggatccctgaagggtcaaaaggggtgagccctgtggatttctttgactttcaccagtgagggtcaatgagattgttaagaaagcaaaacaacacagatgttgtcttgagataataatgtcttctatgggggctggaaggggaagactacttccttctactgcagagttgctccatgctgctttcttccacagacctactttgtatgaaatgctcccatttctcaggtgttttccttccttgatccccttctaacaatggcctcctgaggttccacattttcttttatgccagtttattcattttctcattcattaatccaaaagatatactgagtgctagaatctaatgagaaagagcagagctattgaaaatttgaagcaaggccaggctcagtggctcatgcctgtgatcatagcactttgggaggccgaggaaggcggatcacctgaggtcaggaattcgagaccagcctgaccatggagaaaccccatctctactaaaaatataaaaaattatctgggcgtggtgacacctgcctgtaatcccagctactcaggaggctaaggcaggagaatcgcttgaacccaggaggcggaggttgtggtgagccgaaatggcgccattgcactcaacgctgggcaacaagaacgaaactccatctcaaaaacagaaagaaagaaagaaaatttgaagcaaaagccttctgaattgcaaagaccatgaggaggaaatagcttggcatgttctcggaacagaaataaggactttgaagctagaaatgagggtgtattaggagatgacatcagacagcagggagggtccagaccttggtaggaagtttagaatttattctaagtgcaacaggaagccatgggaggagggttttaaacagaagacaggatctgatttatctatcattttaattttgtaatttagaaaattttaagaaaagtgcatgttagcaaagtttggtgcttgatacacggacaatttggataatggctttagattgaagaaaggttaggaaagagttgctatttaaagaaggggggtgaccccaggatttatttcacacccacatgtttgcttttctctgttcttagctcagtccatatgaccaactgctagtttaggagagaagggtttagcagggattcccctcttccctccaattctcttagaccctgttttcttattaaaagatttgcaggatcccatctcggtcagtgatgtcagcaacccagccattatggtgagctgatgccatgctcatgaagaaaatgaagatcagctgattgacttccaagtatttctgccctaagccacgccaatcacttctttataccgtcttatcttttaatctcttgtctttctcactaagttgtagcaggtgggagaaatgttccaagaccattaaaggaggataattgggaatctctgtatagacatttaaagttgaataagcagcagtttattcggctgcctggtgctcagaggcacaccagtagcatccaaagagcaccctgagttcgaaggagtcggagaggtgggacaggaggaagggtgtcttcaataaagtgaattcaggctcttagacattctgttgagaatggaaactgtgatttttagtagctacattctgatatttacaatcaggtcttcattaatctgccatttcacggcttcatttagtttaagtaagtatgtggaaggtacacaatcggacaagccatgagagactacattaccttcaatgtgtttattctatctgttttcttgagttgctttccaccttattacctctaagctagttacaattttttttcaacacacagctcatgtgtgtttgagaaggttgacctccctccctcctctgtgtatttattcataatgaggctccttggtaccccgtgtgtacctctttcagagatttgtggcacttaaccacgttctgggctagtattgttctctcttcccctttatactataagtttctcaaagattgagtttatagctgatttttgccttctcttatgcctaacgtatttttatatattgtatatatttgtactttaaaatttttattttggtggaaatctttgttgaaaaatctattatatactttaatgccacctaaggatgggagaaaatttgaatgttttcttttggacacaagataatcattgtgctctccagttgttatttttgactcttgaggtatttgggattatatctccttctactaaacacctcagagcatgcgacttctaaaacatgatttcagtattccctttgttgctgttgttgttgttttgagacagtgtcttgctccgtcgcctaggctggaatgcagtggcaccatcatagctcactgtagcctcaaactcctggagccaagcagtcctgcctcagcctcctgagcagctgagactataggtgcatgccacaatgcctggctaatttttgttgttgttattgagacggggtctagctatgttgcccaggctggtgtcaaatttctggcctcaagcaatcctcctgccttggcctcccaaagtgctgggattacagttatgagccaccacagccagcctcagttttcctttttgaaattattttgtatcttcctacttattctaactgatgctggtctattgcttggaggccaaaacttcactttatacaatttgtctgggaggggaattgaaggtcttttcacatatctactacaggctgagcatcctttgtgtaaaattcttgggatcagaagtgtttcaaaattcagtttttgggattttggaatatttgtgtatccataatgagatatcttgtgaatgagaaccaagtgtaaacatgaaattcatttgtttcagatataccttagacacatagcctgaaggtaattttatacaatacttaaataatttcatgcactaaagtttgtatacatttgaaccatcagaaagcaagagtatcaggtgtggaatcatttcagcactcaagtttcagattttggagcatttcagatttgggattttcagattagggatgctcaacctgtagaatgcaaaatacataagctttgtgacaggttgtcatgtaagagcacttttagctcaatggccaagccttgagccagcaagtagccagatatctgctgcatagagaagtatgtggttgctaggtgtctctcccatcaaccacaaggactctttccctaacttccttgatagaaaacattttaacagaagcaatcaccctcattcttcactcactcagctctgagagcaccaatctctaagctaggcatgcacttgcctcagagcctttgcactttccattttctctgcctagattgctcttttgccagatattctcatgccttgctccctcacttccctccggtttttttttttaaatatcgctgtctttcagatgccttccctgaccacttacacaaaatattaccaaccctcatcttcaacccaccatcctctcccactcatcctgtgtggtagatttttatagtaatgaatcatgcctccctgtgtccacactcctatgcagagggaaatttttgctcttttcatcaaaagataaagtacatttttccattctcttgaatctgttctggcttcatgacatgcttcaaacaatagactgtgacaccgtgatgtgcaaactctagagctttgctgtgtaacataggaacccttagacatatgtaaccatttgtatttaaatcacaattagataaaatttaaaatttagttcctcagctgtactagtcatatttcagatactaaataaacatatgtgactagcaggtaccatattggagagcaattagagacgacatagggagaaactgaggtaccccagacaataggcagtgatgatttccagacatgtgagtgaggctgttttgtcccgccctccccatccaagctgcaggatgactataacctcactagtaatcccaggtggtaccagccaaagaacaggtcaaattgccaacccacacaatcatgaaaaataattgtcattgttttaagctataagttttatataggtttgatacacagtcatgataatggaaacacccttcaattctaatgactgacagtaatttggaaaccatgccctaaggggttacctcatgggtgagaatgtcacaaaatgaggaagacagagtgaatccataccatccatgacagtcagatcagttccttatttatctaaaaagagaaaaggatatttgctattactaaaataaaaaccaactgcagactgaaatacttattaatagcacagacttagttttacatcaaaaaattactaccagcaatttgcaaagtagataatttaaaaatacagaactaactgaaatccattatttcagtttaagatgaacagattgggtgactttgttatatcttgctctgacatgttttgtaacattaaatacatagtatttaattctgagagcatttctcccataatttattatgctcaagcatttattgagtgctttctatatatgtctaggcaggtacagtagaggatttcagatgattaagacctgaaccttaccatgcaagaactcacaatttaatggaggggacagatgcatggtcaaaatatatgcacattaacacagtacaagctctgttagaggaataggaagtgctctagaaacactgaggtgggagcagccatcttgttattgcacatactgaacacacagaatgagctcttactttgcatatgcattggggataaagactagaaaagaaacaaattaggctgggtgcagtggcttacatctgtaatcccagcactttgggaggccaaggtgggtggattgcccaagctcaggagttcaaaaccaccctgggcaacatggtgaaaccctgtttctacaaaaacgtatgtaaaaaaaaaattggccaggcatggtggtgcatgcctgtaatcccagctacttgggaggctaaggcggcagaattgcttgagcccgggaggcagaggttgcagtgagccaagatcatgccactgcactccagcttgggcgacagagtgagactccatctcaaaaaaaaaaaaaaaaaaaagaaagaaaaaaaagaaacaaattacctagagaattgttttgtgtaaaaaacagaattattgttttattttaataataaccttgttgagatagtattcctgtatcataatatttacccatttaaagtgtgcaattcaggggcttttagtattttcacagagttgtgcaccattattgctatctagattcataacttttttttttttttttttttttttgagatggagtctcgctctgtcacccagcctggagtgcagtggcgcaatctcagcccactgcaacctctgcctcccgagttcaagtgattctcctgcctcagcctcccaagtagctgggactacaggcacccgccaccacgcctggctaatttttatatttttagtagagatggggtttcaccatattggccaggctggtcttgaactcctgaccttgtgatcctcccgcctcagcctcccaaagtgctgggattacaggcatgagccactgcgcctggcccataacttttttatattccaaaaagaacatccatacccataagcagtcactcctatccctcccctccctccccagttccccagccttaagcaacgagtaatctactttctgcctctctagacttgcctgtttgggacattgcatggtaatggaatcttacactatgccctttcatgtctagcttctttcaatgagcatgattttaaaattcttccatgttatagcacatatcagtatttcattcatttttattactgaataagatgtcattgtattatggatatatcacattttgtttatccattcagcagttgatggatatttgggttgtgtccatcttttggctattatgaataaggctactataaacattcatgtatgagtgtttatgtggacatgtttttctttttcttcggtatatacctatgtgtagaattgctgggtcatgttgacaactctgtgtttagcattttgaggacatgccaaactgatttccagagtggctgtgatatggtttggctctgtgtccccacccaaatctcactgaattgtaataatccccgcatgtcatgggagggacccagtgggaggtaattaaatcatgggggcaggtttttcccatgctgtttttgtgatagggaataagtctcacaagatctgatggttttataaaggagagttccccagcacatgctgtcttgcctcccgccatgtaagacgtccctttgctcttccttcgtcttctgcaatgattgtgaggcctccccagccatggggaactatgagtccattgaatctctttcctttgtaaattacccagtctcaggtatgtttttactagcagcgtgagaatggactaatacaggttgcaattttaccattccaccaacaagcatcaaggttcctgtttcttcacatcctcaccaaaagttgttattatctggaacagaactgttttgaatgaaaatataaactcattaaaacagaaaaattccaattatattatgttatatgcatttaaggtggcccatatatcagtcacgtgatattagaacttaaagctgaatgccactttgtagctctgtgtacaaaacagctcattggagtctaatgatcttatcattaatgttcaccaggtggttgggaaatgcaggttttcttttatgtctaattgagagagttaaagtgtgaaatgattatatgtataaaactgttgaaagttaaatctatttctgacatacaattaaatataattgaaataggacaaattgaataacaaaattaaatttacaaaacaggatatgaatggaaattatcatatgtatgctgctttgtaggatatttgggtggtgcattggcatgagggccagagccctgtatttgtacttacttggcatggttcccacctgcccaggcttgcctcctgtacttccctacattggcatatcaaaggagttcgcgagacattctccagccagcaccctgcgcagagaggatttctttttcttttttttttgttttctgaagcacggagtttaatgtggttaggaagcaaaatacaatctaagactcagacttgcttttaatgaatccaggagacctgacaatgatacattataaaaaacaaaaataaaaatctgacaataccccccaacttgtcagtggcttcccatagcccatgattgggttgagtgagtctcagtgcataggaagcagtgcagtggtctttgtggcctgacctccgcccacaccttcagcttcagctgctaccgctctctgagtactgaagtttttatagttccctgagggcgcacactgtgacactcctgcattctctgctagtgtttagtttcctttgctgggagtacctttccctctctgcaagactcaatttacgcaccacctcccccaggaagcattacagatcccccaaggctctactaggtcccagacatggcattagtctgggtgctttgtttaccatgctgaacaaaaacagaaaaagtccctggtctagtggagcttatattttatctaagagagggactaaacaagaaatatagaaatgtcacctcttttgcatagtagaaggtgccaggtctaggaaatacaaagatagttaagcagaataatgagaatgggaaatgtaggggatgagaaaggtggaatgctacattcaataaggtaggtgggtgggcctcaccttctagacagccttaaaaaggatgagggaatctgtgatatggctaaatctagggaaagagctttccaggcagagcaaacagacagccaaagagattactctattgtgagagtctccatgttaaacaaataaaattccatccataaaggaagttgataggttggttttccaaagtatcctttctatagaccaatatgtacatatttccatttcaatttttgaaatctaaaaagaagttccaagacaaatctctcctttgccctcttccctccccacacccctgcacaatgcacattttgtggactattaatagtctagaattcctaatcagaaattactgtacacctaagttgcacagatcatattgtcttctttctccaacaaaagatctggatttgcctgtaaaatatatgccccgtaatagttttatatttccagagggccagttctgcctctgctcttccttctctgagtcatttgcctttatgtcccgtcttctctcagtttttaatctttccacattattgcctattggtgttttctggttgatcttttgtgctaaattctaaatgccattgtgtgaattcttcctcctatttgataaaccagagtgaagacctgttctaagatcttcatcttctcttcagtggcttgcattaaatctgtacattcctggaacttccccttccccaggaagaaatctagcacaggccttgcacagcattttaagaatctttaccactcctgagccaggcgtggtggcccatgcctataatcccagcactttgggaggccaaggcgggcggatcacaaggtcaggagatcgagaccatcctggctaacacagtgaaatgccatctctactaaaaatacaaaaaaattagccagacgtggtgatggggccctgtagtcccagctactcaggaggctgaggcgggagaatggcgtgaacccaggaggtagaggtgaaggttacggtgagctgagatcgcaccactgcactccagcctgggcaacacagcgagactctgtctcaaaaaacaaaacaaacaaacaaaaaaacccaacaaactactccttgctgggtgtggtggctcacagctgtaatcccagcacttgggaggccaaggcaggtggatcacctgaggtctggagtttgagaccagcctggccaaccatggccaacatggtaaaatcccatctctattaaaagtagaaaaattagctgggtgcagtggcaggcacctgtaatcccagctacttgggaggctgaggcaggagaatcacttgaacctgagaggcagaggttgcaagtgagccaagattatgccacttcactccagcctgggtgacagagtaagactccatctcaaaaaaaaaaaaaaaaaaggaatgtttactgctcccatatttactgatttgatttggattttggaaatatcttgaccactaaaattaaaaaaaataattttgctatattacctgctggttttcactattttttaagtaacatgatttttcatgtcgttattatatatttttaggtgattatggaagtaaatgctaggaatatttttattcctctagagcttcttgctctaacaacataataatctaagttaaagaactggctcaagacttgtaaatgtgtatttttttggattaaaaatctttttttttccatttttcttgtatctctttttatttccatatattaaaactttaagtgccagatgtatataatctttttttttttttaatttcctgaatgtcacacatcctgcgatttcttcacaagctgcgtttgttaaataggagatgatggaaggtttgttatccccgcccccacccaccaacatagtcatttaatgctcatcagtgataattgctgtgtgaatttagttgatttgtgcttgcttcgctgtcagtctttggttttatggatctaggaaggacatataaatgtacctttgcattttagagaaagttttattttatcctatatcctgtgttacatcactatatcttaattgtggattttttggttcactttgctcgttcatttaaattttttatcaaagtaataattgtatagtttaaaaatcaaaataatatttacaatgcttacacacaaaaaaatagcatttttgtcactccgtctctcactagttcttgtcagctcttctcatccctccccacctgtgagggttaagctacactttggttagtccaagcacactttccagtatgcttaccatgttatgacttatctcctctatacacgagtaggaaaattatcagtaatagtggtttctagagtagtacttgaggagggtaacgggtggcgtgtgcatgcttcatggccttattcaatcaagcactctactcttgatttactgctaaatcctccttgaatctttagatttcctaaaggctatcatgagattttctggatatagaaaatgtagcccattagtctctgtcagcttcattaccagggtttttttgtgtgtatgttgcttagatccatatttttatataagataattattctggtatttctagattttttcattcttaccttttattgactatggaagaaaaggatctagcctgcaaatactgtagcatctcaacatagtgatgtcaaatactactaaaaatttagttgtcttcaaaaggaaagattttattcattctaacatataatgaaagttcagtattttagaaaataaaagtctgacttttcataataggttgccagggaactacaccgaaggcaaaatactagagccagtaggtggttatgtgtttaattttaagaggataacaacattaacaaattccatttggcaacagcgttaaaattgcacctgggaaaatcttcattactcttatcttgcagcagtcactgaaggagtttggttgtttttataggtgcaggggtgaaagtttagctccacttcaaggaacaaaggtgctaaagagaaactattctgagaatcatagatttgcatgaaaaacctcacaaaagaaaaatagtaattgcctcagcatgagagatggaacatattttaagataattggagactgttttatatgtgccctcattggtttatttttgatttcatgtatgtactttgtttctatcgcttcatttttttttcttaatgtattctaaataatgtaaaacccttctgaggatcttattgctacttgtgaaattacctttctctgtatcattggatgtaatttttttgtcagtcagtcttacaagaaaaaagtatcttagcaaaggctattatattttatcaatctgacatcagtgaaaatcctaaaagtacattttgtgtaaattcaaatacactgtaacaatttcccttaagtgaatattttaaagctgtttctttttttgtatacttaacgtttacagaaattatcttttttcctttgtatttttcttcattcatatctataaaatttacattttggcttctaacttagctgaaatgcttgctattagtcattttcttgctaagtgtggtcagaagtggtatagttgaagatgtcccataatttggtgaacacgtgaggttacaaactcaacttttgcttctcttttgaaaggccctgagacgggagttaaaggagaaagaatattctgtcctgaatgctgtcgaccaggcccgagttttcttggctgatcagccaattgaggcccctgaagagccaagaagaaacctacaatcaaaaacaggtgagactggtttctccactacatcataaaaacacatgctaggagaacaaaaaacccaaaatcaagtaggaaatttccttacagcattttaggatctaatatttaaatcttttcttctaagtgttactttattcaaatatgtcattaattcacagatatctagattcttaaattaagaaaataaaatttttgtatacctcaatatcaattttaaaggaaattaactgcagaaaaaatagattgtctaaaaagtgtactgtaactataaaagtaatttctataagaaataaaaatttatattatatttaaacaagttacatgataaataattgcaagtagtagaaagttattaaaatataataaatatacaaaatatttcaaggtctataagtaagattacttttgataatgacacaccaaagtcctttcttttacaagcagacaacatttctttaatttaaaaataataccctgtgtgtttatttactttggcttaaaatttaaataataactaccttactagcaaatttactagcaaaaaatatatatttcttatatttaaacatgttatgtgataaataattgcaagtagaagacatttattaaaatataatagtaaatatataaaatatttaaatatctatatgtaaggttacttttaaaaatgagagaccaaatacttttcttttacaagcagacaacatttgtttaatttaaaaataacctgtaacatttatatactttagcttaaaattgaaatagtaactaccctactaacaaatagcaatatatcacatagtaaacttaagagaaaatgtgtaatgaattctgggtccaatatatatctgtattgtgatttttcactgctgacaataaaatcattctgatgcatttttaaaaataaacatgccattcaaaatcgtttttcatcattcacttcacatagtaacagcaaacctgaaagattgcctcatgctgtgtccagcagtgtaaatcatgaacatttattacttgtaagggaagcatagttagaaaatgctttctttgactataactggaactggatcagacatatggacaggtagccgttttcctactgaatcttactcaaggaaccttcttcagtccgaataaatttcccatcaagaccataatctttttgactctctgaaactagttgtatatatgtgtgtgtgtatatacacacatgtacacacacacacagcacacttaacttgtctagcatttctttttgttttctgctggtggtaacactgtctttccagttagcctcctacaaagctaagtcattgttgagtcttccacttttcaccaaatccagtggtctacaaatcactcataattattatttcttttctttttctttttttttgagacagagtctcactctaccacctaggctggagtgtagtggtgcgatctcggctcactgcaatctctgcctcccaggttcaagcaattctcatacctcagcttcccatatagctgggactacaggtgtccaccaccacgcccagctagttttcatatttttagtagagacgaggttttgccatgttggcaaggctggtcttgaactcttggcgtcaggtgatctgcctgcctcagcctcccaaagtgctgggattacagacgtaagccactacactcagccttatatttgttatttctatctttgaagaattattccttttgagtactctgttttatatatatatatatatatatatacatatatatatatatatatacacacatatatatatatatacacacatatatatatatacacatatatatatataaaaaatgtatacacacacacgtacatactcatgtgcacacacatactgccattaattccacattctcagccttttgtgtgtagacttagaatagttttaggcagaatctgttgctacttttggtagcattggtcccattgcattgttctgtcatctgtgtgcaacacgtagtatttgcccatatattctctctcttccactttagtctactactgataagtaaatcttatcatgtaatcatattcgtgtttctcccctgattatacatctttcttgactttccattgcatactgaaaaaaaatcttggcctccagcatgacatttattgtttcattttatgtcatgttatgttatgttatgttatgttatgttatgttatgttatgttatgttatgttatgttatgttatgttattttgagacagggttttgctctgttgtccaggctggagtgtagtggtgaaatcacggcccactgcacatcaacgtcccaggatcaagtgatcaatcctcccacctcagcctactgagtagctgagactaccacagactatcttttttaaaagtttttgtagagatggaatctcattgtgttgcctaggttggtcatgaactcctgggctcaagccatcttcccattttggtctccaaaagtgctgagaatacagccatgagccaccgtgcccagcctagcataatatttattttaaaaatctttggatcatcaccttgaatgcaaacatgcagcaattaggcatataattgagactactgattaaagcacacaaatgtgatttctgtgcacatatgttgcactctgaagatatcatttgctgagcttagggctattttgaatatagcacatttgatcaaatggaacacaatccttgtacattactgccatttggaaaacatactgcttttggccggacgcggtggcttacacttgtaatcccaggactttgggaggccgaggcaggcggatcatgaggtcaggagatggagaccatcctggctaacacggtgaaaccccgtctctactaaaatacaaaaaattagccaggtgtggtggtgcatgcctgcagtcccagctactcaggaggctgaggcaggggaatcgcttgaacccgggaggcagagattgcagttagctgagatagcaacccagcctggtgacagagtgaaactccatctcaaaaaaaaaaaaaaaaaaaactttgtaattgaagccctcctgatttttcaacaaattttttactaccatttttatagttccataaccaatctatactatctacttccttgaatgattttggaactgtcttgtcatggatgtgctaccttcccttcttccatcttttgaagttctttcaaaagaacattttaaggcttgcttatgtccttcatatacaatattagaatggttaagagccttagagatgaactagtccaaggctattcacttaacagatgagaaaactgaggtccatcgaggaaaaatgaactgctcaggtctcagcccagtcctgttggatatctaacatatgcagctattgtttgtattgattttcagatgttaaaattttcttacttgccctaagttgaggaatccagttttgagcattttataacctatgcaatgcctgtatatatcaggtactcaataaaagtttgatgaagagtacatgactacctgagtaaataagaggtataaagaaattcatttatttattattctgacttcatatacaacctattacaagaacatttttatgagctagatgcttaacaatgattcctctctcacccctcccctggccgccatcaccatatttaacaacaaggaaaatgagcccagatgtctcatgtaccccgtaaatatgtatacacttactgtgtacccacaaaaattttcaaaaaaggaaacaagccgaaactgtagagaattctttgaaagagttgaactcatcagtacttgcttttcctcacaatcttgagtctataaagaataactgtagatgggagaaactgatattatcagcagtagagtaattggattattgatttttaagatgaaatggaaataaaccccaacttttctagaatgagcactcaacatttacgaaattcctttcctatatctgtcaagaagcccctgccccctcccgtcaccctgagtccattcttccatcagtctttgcatcttacctcatgctcctccgtcttctgggttgctcgggctaaaatccactgggccgctcttggctcctttgtccttttgtcacccaaatccattctgtcagcaagtcctgtcatcactacattcaaaaggtacctagaatatgatcctttatcaccacgtctactatgctttcctggtctaagcccccactaccccttggatgattgcaggttccttcaactcatctgcctgctctgcctttgctcccttattagagatttccaacacaatagctgtaaggaccatttgaatatataagtcatgtcatgtgactcagagaagtcagattcttataatggctcacagactgtatgccagggggtgccatgttacatttctgacctggtctcttattattgtccctttcgttccactccctgtagatgtaagctccttgaagacagagggttatttttttttcactgctgtattttgtaatatttagaatactatctggcacatagtaagtgcttattacatagtgtttgaaagaatacgcatgagctgagcactgtccaagatggataaagaagtataacgcatgttcctgaggtttcaatttagtgggagatcaaaactagcacagagcgtgagaaagcaagcaatgtaaaagtgtccgtagtcatgcactcagttgtgtcctgaggattctaagtgatgcgggcattccaggagagaaggactctgagggtcagagtggagagaggttgattcctgagctagtcttaggggtatggacaggtaggaagtgattaagttcgggaaagaggaatggccatgctggggacagaatccttagcagaacagctcagccataaggaaagagcagctgtattttggggagtcagtagacagcctggcctggttgccagagtcttgtgcctggacggcagatggggatgagatggttgtatgtgctgaatggttcagaggacctggaaaggtcctacagaggacctggaaagtcaggcagaacattgtaacttcatacaacaagaaagaaggtgctagtacagttttgtttttttaagcttggggaaaaaaataagaagttcacttgtctcatcttatccaatttaaaatctaccttcagtcagcttttcttgtctcctttcttccctaggactttgcgaagtttataaaaagctactttaaagcagtacaaagtgttacatcactaaaacgccacattattctggactcttctcagtggtcagtcatttaagggttaaaacgatattgtataatttaaaaaaaagtttcatgaacattctagtcatgcgtcattcatagtgttggtgaggaagtcatttgggcacacatgtttcaaatccctaataaaatgtctagaaagatacacagaaaaaaaaaatactggtttttgagttcttattttactgtgacattcaggatgttttaagctccatgtttttaatactacatttggggggacaagaaaaaaagaagtcatgtcaatttaactttatggttttttttgttgttgtttgtttatgattagcaattttcatactgcctcctttcctgatactattttctataacaatggctggttttacttgttaaaaataaatcgaagaaaactatccataatagcttttatacttttgttgtttaccatgacttatgtacatctgctattagaagtagcaagcatttgaacattagttatcctgtttgatgccgaagtactcaatgttggagaggttagatcaggaagaaatcaagtgatttttttcggttctatttaataagcattttgtgagtatgtgatgtgtaccatgctataaggacataccaagatggagtcacctcttttcttttaggtaaccattctagaaaacactttcctccatgatttttatctccaatgcctttttttcttccagttcctttaaattttttccattactaattatcttatactgttgtatgtatttttaagtatttaaaaatcactattaattgaccattccacattagtttcctccataccaatcttatgctaggcctatttcaatatattcttaattggcatttctccattaacataaatcctaaaatgataaacctaaagcacaaacctggcatgaggtttcctggagataaaaactgcccgtagtgcatgccatgggatctgagctcctccacctggcacagaaggctgcacagcaatttgtcctcagcttttccatccggccccaccttgtgcctctcttcactccactcttgaggtttgctgggagccaggctcctcactacattctgcaggtagtggtcttccttgcctttgccccattgcccatcccagttttctgcctgtaggtcctctgacctgatttccaacgcttgcctcatttgcccacgcagctgctggtcatcctgccggctctgctggggctttgtgtcttcctggacgctttcccttcccgagctctctgccatgattccctggcaccctgtggtctctctcactgtgttttccaatgtctgtgtctgaagcttggcccttccctctttttttagtgattaccctcattgatggagagtctgaaagagtgtaaaaaaatgatctgagcagccaggatagagattgtatggaaaacatagtgcagatccttttcttagatcatgggaaagccactgaagtacttctcagaggtattaacttctgctgtagacactggtgcgactgtatgaacttgatgtccggtgagtgatgggtaagtagcaaaatgaagtgacaggacagggacaaagattaatggtaagaaatgactccagctgtctgacagcaatgaggagaaagaaatgataaaaagatatgcaagaatcctaaaataaaacaaaacgaggtagtctttgggactttcaacagtaaaagaaaactgaagctgtgaattatggtgtgtgtatttctgaagacagaatataaatcagttaagagaaggcataggaatttatattatattttagtaaattttcttccaaaatggtaaccataaaaaaatagggctaaatgggtaaaatgtagctctttggaaaactcaactactcagatttctgcttataaatggctattaagtaaatatgatttttagctgaactaaaattatctgaatccttgtagaaattttaccaagttcacaactttgtcagtagtccctgacttttgtttgagcaatatggaaatacttaatttcatttaatttgtatcatgtcaatgtatactttttccttttaatgcaattgaactgttttttttttttattttaatccctagtttgtatgtgttagaaagtatcacagtacaacaatctctcatcctttgcattgttctttgtactttccaagcaactttcatattcattctcctgtctatcccaatgagttgagccgatcatacagtatgattttttttaaaaataaaaacacaaaggccaagaagatattatggtgctgaccaaagtcatccagctaacgaaaggtagatgcaagaacagagccctatgcgtctatgacaatgacttccttaacctctggattttggctggcttttgactcatcccttcgattttatctcctctatctgtgttcactgacggccatctggcccctaacttcctagctcctccttgatctcaatgtctagagcctcttaaacttgcatccatgttttctggtctctcccttgtgctgccagcctcccctggctgttctcagtaccagatcagaattcctgtgtgaaccacactgctgcacagtgaagctgtgcaagacaacagccttcacccacccctacccccaaacctccagagggaattagggaatatttgtgccttctctcctgttcattaccttcagttcagtttaaaagtcagatctgcacaggggagttggagccttctgtcggtcttcctctctccataccacatacagatgcaggcaggcaggcacgcacatgcacaagcaccccccaccaaacatactttatgatttaaagctaaggtatcaatcactaaataaaactgctaacaattttataggctatctcacctctaaatgtgtttagaaaattacacaattcattgtatacatatgtatggagaaaacacctgtcctcttcttgtgatatttttagattaaaaaagagattgcattatttatccaccagtttcctcaggaatcatctttaaaaattattccagttaaagaattactgttactacaactactattttatttaagctgcctgaatatcatttctgtttcagcctggagcagtcaattttgcttaatttaaatattttattaataatcatagaaaaacccagctattacttaatttagtctatttgtgcatgtatagttgagtatagtgggtatagttgtgtatgtgtgtatgtgcatatacaactttatatagttgtgtatgaatgtatatgtgatgaatagttaataataatttttcagatgaaaaagtatgtatgggttaatgttttcctctttggtcctttgacagatggctatgtatatttagtacataatatggtatgtaatatttaactcagggtatactgtttaatttttaaatatttcctgatattttagaaagccaagtattaagactatttttcttccctgtaaaatctcatatattttgtgatacaacgaagaatttataagtgacatattcagtccactatgtcagtccactttatgccagtattagcaaacttatgcaaatacaatttcatagttattaaatgagtgaagatttgaaattattatatagtttagtagaagttacttttatattctccatataacttaaggttacaacattattttcttgtatgtaataaaatgaggacaaattacacattagttaatagaagtaactgggctagtaaaactaatgggtgttttctcccagggcttttgttttcctcactaacaactttattaattggagcctcattcattgtaaatgacaggcacacagcttccctaagtgtaggcatgaaggggaaggcattggcctccataaccgagccacggtagagacgtagctgaccacagggactggaataccacccagaaggcttttctccatgtcttcttctctgcttctctgtacaggttttcattttcttagctttcctatgactgtatagctcacaacctcataccaggaagggctcacccttctttagatccagaatattccaggagagggctctggttgacttggcccgagtaacatgggactcagggactgctaggattggcagaccttcttcataatatcatgctaaatggaggaagaatccaatcccataaaggaaggggaaagtgaaaaatggtagtaaatgcagacattcccaacaagccagaatttcacaggtgctgaccatgtgccacacactgtgccaagaaacttacctaccttgtttaattgcattctcataataattccttgaagggtgaatacttaccacccattctacagatgaggaaactgagagtctgagaggcttagaggcatactgtcttctatgtgacagagccaaaatacaaactaaggcttatgtcacaaaacttgatgctcttaactgccatagtgtactatcttaaactacttccgtaataattagtatttgtagctattcaatagaaacaacattttattttcattttcttcgattttaaaataattcacacagtaattgaatatgtttataactctttgcttttttctttattgttgctctttcttcactgaaataccacgctgcataatggaatcataaacagttcactgatttcctaacaccgagggagaaggtgtctaggcaatattagactttgtctttttaattttcatataaaaatttgaagtataagtaattgctttcaggcctatagaccacgacaataatttcattagcttctcaagtccaaattagattagtaaagttgtaatgcatgaaaaagcgcagaaaaatataatgttactttcttttccggtgttcttaactacagagcagtaatgtgatttttcacaaattaaagttctataatatctgtatgaatataatgcatctagtcttcaacttttctaaaatacaacgagccagctgagtaagcccatcgattgggtaaaaatttggaaaatgtttttcatgctaactcctactgtagtaataaaatctcatttaaataaacaatagtcttcatgaagaattatatgataaagatttgtttgatagacatagcattttcaattaattgtttaccatctgttatgttctctaatcagtgttacagccattcataaatcacatttgcctcataaaaagatggcaatcgtttacacgtgtgtattttattataatcagcatctgagacattactttctgatttaaacataaaggaccggaggatacaagactctttgagcgtggtataatgtacttatgttttgtgattgttgttgttcttagtagaaaactggaatcttccaagaattagaggttttgccattttttaagaagtataatcctagcaaaggcatgaattctcctcttcaattaaactcatcacttattttggcagtacataaacataagccatatttaacttataagaatggcagagcatgggtagaaagctccagacttctctgtagctcgatcaatcactaggggctgtgtttagctgggaagcagcctggggagagatgggcagtcatgtggcaagaaataaaagactttgaatctaaaactcctgtcctttgattcttgaaagagaaaggggagaattttcttctttattttctttttctagttaaagatattgtacagagattgatttatgcatttaacaagtacgttttgagtgcctaccatttacaaggggggtgttctagatactcgggatacagtagtaggcaaaacagatgtttttttcctcctgaaacattctcagcttttcctctttccttttattgccacctgcctgcccccagtgacccatctgttgatgtccagcccaaaggaattcacttgaataaatcgcaaaactgccactacttggaggaaattcagggattattcctgaatgaagaaaatggaaagatctcaggttgcttagcgaggccctggttgtctgttccagggtctctttgctcttcctgcttctttccttggagttgcgtctgtctagtggttggcccctgcttcttcctccactcaactctgggcttatttactttggccacttcacaagaagagtaaaccttgaatgtatttagactccagttctgcctctattgacttcaggtcagtggtgccatgtagctccctccaaagcgtgttttgtattctgagttccccttcatttgtgtcccctctcttaataacttgcatttactatttgtggaaggtagtccctaaatctgtttacttttgaggtcttgatgttccctaaatatatctaggttctcttttcttaaaaaaagaaaaaaaaagaatttgagaagtccactggcagcatggatgaatctatgccatctttatcatatctgtattgaaagatttaggctacatattaacaggtgaatctgctctgagtagcctcttgttattgtcatccttataatttattaaatggacataattagaagcactaatcagccgtggcacttgatgatgtacttgtaatctggctcataatgagtggttgtcatcagttattgtacagagtaggaaatggtcagggccctctcaaacactgattgaacatttcagagttattaaatggatcttaatcactttatcagaaaattaggaaataatgtatttcccaatattttaatcagaaacatcttttggtcatgaggaaagagagagagaaataggaggggggtaaagagagagagatattgagagagagcaagtcaagtcttttcctttgagttcttattggctaatcaacctggtttgcttatgtgaaaatctctacagatatctaagcctcccagagctagttataaaatagtaaaaaggaatgaaagagtaaccttcctcaagaacctactgtgtgccacacatgtgccagtagctttctatgtattaactgaggttgaaagagataaggaatatatctaggattatgtaactagttagtattggaactggcatgcaatctcctaatcttttcttctaccaaattgtccaacagtaaaaatgccagttgtgaatttttttctttacttgattgttttaatatttccttttcgtcttttggtagaataaaacaataagattatagatacatgcaaaaaagcaaatagtataaataaggtatttggaattaccatacctgaaatgactttgtaaggttgatccttctatttcacaatagtttttttgtaagtgctttacacagatgtgagaaggaggaagaaaaatgaagtgaaaatatgtccacttaaaagtgtaaagttgaatgttctcaataaagaggagcactaaaaattcaattccgtccaactcaattaagtaattatatactgaggacataccaatctctagactggctactataaaatcaatatggaaggaaagaaaacattcttgacattgggctttaaaacgtaagtgtagaaaagccacaatggagattacaaatgttgatatcataattgagaaaaaaacaccatacatatgggaaatgtttattaaacaataacactgggcgaattctaataaatatctatcattatttcatgggagaaacatagtttcatttttaaaatttaaaaaatagctttgcataagcactcaaaggaagagttttttttcctctactatcaagatttctttgagatatacagaggctcaaccttcttacataattgaattgaggtaaaatagactcttgaaataaaatatttttctagcatgagaaaatagggtttgcacttgataaaattgggctgggcaggtcaagtaactggcctaggggcaatgggcaaaatgggagcaggactgattccaaatcctagtctctgttcctggtccagctttggtttttcacctgcattctagggaagtgtattatagtcttcttcctcatggtataaaggagagcgtggcataaatgctgtgccactaatttgcatatttgaagaagtaaaggtaattggatgacagaaaacatcaggattgatctttcctttttcctctcttcctttgtcttcttcctgtttcttctttctaaaagatagttatctgtggtcccttaaatagctttgtaatgcaataaataaattggtgtttaaaaattatgaaatatgaatataaaataatattcataatacatgatacataaatatataatataaataaatataaaagtataagtaagaggctaggtgcggtggcttatgcctgtaatcttagccctttgggagactgaggtgggaggatcacatgaggccagaagtttgagaccagcctgggtaacatagtgagacctcatccctaaaaaaaaaaaaaaaaaattagctggccactgtggcacataactgtgatcccagctactcagaaagctgaggtgggaggatcacttgagcccaggagtttgatgctgtgagccaggcttatgctactgcacttcagctggggcaacagagcaagaccctgactaaaaaaaaaatggtgtatacatatatatatatatatgtgtgtgtgtgtgtgtgtgtgtgtgtgtgtgtataaaatttttaaatatatagatatataaaaattatgtataatatatacataattttacttatgtataatatatacataattttacttatgtataatatatacataattttacttatgtatattatacataaatatatatattttcttctgagtagttgagtgtatatgtacgtaatataattctaccctcaaattttggccagttcaatgggaagacccgaagggaggagaatggagagtgacagggcatacacacacacacacacacacacacatacacacacacacacacacacactttagagaataggaaagtgacataggaaaaaaaagtcttctgatctcagaattgctagcaaatttatttggttttctcctgctgtttcctctgtctctagcattagcctctattactgcctttcccaatgcaaattagattaccctcttatcactgagcttcatttgctctctggcctccagtatttagtgactgtgctctgtgttgacacaagaacccagtggagtggaaatgtcccgtaagcttcagctacatggtccagagaaatcaatttatatgccaataggctagccacattccatcctgacaacctgttagaaccacctggggagctttggcatctatctatccatgccagaccttacgctgaccagggaaatcactaccttttgggggagggttcctggattatcagccttaaaaactcactcagtccctcactgtgagggtcgtttctaacatgacaccggggttcttcactggtgaagcagattctctgcttctacttgtaggtggtccttagcatttaccacaaatacctattcagaaaatctcaagtaacatttgtcctttgattttcaaatgagagtacttttttttttaagaatgcaataatttccctttttttcatttttttctgccttttagatgtttgaatttatttattatttattttaccccaaatagtcataccttcatatttcacatgtcgcttcttcttatgtatttcacagacttctagaaagtttttgttttgttttttactttgctctgtgcttggcttaaagtatgcattcagctgagattgttgctgcactgggaaactcttattttgactcaaaagtgattcgttgatatgtttcctttctggcagacagatggtgaattgaacacagagcttttcttttcttctgagtagcttcttgagtggggattatgtaataaatactgcacaaggactgctcaatcaataaatttttacattaaggaaagataaaaacgtcagaggcagcagatgatgttttgtcacaagacaaagaacccatgggcctccctgtgccaagttatttaatgtctgacagaatgagtttttactttatctgaggaaaattaccataattaagttgtccgttctgaaatgagtagtgtatttctttttttacagtagtcaatgcttaagatatatttttgaaaaagcccaagtgacttattaacaaacacaggtgtttaatcataaaagttaccacctctcatgagactaagaatgatttttttatcttagacataacattttatatttatataaaatatatacaatataagtattatatattcatcattttttagatatcttttttttttcctgagatggaattttgctcttgttgcccagcctggagtacagtggcacattatcggctcactgcaacctctgcctcccggggtcaagcgattcttctgccttagcctgctgagcagctgggactacaggcatgcgctaccatacccagctaattttttcgtatttttaatagagacggggtttcatcatgttggccaggctggtctcaaactcctgacctcaggtaatccacctgccttggcctcccaaagtgcaggaattacaggcgtgagctaccgcacccagcctagatatcttaaaggtataaggatttaaataaagtttgtctttctaatgatacactggccttcagagagctgctttctcaagaagcctttgcaatcctgacatgttgcatgttttagggcttttctctgggctcctagacagttacttgaacctgtttctctaattcacttatttttttatttttatttttatttttttgagatggagtctcaactctggcacccaggcaatggcactgtgtcggctcactgcaacctccatctcctgggttcaagcaattctcctggcccagtctcctgagtagctgggattacaggcacccaccagcacacctggctagtttttatatttttagtagagatggggtttcgccatgttggccaggctggtctccaactcctgacctcaggtgatccacccacctcagcctcccaaagtgctgggattacaggcatgagctgccacacctggcctctaattcacttatgttctttatttatcttgtactggtatattcagcctatctaccagttgtgatgttttctcttcttccttcagttcagctgccaagagatttctgaagtttcctgtagacttccaccacttaagcagcacaacttgtagttctgcggttgctaaatatcaatgtctagaatttttttgaaatttagagagacaaacatatgtgttctgtcacctttgacttggcttttatataatatttaaataaagcaggcagaccaatttacactgaggatgaaagttacagtttaggagagcttgcttctgtgcattttatggtgaagttcatcttatgatgatcattttccaagtgatttggaacattttgaggtgaagtggaaattgctaatgtgatgtgtactgaaagatgagatgttatcacaaagaagaatgtgttttctgtctcaaattaatgtacagtttatgtcaattgcactgcctctttatttgcagtggacagttggataccaccatcaaaccagctagataggaaaggaggtattttaaggtgtagaagatagtgaggccccaggagtgtggagccatgctggagacctttctaagctgtcttgagaatttctcctcagtgttgactgcattcctctgcccttgctttaccagctccccatctcttatatttctgacccttggctttgaacttgactttgatttctgtctgtatcctttgcttctcctctggactgttccagcccacatcctgtggcctgtccatgtgttatgcttgctatttttatctgaaactctaagtttatttcaggcattgtggaagcccccttgctctattacaaacttaggatggtccttgaaatcttgctatcttcctgctaaaatgtctgtgggctgcagatgatgccctttattaaaactaaactgctaaacagccttagagagatgatcactatctaaggtatgttatttgtcttcagtatttatttttaggaacacaatacattaatcttattttctgagagtttttgcttataatttatagtcattcttcattaattatacttaccatttctcttgagaatactgaaatgaaaaagtgtctttggattttgtgtaactgaatttatgataaagaaaaattggtttatttcttgtgttatcttcttacatttcagtggctttagaaatatattaaagttcaaaaaccgggtcaatttattaatctcagtaactgttttattatccttttgagtgtgtgattaaatgtagcagagaattcatggatgaagtatggagaaattctttcttaccctggacaatttttaccctggagtaattttttcttactttttctccgtatttctcagtaacgatggtaacactcacacttggctattaagaatatataatcagacatccaaattattctttttcttttttttaatcacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggtcagcatcattgtctttgaaggatttttaagaaatgttttcttgttaaatataacacaaataaagagagccacgtatataaattgttataagggattgttacaaagccaacgccgctgcaaccccacccatcaggagtcaggacaggtgctttccatatgaccctcattggggttcattggaaccccctgcccccaaataacaactaatgcaacttttatgataatttacatttatttttattttttatccaactgtgcatctctagacaatgtagattaggtttacctatttttaaaaaatatttttaatccccagatttcccctctcttcctttttccttttcagtttatttgttaaagacactgaattgtttgttttgtattgattcccagagcctggattttgcagaattgtgtccatatggtatagtctccaggttcctctctactcggtatctcttgtaaattggtggatggagatagagatttaatcaaaagcacactcttttactgggaactctcatctataaattgtatcttattgtatattaatgaagaattagtttagctataaattctgtttgtagtaaggaattgcccaaagctatggatgttagacttatggttacctcccctttggttcccatattctagaacatctcctgaaaaaaaagttaataaaatttagacaataagagatataagagatggtttaaagtataccccaaatctcattgacagtgtagtcagataaaaataagtactgaattttgctaaatattattaaatatgtcaaaacaactggaaaacgaaatccttgggggtaatcaaataatgttaactgcctaaaattatcattaatcgttcttatttacagaatacacaccttctggcaggagaagggcttaggagtcacacctgccaacagacttccagttagcacctttgatactagcagatgttctgtttttatggcaaggaaggccacatagtcttttattctgttataggaaagtgcagtcataacatgataaataggttctttatgctagaacacacagcagttctgaaaccattttaaaacttgctttatctcgagccccttaatttggaagctcttcaaaaacaaaagataaactttcttgatagaaagactcctcattgccatataacacctgaccataaaaagaaaaacaaaaaccaaagaccttgtttgtcaaagctttttaaatgttttaacctgtggcttatatagggaaacattatttttggagaggaaaaatttgaatttcttttttgttccaaaagatttttaaagcctgtcttgaagttatattctatttgtttaaagtttactatcttttgaaataaaataggctattatttgaaattatatgcatctcaaaacattttctggcatttcatttttaatctttaatagataaaaataaaaagatgttgattttaaaagctaattacagttcttgagtcctccaaggtacctacccatggagagaatattaatgcatatagctaaaatcctgactaaagaaaccttgaaggatttgaattctgtaattgttctcaaactgaatctgagagacccagaccttttcaaagttcagactgaaaaatccctttgcccaccctaacccacccctcctccttccctgtgcttctatattaattgtgaattttttacacttataatgcctctattaccatacaactgctcttcttatttaattgtatttgtgtgtttttctgtgtgtgcacattctgtcatccattaaaatgccgaatctgcagcaatggaaaaaaaactatctcaactcttcttctccttccatactgaagcaattcccatgaatttgtatgcatcccttcctctaccctgtctttgaaatgttggtagctgcagggttcggtaatatttcttactttacacatgttgacttcaaacttccaacattcatagttctcaccctgactctagtctcttaaagagacttaaagagcctccccacttaaagagtggacaatgtagaaatgaggaaacctgagggcaaagctaatgggatgtttacaacacctactacttctaaatttagtttggtacattattaactataattttgtggccaatttaaatttaaactgttttcttttaatatcccagttccattatccattctgtgttagcttaatattgctcaaatatcatttttgtgggcctttgtcaatagaaattaattctgtctctcttggattgcaagttctgtgctgaatagtgagggtctattcccaagcagcttccattctttactgggaacgtcaagaatgtggatgctcataattacaatttctaagtgctcttagtaagttgttttaatgattctagaccttgctcagaggtggcatttgtcaattctaagactcatttaccttttttctgtagactccactcttcctgcccaagccctaaccacagacagtgattataaatgattttgacagggatagatcttacctcttgagtctgtaataggcattggtttcatggttaggaatgttgtttctactggccactttctaatttaattttaagtggaaacatgttaaaatcaagttgttgcatttggtgaaaaaatattaaggtagctatgttaaaacagaataaaaagaaaacacgaatacaaactaaagatagaatcaacattagatatcagtaaagtggaaaataatggcatacattttccagagtaaactgcatataatagaaagcatgaaaggaaatacataatcattttaaaagtttgaattataatttttctcttcacacatttatttatatttttgggtaataaacaatgactttttggttcttcatccaagttactgaagacctgaattaagtcagctgttgttgagtgggcaactgtagttgatttcctctgagctggccttgccatttatttggaagtacaattccaggaccccgcatgtaccaaaactcatgtatactcaagtcccacatttccccatggaacctgcatgtaggaaaagtcagctctccatatatatatgggtttcgcatcctgcaaatactgtattttccatatgtttggttgaaaaaaatctgtgcataaatggacccaggaagtttggttgagaaaaatctgtgcatatgtgaacccatgcagttcagacctaagttatttaaggatcaactgtattagcttttgttatattcgtttccaataatatattttttgttcttttcttctaggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtatcagcttattccccttcataatgcaggcttacaccttgggtggtctttaaaccctacctcactatattaccactcaccgttttctctttctttgctgatggtatttgataatgaatttagcatgtgatgacatcaggtatttgtctttcagtatcttgaacctaaaggcctcatttatttatagagtttaatttaattttttgatgtactattcatatgatatttgtagaaaattgcaaaaggttaaataaatcacagtaattgaaacctgtggtaggtcacagaaacatttttcacataatggctaataaaggagtcatttttcttactttcatcatgtattttttttttcattttgaaaaatcaggaaagtctctattgtttttcttctaactggttgctatttaaatatcttccttattttttccagatagcacatttataccagtggtgtttacctttagttcttagattttagctaatgcagttggtttaatgactctagaccttatttaaatatgcaattttgatgtagcacataaaaacatttgagagatatattttatctataataggtttgctgaattaattcaaatatcaaagcactcaatggttcatattttcttaatgaaattgaagaagtaagaaattagtgtacaatattttacaatcttagtctttgcaaagagtgttaataacctaggattagtaaagcaaaatctgttaaatttatgtgtttttctagtggatggaacatagaaatatttgttctttattctttttttttcttctgctctgtttctctaattcattatcttcatgtgatgattcttatggtccatcttgatttacttcccattctatttctgttatcaccatttccgaagattagaagtcggggaatatgttatacttgaaagaagatatgtattctgtcatccttatctatgatcctggtaacctctagagctcagatgttagttgctggttggaaaagaagagaaaaatctatgctggtgggcaacactgttgaattgcaggagtaatattttctttactcataaagtgtggcatttgaaggcttttaggccttaatgaacaaagtgcatactaatgcaatttaaatagctagccaggaggaactagtgctgtccagggaatcagacatacacagtttcatttaaggacagctgcaaatgagattgtccctctaagtggaacagtaactagcattacatgaccaaggctagaaaaaggaaatggaaatgtcagtaggctgtgtgcagttgttattgatttgcatttagtttctcagtttagtaaccctttacattttcataatgcagagaactaactatagaatgtgtatttttaaaaggctaggcatgggggctcttgcctgtaatcccaacattttgtgaggctgaggtgagagggttgcttgaggtcagaagtttgagaccagcctgggcaacataggaagagcctgtctctacaaaataaaaattaaaaaattacatatgtggtgtggtgtgcgtctgtagtcttagctacttgagagactgaggtgggaggatcacttgaggctaggagttcaaggttacagtgagctatgtttgtgccaccgcactccagcctgggcaacagagtgagaccctgtctttaaaaataaaacaaaaacaaagatgtggataaaagatgtagagtgtccaacctgggcagcatagtgagaccttgtctctaccaaaaaaaaaaaaaaaaattaacccggcatgattgcacatgcgtgtagtcccagctacctgggaggctaaggtgggaggattgcatgagcccaggaggtcgaggctgcagtaagccataatcgtgccactgaactccagcctgggcaacagagtgagactctgtctttacaaacaaaacaaaaccaaaaccaaaaatgtatattaaaaaaaatacgaagagtacattaatatgcctgtacaaactgaaatatatatctcaacccgaagtagagatgatcagatacaaatttggaggaaaataagatgttgcatactcacatgtcttttcattctctgtttatcttctaccacctcactcactctatccttctaactatccactatctatgtactgtctatttctctctctcactccccatatatatatataatctattatctatctaactatctagtttcctaggcttctttttcatttgctccccataacactttttaccatcttccttacaaaagagagatgagtggtcactgatcccatgaccacattttgactttagaggctttacaaacaatgtactgccttagaggcaatgcagagtaacagttagggcacagattctggcactgtatgaccagaatacgaacaggagtgttgccactcactagctttatatccttgggtacctctttgtgttttagtttcttaatctgtaagatgatgataaaaataacctttacagttattgtgaagactaaagcgttaatttctataaattgcttagaagagtacctggcactgtttactattatttgaggtcagaaggagtctttttttttttttttttttttaccattactctgataccagagacagagaaggggtccaaggggtctatataaacaatcatatcctgggcaatagcatcatttattatagtctttaaagcaaaaatattattaaagttattgtttcggaatcaaattatttcctctgacttgcatgtgtatgtgtgcaggtttctgtggatgatcgccttaaacagcttcaggaagcccacagagattttggaccatcctctcagcattttctctctagtaagtactaataaactggactgatcgcattaattgaatgaattagcattttctttcactttaattgaagaagccgtattccttgctataaatatgtttatttagatagatccttgtaaggaggtactaacatcaaagaaaatattgcttaatggttattatttgtaataacgtaatgacaactgagaagtcttcaaggtggaacagaaatgaactcatctttagctatggtttctcattggaatgtctgataactaacatagtatcatatcatcattgctttgtcataggcaaagattatgaactttttcataataaagaaatcagttttatcttttaaggttttaaattaatttttctgcttaaaatgtgcttatttaaaacacaccttcaactttcaaagtaaaaaaaatcactccccataaatctttaagtgggaagattttgatttattaggctcgctgcgattatatttagtttttctgctattcgagtattgcgtatgtagccaaaccacctatgcagaattttatgtaatatttttcaactggaattgataaatttatggactattcttgagatcttcaataaacaatttgagcttctactttatcattcactagtgaagatactaaagaatgtcggatttatagtcaaccagattgagtttaaacattcattctgtcgcttaccagacctgtgaatttctgaaggttgatttctttgtcttaaaataccgtattacctatttcctctgattgttttgagaactcaatgacaaggcatatcgaattacacaaagcacctagcacagttcttgacacaaatgctttcaataaatattaattcctttcctttcatttcctttagcaaatatatgtaagaaagcaatttgtttcatttaattcaatttaagtaaactttaaaacttagggcaaagcttatttctcaattatgacagtttttttgcaactataaccatagaaacagctaaaaagtactatatcttctaactaaattgattacatttatatttcctcttaatgtttttgtcactcttgataaactgccttacctcagttaaaggttgggcttttcttttacaatttcaagaatcttaatcagtcattttctgccccttcctgccctacacctctctacctctcaccctcctcactgcccccacccctacctcaactccatacagtttttctgtttcacaaaccttagaccttaggtagttaatctttggtatacgccttcctggaatatactgtgtacctagatgccaggacacatttttaaagtccagataccatcaatgttgatgaagtaaataggtttgctgtatacttattagattattaagtattccagatttctaaagctcagtttttcaaaatgtaaagctatgtaccaagaccaaatgaaagaggaatttacaaaataattgagactgtctttacagttctaactatcagttatctttaatattgatgaaatgctatactttcacctagcaatcactctcatagtggaaatcaagcacatattcttttggaagtgaaatattgtgaaatttatacacatttttgtaaaagtcaaatacatggccttgtattatctaacactgagaatccaaggaggtagaagttattcaaatcaaaacaattattaaaatgagtggggaagtgtaaacaaagtcccaattaatacatttaataattgttatcctttgctgcttggaatctttggctttattatatttcttggacttcagccatggttataaaagaagcctgtttagttaggcacaaaataaaaactgacctattagcctggtgccaacactgaaatgaggttggctctaatgagaaatgtaacatacctacttcctcattttcatccctgtttatactttggtgggcatagattgagaacagagtgcttgccttttataaagagaggaggaattgttgagtagaagaattgctcagctagtgttcagaaattgagatcacatctgagctcgaccgtttatttactggctgtcactctttgggcaagttattttatctctacacatttagttcctcatctatcaaatggaactttaacgtgtatcttgctggcttccttaccgaaaacatatatttgaaaatgcttggcaaagtttagaatgctgaatagttgtaagatattaatgtgacatgaaattgagaaaaaaagtattggtgacaactggctacgtgaggatctgatgatatttgcaaagtatgaaaattccaagtattatttgaatttttatatttgttcatttagcaaaattcttttatggcactaaattcacatgtactattcttcttaaataagtcttaaaataattggttaatgtaggaataatatattttttataagtaagaagtaactagaattgtaaaaaaaaaaaaaaaaaaagtacctcaatttaaaaaccccataaaatctcagtcatagtaaggtctagtgcaaaagtaggagactgggctctctgtatgtttcagatgaaagtaagaaattgggatttttctgcctagacgattgccttggttcttcacaactttttgcctatttttaaattccttctttttaaatgttatagaattgaatttacttaaatgccatctgtactcaatagctactcctgtgactacgatgcaaagtaaacaatgttattagtcatctggaaaattcggtcttgaaaaatctaatttttaatctggatataccaggtaaaattaattttggttttagctttatcaaaaatatatatggagtacagtttccagatggcactaaggtttaaactgtagtatttataagcaacaccatttgaaagtttaaaagtatttttatcaacaggttagattagttggcattagaccttgaacctgtattgtttcttgttttacttcaaatgaatccttaaagccattttttgtttggcccagtggatctcataattataggaatccagctcagaaaccagagcagttcattgaatttgctataaaatgttcagttgttttgcattaaggtgtaaggctttttggtttccaacgtttccaataatctccctttgtttcctcagcgtcagtccagctgccgtggcaaagatccatttcacataataaagtgccctattacatcaagtaagttgattttaattctcctttatgataccaagaaaatcatgttttattgataacttaagaggcttctctccccataacttttaaaaatagaattcagtcctattatctgaaagaaactgtgatatagttaatattaaaaagaaactacttttaacatgagaattatatttttcatgtatcagattagggatataggtgtgtttagctgatatattttaaagtagagatttaaatatttggagacagacaataagctatgatggccatactgtattccagcctggacaacaaagcaagatccagtctctaaaaagtaaaaaaaaaaaaaattggagaaaaatgacagaatttcaaaatactcttgacataatgatatttgtcaaattgtacaaattctaaaccatttttcttcctctaagaaaatccatataaaaatgtcttatactcttgtcattttattccaccaataagaaataatgatttatcatgaaaaagtgaaatattgtcaagtttttctttgtcttatagaagttatctgcattattagcataggctcatcattctttgattctgttgtccagttagtttctccttcttgcatactgtttcttcttcttatatgacattttataagttttgtataatttacacaggctcttagtaggcgttgatccttggcttagggctatatattgtcatggaacagaatgataaaattctacttctatagtcccttggagtgtaacttagtaaagatattaatttacaacgtgctctagtgatgagtcatagttgaccctattttatgtgtcagacgaacagcatcataatcatgacaacacttacttattgtcaggagacagctctgtctcaggttagctgtgtgacctcaggtaagtcagatgaagatctctgggccaagtttcctttttatcatttctaacatggggtgtggtatctccaaaatctatacaaatgctaataatctgctcttccagtatacttcctgaaaacgttgtgtgaagtccatgttggtgaaatagtcttttcttataattttttattacagtctgagatgtaagctcagggtaaaaaacaggtttgcataatatataataaatataataagcaatatacgttacattagcttatgggagtttaatatttttatcagtgtataacctacaatgcactgagttgtgaactgagttgagaacaaggtattaaagcaattgattggtgtcaaatttgcccaagtaagaatggaaagaggtcagacgctggttaagttggcatgtctctagtgaaagaagatgtgattatctaactgaaaatgtttaaaactgtttacatttttattgtacactataacaataataatagtaatagtattagagaactttaatttgcttggttgaatattgacttgaatttaatcttacaaatttagatataaatctgatgtactgtggtaggcaaaataataactgctcccaacccctgaaagatgctcacatcataatccctggaacctgtgaaaatgttaggttacaaagcaagggagaattaaggtcgtaaatggaattaaggttgcaaatcaactgacctttaattagggagattattctggattatcctgatgggcttaatgtaatcccaggggcctttaaaagtggcaggggaggcagagatttgagaatgctagctactagcttggaaggtaaaggaagcagacatgatccttaaatgcaggcagcttctagaagctggaaaaggcaaagaaatgggattctctcttagaacctccagagaaggaattcagccctgccaactttgattttatcccagggagacatttttgtaacagcaatagaaaattaatgcatgtactataaaaaaatcaagaagttcacgcaaattaattgaaattaattaatttattgaattgacttagagtcttttatcatctgatttttttaaaaatgcaaactggatctagtttttgggttttactaaataaaaaaaattaaatatcttgctttatgtttatatcatgattatctgtgtggtttgggacttttaaagtccatccttaattttagctcttttttaaaaatgaatttctatatgtttaggttaattatatatgactgagaattgtctaaatcagaatttctctaattcaaaatgtttataattttggaaggatctggtaggattgtattcttgttcttgtggggcagagttcttatggggcagattggtagaataaaagttagttttacctggcttcccattggctagagcactattaccagcactggaaaatagatataatataatgatggccactattttaaataataacgtttaggactgtagcatttaaaaaaatcttctccatcaccagtaaaagatcagattgtttaaaatatatgtagttttagtgttaaatgtcttttaagtcttccaaatttttagaaatgtgctcatttgtatatagcaaattcccattttcacaaaacttgtttaaccaggatctttcattgtgtaatttaacagtttatttcctcatgaagaaggaacatcaaattctgaaggtagagttataaaagccagtatttatgtgtgaagaattgttatgaaaacaaaatttaattcccaaattaataaccaagcaaatggagaatgaaaaagcttttaatatacacttccctttgcgtggcttcaaaagtagaagaaaaatgtttaaaacaaattttgcatgattgccatgcaatgagaatttcctggagcaaattagaatgtatatggctaacaaaaaataatattcaggtagaaatattcaacgtttttggtgtttaagtatatcatctttgtattcactgttagaatatggccagaaagttgaaaggagactaggaagggcaaattatttttatgtcatattttaattttatagatcacttaaagcccactttgatggcttcccactgcatttctgtctctctaggtaattccttattaatattttgaagtgcactgcggtggctccatggctcatgtgtttgtagaaaatgaaagaatataaatctgaactgaaagagtctatatagtataaacccctctatttgttgatatcttaagttaaaactagtctatatagtataaatccctctatttgttaatatcttaagttaaaactagtctatatagcataaacctctctatttgttaatatcttaagttaaaattaacatttgaaaattttatttgcttcctctaaggtagactttctgaaactgatctagttatttcttttttcctagtatagtgcaatgagagctcattgtattcagggtttaagaacatttaaaatggggccgggtgcagtggctcatgcttataatcctaatgcttgggaggctgaggcgggtggattgcttgcccccaggagttcaagaccagcctgagcaacatgacaaaaccccatctctacaaaaaattagctgggcatggtaacatgcgcctatagtcccagcagtcaggaggctgaggtgggaggatcacttgagcccgggaggtcaagactgcagtgagccatgatcacaccactgcactacagtctgggcaacagagtgaaactctgtctccttaaaaaataataataataataataaataaagagagagagaaaaagaaaatttaaaatggttcttgctgccttcacaatatacaaaaatctgccataaaagccagatatctctcattgtaaatttttggttatgtattttgcacaagttgttcatttcctcagataaaagtcaacttccagggaatatgaggaataagaggaatgaaagctttgggttcggttgaactttcttaatgcatcacattaaccatgtaaaattcaccatttctcagtttgccacagaaataataataacatataataatgataaatagttgctgtgggaagtaataatgatcattgtaataaattacatttttgaacagtcatttatttgccaggtgttgtgctgaatcttgtgcatagatgatctcttttaattctctcattagccaagtgaagtataggtactataattacccccatttacacataagtcttaatgaattatcaataactgcattaaaagtaattaataagcacgcttacagcttgcttgagattacacagctggtaaatagaagagctagtgttcaaacccagggattgtctacagctcctgaactcctgatcactatgcggtgctgtgtcctggccccaatattagttgagtcagaggacggaagtttttagtcccatggaaactttgaataggatgaaggattatatttaggaaggaggatagtagtggagaaagtatgagcaaacatcctttctttcataccatagacggttaccatttactatgcacctcctgtgtgccagcaactgagtccagctgtccaaggacaaagcccatgctttttccagtactccacactgccgttgtataggcttttccataggctaatttctacaggaggatctattttctagatgtttaaagcagtttcacactgtggtctggtaatggacaaaggtgctttttcatagataggaagatgtcattcccacagtgcttgccagttggaccttgagaggaactctgaggtggggaaacacactctttggccttcctctatctttccccattcacatgatctgaagatttctgtcaactggtagatttaagtatctgcgagtaagatggccaacaaagctggcttataagtcctaagggacttgaaacacagatggttctctatacatccggcctgttggtaagtcacagtatttaatagaatttaataagatgtagttaggaaataagattttcctttttccttataacaccttctctaaagcctgagttgttgacttttcagtaagcctttagtcttgctacagatgactattctgttcttgtgacaaggtgtcaccatcacaatttaacaattctatagctcagtttttcccactggagtctgcagtgcagatgttaattcttcatagaaccctaaatacaatgtacaatatcacacaacacacagctttcattatgtacatattagtaatctctggttatatataccatgcatgtcacattttctaaaactgacattcctcaatattgcaagaaattaaccagcataaacttgtctatatctataaaatttgctgtcttacatttctttcccttgttctaactccccctctgagtggatccaaatgaagattatcctcaatttgttacatctctctttatacttttattttccattcttgtgcccattattgataatcctgcaaagctcttttagacctactctcatttcccaaggccaccctctacctgccctaatccttcagtaactgaaaggaattgaaatttgtaatagttgtaaaatcttggggagcgagtagttgatctttatcgcagtcatacagttcatttgcatagattgtatatacttgtcttggcagaactacatataccgtctagaggagagaattcatgcatacttctttagaagaattgtgcgccagcttaggcaatacagaagaaatagtccttccctaaatatggtcagagaggagtatcagcaaggcaatctccaaatactcagcctaacaggaaaatgaaagctaacaaagtgtgtgtaacagcaacaacgaagaattaacataaagcattttatcattaacggttatagaaaacttatcccagaacagaataaacccgtaacaaaggtataattaacaatgaaaaataaacatagctctctccaaaagggtccctacagcagtctttatttctcccttccctctttcgtgaagatgagggatggtatctttttggttccagttttttaagtaaagaactcttgggccgcactttgaatctctttcaagaactggagcttgtggttttggttttaatgataaagaagtaaatgaaatagaagcataagcaaaatgtactggagagtctgtctttctagtagtctgtgactctgtttttactgaaaataaatatttaaaactcactgggccaagtctgctgatggggaggtaagaacaaaattgctttatgaaagaatgtaagtaccttaggatcactaaacccctgggcttggaggggcttcagataaatgagcataagcataccttggctaactaaaaatctaaacagtagaaagcctgccctgcagcagccagcaaaccgtcactgggaagaaatcttatgtattactggtgtcctagttaattgaggtaatttaggtggaattgatattgtctttgagagacattaggtagttaaggacttaaaatatcaccttcactgccattagtctacatattgttgggccatgaagtagtattttggcttggaatcttctagattacccaactctattgcattatagtgacaccatcagccttactgggcaatttgatttttagggtaagggatgcagttagtaaagttctaccatacaatgtaggaaggatcactgtggggccatttagagaggaaaaaagatatctatactttataaagattaaatttttaaaactgccattgcaattagcaaaagtacagaagtaataatgtttaaaattgtaaaataaatagaaatatgctgattataaagtaaaataatacagtaaaagatttcatataaccatatagaaaaaaatagaagtaattaatcccttcttttaaaaatacataaaagaaagagataaagtagtaattttttttaataaaaagctaaaagctacaaatccagcttttaaaagcaaacttaaaggatacaatgatcccctcaactgttgtgggaacatagtcctggtgttaacaccttcagatgggggcatacaaggctccccagggccaatgcaacaacaaatgacctacaggaatttggctgatggtctgaatctccccagtttgagagtcacggagatgagggtagggttgggtgggaggtggggttccctatgaattctgggctcatgtagaaatattatcaagctagcagatcccctgggtttactgagtatttgcatgtttatatttccaagcaatttagtaccctcaagacaattatcacctgtccctcccctcgcacgtagacacatcagttttgatcattaattctactactttatttaaaaacaaacacaaataaactttgtcttattgttttgtaacaaatgttctagtagtcatacatgcaatattgacatcttatattttggggtgtatggtatggtagcctatttctatatagtcctttccatgtttgtatctttaaatctactcttgagtgtgaaattactttaagtgtattttgtttcagagacagggtctcactctgttgcccaggccagagtgcagtggtgcaaccatggctcattgcagtcttatactcctggcctcaagtgaacctcctgcctcagcctcctgagtagctgggactacaggtacatgccaccatgcccagctaattggactttttttagagatggagtcttgctatgttgcccaggctggtctcaaactcctgacctgaagcagtcctcctgctttggcctccccaaatgctgggattacagacatgagccactgtgcccagcttaaatgcattttatagtcaaatcctacggaattattcattatttacaatgttgtcttcctgcctcctgtcttcattatcatgagatactaatggcattttttaaggaagactctaaacttttgcagtacctattatcaaataggatcatatatcttatttgaattttggacagaattttttttttcttgaaattctgacctccacgcttcttttctcttaagttaatttttgtttctaaaagtatatctttggatttcctgcctttaaaagcttagaggacagtagacagtgtttgcgagtggatgaggaagttgaatataacctgaggaatatataagttattcctgcagctttctcacccactacctccatcctctccccaggggcttttccacacagacacacacacacccacacccacacccacacacacacaagcacgtgcacagagtgagaatcaatgttactgatgggggtactccacattcttcctatattctagtcttgggtgaaacaaggactgaaaagattataaattccaaagtaagtacaccacctctcagatctttaagaaggtgttactcaaataaatgttgtcatatcagattgccaacatttgttttcactcttcatactttaggcagttgaatgcaaaatcgattagttgggagctcgtgcttgattgctatatatatgtaacttctataagtgtacataaagtaaatgttaacagaacctgtattttgcctgtgtcaacttccttttctggagacttctggttttctcatagtacctcccaccttctaatacactgtataacttacttacagtgtttgtcgtctcttatttttccccatcctgaggcatggccactccacttggcaccatggagttcattgctaataattataggaccagtttgagtgcaggagaaaagttggaagccaaacagaagtggctggagtggtgaatgggacacgaggaagtagatatggtacagtactcattggtgaattttgcctgtgaaggagagaaaaaaggtgataactagcagaaaatgtagatttgaggtaggggtgtgtgtgtgtgtgtgtttaaggatggcacgtctgtaaacatttatattctacaaaggatagtcttcttgagagaggggttgacagtgcagcacaggaaatttttaagaaatcattgggaagaattggcctttaataagaagggggacaatttctcagttaaaggggagataggataacagactggcagttggagggaagtttcctgagttggtggtggagagagaaaggagtcctcatctagtagtatttaggttttcaatgaagcgtgagataaagtaaaatgatattaaggcagagaaataaaccagtttggggagagagatagcagtagtgaatttctgttttggagtttgggaaagcaagtttattagggaatatagtgcagttgccaggagttggacatttgaggtttgaaatcacatattttaaagtaaattgagtctgtctgttgagtgattttctccagttgtttttatccacagctgctcaggtccagagtaggcaagtaattgagctgatccaggcctgggatttgcaaggggtgagagagaagcaagggagatgaggttatttgtaatgattctaatgatagaccatggactcaaatttggacagattcatcaagaaatattttaaaaccttaattatgcaaatatacttccatatcaagagcttagcttaaaatgagactatctctgtttaaatcccatttctattacttactataggacctcagacaagctatctaagcactctctgccctagttttttccatctgtaagatggagacaatattgtcacccaagtcatagaattgtaatccaaatagaatttacacatagaaaaagtttatccaaaaaagtttacttggtacaaatcgagcactcaaatagcatgttattactgtgattaatatacatcctgacctagtatattttactttgcacagcaaagaagaaatatttttttctttgattgtcttatctcagagcaatatacatagttcttgtccccacatttgtatttttacttatctttagttttgttctgttatatgcctttataattataattggaatggaatgatatataacaaacctcacaaaatccagttataagcataaaattggatagctagtaacaaataagtatatttgggtaagtgttagtttttggagaaacaagttgccttctgatcatcctttaaggtttcatggaaaaatatgagaccactctaatgaggacaaatgggtttaagaagtatcttccacagagcagtcatttgcccagaaatcaagattttaccagcctatcaaaagtgcatgtcctttgctgttggttcattgtgttacatgttaggcagtattgcagcacaactttttttgttttatttgttggtgctacagtcttatattatttgtgttttactttctgtggcttatcagtgttatattgttatgaataataatagataggtggaaggatatactacttcttaaccttattggcttaatattttaataatgtccataaaatgcagagattatatgttatcccagctggggctcttcagagtaagggggcacttttaataattataccaggatgctgatatgtaattcctgtatacagtctagtataaagcaggatttatactgcttgaaggatagttttcaaaataggcaaaaatcttaactcttatacaaatacaaaaagagcatgtttcatttaactcatagtaagggaaccagtaagaagttataataggttccaaagagaatacaaaatgtcacatatttatagtgagattagggatgctaaaatgaatttacctctggatgcaaagctgacaaactggtcaatatccacaggacaataatcaattgcattccactgggcacaatttgcatttatatggacagaaatcatttgcattactatctgttttcttcagtttgcagagtttaaaatagctcagagataatttaagctttgcaggatacccactcattttttgcccacaacaaagaccttcacaatttttccctgcacaggcaaaactggatggctggccagcctagttacatgtcacatgttctcactattgtttgcttcatatgattttgtacttaactgttaattgctactttgttttttgttttgttttgtttttttttttttaattttattcttggatagattcccatggctgttgccttttaaagagaggatttttagtaataaaatcataattttattttagagcttatcaagctgcacaatatgaagtcccactccctgttcatatttgagattaattagaacccaagctgttgttattttgggggaaaatgctacttttattctgttttggttgcctactctgggagaacttcaggcattttggcaagaggagctgagctatctgcagctgttcaaatactttaagcctttgggttcattgtggattttgctttaaccctctcccccgacttaaaaaaaaaacagcagccaactgcattgcctgttttttttatttctgttgtttggtaagcagcagttatacttttgtaaccagaggctgtatttattttctgtgttggcagttctgcctaatgaatcaactggtattgaattcacaaagggagatgcccgttccctccctccatctgtttgccaaatgtgtgtgttccgtcagctctcagtagtggtttcactaaaaagagccattagcaagaggtgttcaccttgaattcttagtcctccgcctgactgagaaatagtggtattttcctcttgtgattccgtaggggttgtgtgaggtgaagacccacacctgtaattccagagaaagcatatttgttgtttaagtataacgtctggctctacattaccgatggctttagtttggttcttgagccttggtttgctccatcatgatgggatgtctgtctctggacagtactgttgtcgtggggattgaaattccctgaaagagaagacaagagatcaatgaaccctagtaggttctctcagactgggagcccatgatgccttactggaattgcattacctcctcagcaaatccttccatatttgttggtaatagggaggaaattctttttgagactctgcatttctgtaaagctctgagcctaatgatgaatagtaagaatttaggtcaaacaacttcagtacccggctccatggtcttttgagcaatttgtagtatcactaccatcaaaccgaaagggtggaatggttttgttggtgttcagtagtggaccatgaagtagaagtatttgtctctgcattggagtcaagaatctgggtagaggagcccgacaactttccatctctttccaagacagatcttcacattgtagttacattattttgtttgagatcttggaatttccaggatacatacccaattgctaatatttccgggatacgtacccaactgcaaatacacactttaaatatttttcaaaggtaagtatgagttatttggggtttttgttacctgtgtatatataacagtgatgatattcttttcccagtgacatgccccagtttttgatatattacataggcttgaaaaataatttctcttgaatttgattttatgaatgttgtaatatcactctcttaggtactatgctggttcatttagtttactaaatagttttataagaactaggtgtcatttaagaagtctttggagcactattaaatgttatgaatctaccctgacctagataaggggcagttaactctttttaaatgtaaggccactgacccaccaaagtcatgaactgtttacctaagaaacttaattgaagcattccatttatgttttaacctcaatttattaccccaaaacttccatctaacatatgaattagttttgaaatttacagaaaaagagaaagtataaaacttgcttttaaagtgaagaacatgaggaaaacaatttaatacatatagaaaataataatactggttaatgagaggaagctgagaagaggaacacagagtctaagtggcaagagacacttgcctgaggggagtggggaatccagatacacatgaagagaagaaagggtagatttgcactgaggaaagttcgactcaaggtagaagaggagggaggctctgtagattgtgggatgatgttattcagagttaaacttgtttctgcaatctttggaaatatgacgagacttttaaggtgtagtgactcccacagcactacttctgctgttggaggattcgttctgaatgataatctacatctgtttaacagatatgggtttattctggagcctgcattgatctggccacatcaagccaggaccgaagggttcatgacagtcacattttatatctaggttttaatttgtagtttcagttctgtttgaaataggcaaagcaaagatttcatttgtgtttttacaatgtagttgctcaaatgaaatttattattaaaaaatttttataaaaaacttttgtatagagatgaggtctcgctatgttgccaagctggtctcaaactcctgggctcccacctcaggctcccaaagtgttgggattatagatgtgaggcaccacacctggctaaaatttattattaatattttttatttttttgagacagtgtctcactctgtcacccaggctacagtgcagtgaaacgatctcggctcactgcaacctccacctcccagcttcaagcaattctcatgcctcaccctcctgagtagctaggactacaggcacccaccaccatacctggctaatttttgtatttttagtagcgatgggatttcatcatattggccaggcttgtctcaatctcctgacctcaagtgatccacctgcctcggcctcccaaagtgctgggattacaggaagagccactgcccctggccaatgtttcaaatgttaagtaacaattgggcattgggtttctgaatggttgataatgaggataattttgcatgtatttttaaaaatttgaaaaaaatcatttctacttgggtatttcgtttttggcctatatgaagttttttgattttttgtttatttttaaaattttaccttttttttccagccatcaaacacagaccacctgttgggaccatcctaaaatgaccgaactctttcaatcccttggtaagtgttattaatagtaataaattaacctaaacaactgagaaccggtttttttttttttttttttttttttttttttttttttaaggtggattctcgctgttgcccaggctggagtgcagtggcatgatctcggctcactgcaacctctgcctcccggattcaagcaattctcctgccttaggctcctgagtagctgggactacaggcgcccgccgccactcccagctaatttttcgtattttaatagagacagggttttactgtgttgcccaggctggtctcgaactcctgagctcaggcaatccacccgcctcggcctcccaaagtgctcccgtgagccactgtgcccggccgagaactgtatattgttaaataggagctaatcaccagcctttcttacatggcatattaatgttaaaagaatcatgtcattgacatttaaaagtagttaaatttctaagggcaatgcagtaaacaggtattgcctttcttaggagaattgtgtggtttgaaatcatgtgagccaaaaagagttgatttacagggaggaatgtaattgtagtttttacctccttcgtattgagtcatcttaaccttcagctttgcacgcaaaaaatatatatagatatacaattacaatatagccaactttaatccactgccttaaatttgcttttggctcactttttatttagtacgtgccatcaaattagctcacctagtttaaatttgtctaaattgttaaaagctaaattcatttttatataaaaatgcaagaaaacacagacgagaattccggttttgttttaatttctagtgcaatgtggctttcaacttattgtttaacctacttcctctggttggtccagcggtttttttaagttttctctttgggtagctaaggagatgctggagggaaaaacagcacccgaagcctccctctcccatttcaataaaaaggatgcccccttttttaatctctttaaatgttgggcttctgtgtgagtgtttttttttttggtgggtgaaggggcctgcaaaagttggacaaacaaaagacatagaactggtttgcttagtttgtaaaatgagggggcaaattttgatgatatctgagttttcttttaactctactaatctctgatactctgtctttaggggacaaagaaagaaattacaatatctattgtttccaaagagttgagtattggttgtaggatcatttgaaccagatctgcaaaagggcaggaaaaccaaatcaatcaggatgggaggagcatagaaataagatgagctccatgaatagtgaactggacagtgtggttggaagaaaatgaagtgtccttggggaagatgcccctggaggaaaatctcctttattgggaaaaaaaggaagggccctctgcctactgtgcagtgcatttaataagccatgtgacagctgtgctttctcttcatcaccttcctctttttcctaccaaagggctgaaaggggtggtaccttttctcacccatcataagggtcatggtgaccctcctataacaaaagacaggtcaaccagaaaagcacaagaaatttacttaatcaaagttttacctgacatgagaaccttcagaagactcaaagaaaacagggaaaagtgtctgtttttacacttagattgagtgaggaatggatgactgcattgaattgtgattggatgaaagggtataatttaatgataatagactgagaagggaattccagcaaggcctatctattcagattcttcttggcttctccctgcagcatattcctttcctctagggacaggatacctgtcacaggagaatcttcaggagagaagggagaaggtgacagtgaacttgctagattttatggcttgctttggggaagagaagttctagttttcatgacccaccttggggaaggggaattctggtttctatttatcactttggaaggagaaagagggtcaggagacaagagacccagaggtcagagagaccttactactgaggccttccagtctccttcatttcaaagtactcaacccaccatgttctgagccctgacacctgttgaaaatactttcttagaattttctctgtagcactgctttgagatgtatctcaacatggtgctaatgatcatttaacttttttcttaaatacgtgttggggaatttgggagaagactttttatttcaggcaaacataatattttttcatcatccaaagtaaccaaatacattctgggcattcaatatatattcaataataagcctatcttcaaattgtttctttttctatttcagctgacctgaataatgtacgtttttctgcctaccgtacagcaatcaaaatccgaagactacaaaaagcactatgttgtgagttattctaccaaagttaatcaatctgttacttgaattgcgttttttttttttccaagaggaagataaatgaagaggatggagtgtttgccaagttaatctggtcttcagtgtacctcactcaaggagttggttttgtttctataaatgttttattacttgccccatcagtgtgcagtactgaacacatgccattcttacttggagaacaaaattaaccaaaacacaggagtaatgtaaaaagctttttcaaaaattgtgctgccacccaatttaaaaggattaaatcaaagaaagtattaagtcatgtgttttcagtaccttttgcccatttggcaatgtagagttccagtttgtctcaataccactatatataaagaaacactaaaaaatcacattcctgatctaaatttgaactggcaccttaacaagtgagataaaaggctctattttcttttaaatatatcttgagacatttagtattatcaatgcatttttcctgtggaggatgtgttcagagtggaattctgtggcagtcctttcatcaaaaggatatttcctcccgcaaaataacctaaaattaagtagcagtgtgaatacttagcatatagatttatgctatctggattctatttgtggttgtagttctaatgattgagtctaccctaggccttgtcagatagttgatgtggaaagtgatatttacctgttcttttaagatagggtaaattgaaaagtttcaagtattcttctttgctaccttttgttaactgttaatatacgtctaggcagttcagtgatgctttgaaaattatgctttgaaaaatgatatgttaaggttgaaaaatctgctccttgaaagtcaatagaagttagcaataaattttaagctggctgcacgaagaattgaggaaagagaggtataatgtcattgagaaaaaatagcaatgcaaagcttgaaaataggaaaagcttaagctatgtatggaagagaagtctacagggctgaaagacacctccagatgaggcaatgcaaggaagaatgagatgaccttgacttttgcataatccacagagcctcaaagataattagcaggtggtagtagttgcagcaagtgttgcagaattacccggacaaagaaaagaaagccaccacgctctggctactgatcagtatgttgagcgaaaagagaataggaagtaaattacgaacacacaaaagggatgtttggtctgcgcaggagtccatggtgacagcagttttgaaagaggctcagctgcacatccaggatccagttgatgggtctggaagttcttctcaggcctgatgagctataaaatgaggacaaatgactcagccacaaaatttccattgacagaagactgctttttgtcattatgaacatggtcccagttttcgacaacacttatgggtggataagcatattaacacatttggtgttttcttctcttggttctttggattcctgaagaaaaaaaccccctcctcagctcttcccctcaaacctgagaggaacagaagggacgcttctccaacttctaaactaaacgagattggtaatgacaattaaacaactaaatgacagttagaaaagggctagattgtattggatttcaagtatatgaggtgcttttttcagagccaactgaccttcacttttcctacagccttctcccactgccctccagccaaggcctctgggccactcctggagctcatcagtttattattaatctgcttcttcctctcccttcctttcagtttactagaaataccctgaccctttctctgcactggcttgtaacccttttttcctcccaaatactgttaaagatttacctcttttggaaacatttacaagctaatcctacccgtctccacattttttcccagtagtttatgattgcctgtaatagcaggttctctcaccttagtgacaagtgcttgcctttgtgtgctcgaataatgtttggtggattgccccatctccactgtgaactactttaggtcatggctgtctctcattatgtgcaaatctccacccagcataaggcagagggcagtgtcattgttcattcatttgttgggctccaagattgtgcaggagataaaacactataaagagacttgattctcacactgaaggaactcatatttcgagaacgttgcacatggacccaatgccctgcttacaaaagattcctgctgccctcagaatggaatggtctttgcctggctcacctctctgtccacctccttccctctgctccaccggggcatcaccatttcatcatccacttagtgatagaaatggcaaactctgtattccattcctcctgcctaaaaagcacttgtcttagctctttgtataggttgatgcaaaaataattgcagtttttgccgttaaaagtaagttagggtatttcattaaaagtaatggcaaaaacctcaattacttttgcaccaacttaatccttctgttcttcccttggctgggacactcattcctgtaggtctcaatgttgtcgatcacctctcttttaatgaggttttctatggctcctcatagaactgttcttttccttacatgacacttctggtgcttggtttaggcactaaggcagagtgtcaatggtaatttttaatattctgtttattagttattgtttgcttctccatcatgggatggatgagtctgtgttcgtctctacttaggacctcatacaatttctggcacagagcaggggttgcttaggacacactgagtgaatgatttgagtttgaaggttatatagcagtactccagaagatgtgtccaaggagatttatagcagtacttttcatagtaaaactcattcagttttggcatatttataaatataatacagcaacaaaaatcaatgagctagtaatcagcatcaacatgatttaatcttagaactataaaattaaatgaaaaaattaaatggcagaaaaaaaatgtgtaccactctgttccatttatatgtagttcaaacccatgcaaaactaatgctatatacacttttaaaaactgaaagtgaaatacaaaggttaatggttaccccataattgtaagaggatgtaattaggcaggattcaaggagcttccaagatagtggtaacattctgtttttttcagctgtgtgatggactaatgggtatttgttctattattttcttttagaccacacatatgtattttctgttttcctttgtattttgattttgaaactttatgtgataggtaatagcagaaaagcaaaagggaagtatgttccgaggagggggagagtcctctcattatgaagaagaaggcaggcttccttgattagtgggcatatgagccaggctataaaaggcacctgggatttaggcatggggcagttaattggggataagaagggaaggagttatctgtgtgagaattaaggtgtagatggtgttcaaggaacattaagttatagagtctgaatggaatagcttagctattttgtccaatatccagaaatttccttaaagttaatttaggtcaatttgaacgtcatatttttcctgaaattcctttcggtttttttcctcaagttcttattgtgttgtatttcatgtttggatatttttcgttatagaatggggagccatgaggcattttctgtattgtgggagtttagagatagggccagaagtggaagtatgctttagggaatatctaagaaagaccaaagggcagagaacagagaatgggtaaatagttcaggtgaaggatgatcaaagctgagctggctgggagttgtaggaggggagatcagggtctggatttttaaggctgcctgaggaagaactgatgactcggggtattgggtagttggtaaattgtggcaggtagaagaaggaaggatgttaggatatttcacggtttgcagactggatttcatcatgacaagaaggccaggcctttatggggagaggttcctgaaagagaattatatagctcttgtagggatcagagcaatgggacatgggtcaagtgttgaggcaggagatcagcaggagaaaagagaatctggagccatccaaagagaagcaataatagaagtaagaggagtgagtgagggcctcaggctcacagaatgaaatgccagatgtgaaaccttgagctctgcctatatttctggggaagagaagataggggaaatgctaataataataataataataataataaaataaaaaaataaagaatggccacatagcttgacacctggagaagtgtcactgaagcccaagattggatgcttaacagtgttcattgttttgcagaacaggagaatgatgatgcatttctattccatcccctgtgccttgtatgtgggattaaagaaaaagtcagaaagttggatagaaaatgattatgctgtttgtttcatttaccacatgactgagctgtcatttgtctccctttgaaatgagaaaatcttaatcataattttctgtgatttaaatgtagtcagttctttaaaggtacctaaatgtgacacacttcaggaagatttacgcttgacttaggcactaagacaaagtgtcagagtaaatcactaaaaattgaagacatgatagtctgtgggatgtggcaaattagtgtcacagctacagagtgtataaccagggagacttcagaaagaaatgcaaggacagcctgatgcaggaaatgggctttttggaatttggtctgttgtcacctgatgccatgtggggatccaatagcagtgctgtgttactggcataattaatgttggaattcagaaaacttacagccttttggccatatttgaatatgttccttggtgtctgtggggagctgtagttccctagctactgccctttattaaacactttcctttgtcaggcactttgcttctgccctctagaggtttacaattgaaaactgtgtacagttgacccttgacacccaaaacttaacatgttaacagtcaattaacacatatttgatatgctatgtaatatatactcttattctacaacaaagtaagctagagaaaagaaaattttaagaaaatagtaaaagacaaaatatatttaatattcactaattggaagtgatcatcataaagggtcttcatccttgttgacttcatgttgattaatctgagggggaggaagaagaggagcagttggtgttgctgtctcaggggtaacagaggcagaaagggtagaggagaaaagagaggcaggcacgttcagtgcttaactttaattgaaaaaactccacgtgtaggtggaccctcacagttcaaactggcgctgttcaagcgtcaactgtacagggcaaagaaatgaggtaagaattacagtgaaaattccagatggttcttagtttttttctgacaccttctctaactcatatgaagcttatttgacttatttttgttattagcttaagtttaccaatgatacatttggcatctgaaggaaatggattggttcgttatccagacttgtatgttttatgtttatctctttaaaaaaaaaaaaagtcttccctgttgagttgtttttgaaatcattttactctgtatgggtttaaagcagttcttttaatttgtagataacttaaaaaataaataattctgtgttactcagacagctagcatggacacatttcatacatgtctttaaaaattcaaaattattagttattcagtggttacaaatggataaatacaaaggaagctatttgttcattttagttaactgtcaaaatatgtcatattttttgagagaacagtttttgcatcaggcgaagagaaagaagttggttttatatgtatataaccttattttttctctttgcctcttatttttcatgctaaaagttaaatatataacatatgtgtatatataaccaactattttctctttgcctcttatttttttaatgccaaaaagttaaaaaataagaaaaaataagattagagttcttctagtctaatttttttatgctaaaaggttaaatacagagacagagaaagaattttataaaaactgatgtctatgagcagaccttaaattaatgtggactctaattttccttactcagatgtttagatttagaagagtcatctccacactcaataaatgtatagatagatacatggtagtttgataatctgctttgtctctttgttttcagttagtgaatgaaagacttaaaattgattaaattaaaaaaaaatttgtcgttttcatctaaactcctccttcgggcctttgcgggcctccccttgggcagtgtgtgcctggaccatgcatttctcctgtctgtttcactgccggcaaacaccactcgtgtgtaagtcacgcatcacccacactgcagtccaccattccttagagcctctgggcttgagtgaattcttgccttttctcaagtacttctctaaacctggaattctttcctcacttcatgtggatctcttgtattttatccatttttcaaagcccatttcaaatcgcacctctccagggagccttttccagttgtctttcctctcctagaagtagtagctctagcagaaatttgcgtattcctctcatagggcatgtttactcctccttttagtaaagccatcagtatgtctttgagagcaggggctctgccttcacctcctgtgcacaccctcctggctctagccccagccatgcctaccatagatgttgtacacatgaagagtaaggatgggaacaaatttgtgaagaccaatggatgtgggggctgtctagtacttcttcttagctacaggtcacctctgtgtctagagtactgactgctctagtacttcttcttagctacaggtcacctctgtgtcagagcatcatcggaagtaaaccaggttagggccagtttgtgacaatcttatagatcgggcttgattcagcaggcagtggagagctgttatttttctataaaacctgttttttaatatggagcatcttcagtaaattttgtatgtaatgatgtacatgataaaagactgtttaagaacaattagtttggctgtgatacaaagaatgaagagagcagtgcacaggctgcttgcaggagttaagatgaggagagcagtgtaatatttgagatgcgctgccatttggagtagattgagagatttatgccttgctacatttaaaagcaaaaagagcctggcaaagggaaagccagaaaaagaaagtaggaataattaatattccaaagagcaaaaaatgagataagattgggaagcaacagagttcagattcaaaagtatgaaagtgtggtaaaatgtaagaatagaaatgtgtttgtttctttaaaagctgaaatttagctaaaaaggatagattcttaaattgaagaatcaagctaaatacttgagactagaaatgcctttgttgtgatgttgttatgtaatgtaatgtaatgtaatgactgtaaacattccttcttctctcctggttagtggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgtaagtttatattttttctcattaaaatacgatcactgaatgaaatatgttaatagaaaatgtctgatttttaagtgaattttttaataagtgctttcaaattactttcccagtggaaatatttatgtttgttgttgaaactgaatgattttacaaatcattgagcttcttaacaaacaatagaacagaaaagaatgtacatctttcattttaaaatgttgcttcaatttacaaagactgtcaaatttatagtattctttgccaaaatgctaggggaaacaatatagctaagtcctactttcttcttgtttcataatgtctcacagtatttcttttttcaaaataaaaaatcttctgtttattgttatgaattacagtaatttattagctcataataatctgctctacaatctttgtaatccaactgaagagtgatttgaatggccatgaacgaggtagtcttttaatatttgctttatttgcatagtggttatgtgtgtgtgtatatatatataatatatatatatatggtgttttaaataatttatgctacaggacactttaatatctgtcatttaattaggtactcactgttcataaagcacactctcaactcccagcataactcatttgccattaatttggcccttttgaatacgacagtacatttgtgaaatagtcagttctagaaagacctgctgtgggctgacatttctgaaacattaggaattactcattgttctggtgggaggttaaagtatgcaaagatgaaataagaaaactagaactgggctgggcacggtggctcccgcctgtaatcccagcactttgggtggccgaggtgggtggatcacctgaggttaggagttcgagaccagcctgaccaacgtggtgaaaccctgtctctactaaaaatacaaaaattagccaggcatcgtggcaggtgcctgtaatctcagctacttgggaggctgaggcaggagaatctcttgaactcaggaggcaaaggttgcagtgagctgagatcgtgccactccactccagtctgggtgacagtgcaagactctgtctcaaaaaaaaaaaaagaaaagaaaactagaactgttgttttgcctctcatgcccaaaaagttattatctattaattagctacatgaaaacttctatttaccaacctttgatttagagataaataagatagatgatcattcataaatgcacacattcaggagctgattggttctgtataggaagtaaataatgatgacagtagctttagcaatgagctgactaaaaatctggattttttttctattccttttagtttacatgtaataactgtacatatttatgaggtacacagtgatatttcaatacatgtatacagtttgtaaagatcaaatcagggaagttaaaatatccatcacctgaaatatttattacttctttatgttggaaacattcagaatcctctgttctatcttttgaacctgtgaaataaattattgtttactatattcaccctacagtgctatagaacactagaacttattccccctacctatatgtacttttgtaccaattaatgaaactttccctgtcctcctctctcgattttttttaattagagaagtattttatcttttagtgttcataaatatcataacaaagtctttctaaataatcagccactgtgtgcttgagggctcttaagaaacctgctgaagcatgagtctcagttaccataatgaatacgggatttgcgatatctctgtctgatattttttaatacatttcattttaatgcacattttaagttctcctagggtaaaatattaccattagccttaatccaccattaagttgctcttcaataatttgaatcctcagaagatgctttttcatagtaaattcaccaaaatagttggtcaaaggtgttttaactacaaaacctgtaacttaacttttacatcccaggaaaattgctaaattcatagaatacttaggaactccattcagtcctatagaatatggtagaggtatacatcttgaactacattttaaggaagaactggagaagaggttcagttgccttatattgtccatggctctgacacactgttttggttttctggggctgccataacaaagaatgatagactgaatggcttcaacaagagaaatttatttcctaacagttctagacactgagagtgtgagatgaaggtgtcggctgggttgagtctttatggaagccactctttctggtctgcagatgatcgtcttctccctgtgtcttcacatggtttttccttgtctgatgtgtgctcatctcctcttcctctaaggacaccagtcatatcagattatgacccactctaatgacctcattttaacttaattacatctttaaagaccctatctccaaatacagtcccattctgaggtactaggagttaggaccttaacctgtaaattttaggggacacagttcagtgcataatgcacacatatgctcttttcactggacagcccaaagggaatagtgccacttggttgggaggaagcagtgtgtgaaatgccgtgattcatattctagggagttaaatgttggcacagttccacttgcctccatcaaatgggaatatgtgggaaatgctacaatttgccactgtttctcatttagaaagacagtatcttgaaatttctcatttttcattttaaaggaaaaaaatctttcaggactaacctcccttctatgaaaaagaaagatggcaaagaccatgctggatcagaatggtgcccatgcagtgtagctttctatcttggagagagtattggggattaatctatggaaaaaacagttattcttatgacagtaatgtcagacggccagagctggttgcccaggtttctctaacaaccatgatttatttattaatctaaataatagttattaactcttttcaaccaataattttctttgagaatcagatagaaattactatctaccctccaattaggacattacagactcatacatctgtgaatctgaggaatggtaccttgttctaacacttctattcattcagccgtcctgacattcactcactaatcatatacccgtgactgccttctttcctggcatgtgatacagccagaactggtgttttcagcttcagccagctcttgataatgagtgatgcacacacagatcacagaattctcaaagtagaaggatttggggatctttaattctgcccttttctctttactaattgaaaaccttgcccgttgagacaggagaatttatctacctattgcatattagtcataattaaagaactagtgttcagtcttttgataatcatttgattattcttactatatttctatatctaggaaacatagtactttattttaagtgaacagtttttttccaattttaacatgtacccacctcctgatattctgaactttgtaaaaaaaatttattttcatctgtcatggatgacaagaattcaaatttttggttctggttgctgtgtgagttggcagctacttaacattggcatcttaatttttcatctgaaaaattgaaataaaaatatccactctgcttaccacacaaaaggtgattatgaagggcaaatgaactaatatatgtaaaaagtactttataaagataaaattgatttcatttatgaatttgcagcctcagtcatcttaccagattaaaaggtcttaatttcacaatcttccttctggatttaatggaaatcaaaagtgtttaaatcatgatataaagcaatagtctgtagtacttggtttaaatgtgtttttttctaccaaaaatattaacctcatttgcagtagtgtcatttgttccactattccaaagatggtataattttataaagtaaatgtctttatagttaaaccagtttaaagagttgcctatgaaaactatcaggagactaaatatgtcaacactgggctatgtcactcactaatatattttactgtctccctcttgtctctcacatccatgtagcttatttacatcagtgtcctttattgtctggtcccacgtaacctgtacagttcagtcaaccagttaaccttgatgcaagtctctgacccacctgaatgcatcttatttgtttgtttttgtttttgtttgagacagagtctcactctgtcgccaggctggagtgcagtggcatgatgtcagctcactgcaacctctgactccctggttcaagcgattttcctgcctcagtctcccgagtagctgggattacaggcacgcgccaccacgcccagctaatttttgtatgtttagtagagacagggtttcaccatgttggccaggatggtctcaatttcctgacctcgtgatccacctgcctcagcctcccaaagtgctgagattacaggcgtgagccaccgcgccgggcctgaatgtgtcttatctccgatgctcacacccctgcctctgtgcctttgctcaggctttctctgtgatactctatgttctcctacttgggactgtcatggcatgacataccttctatgtctgattttgggtttatcttctctgtcacatgttgtgaaactaatgactacctagactaaatcactaatgataggcagccacaatgatcttgtacttgatgtttgatttccatacataaaggattgtctcatatgttttctagttgtattcctatcttaccttcctcagctagtgtgtgagttcatcggggtaggaatcatgtcttctgcttttctcttggtcccaacagtacacagagcaatgtcaggatcacagtaagcctttgtaactggtgatggtgtgatgaatgggtgattgacagcatcagttgtcttcctgatgatattcctttcttgtgttgtgacagtaaagtgggagtcatgctttaatgcatattattttgaccatttttccctgtagggatcactttatccttagccacattcatgtacttgtctcagcccgttcacaaagccttctgttatcctctgcaagtctattgtctgactgggtccagagagtaaaaatttcctgcttttgaaaggaagcaaacattgtctgtttcatgtgataattaggaaacttctaaaaaatataaagtagaaacacagtttgtagcatggctgtctgtagggttaatgtgaaactggtgtttctgtaattgtgagaaatgattatattaatttagaaattctgcttagaagggctatgtttattttaatattaagtattagtcacttcataggttaattctgaatgtcatatacctacatactaagggttcagtaagtttattagatatgatttaatataaattataaactctatcctattgagggagtactttgaaaatacattgcaccaatccctaagcacgatttcctttcttatttattgcatactttatatgtcataatatgcgtacagaaacttccttcagtacatatagttgagaatggaagaatatcaattagtgtaagtagtaaaaatatcaataaaatcaatgattaaatatagtttggcaagaagactgcttaaaattaaagttacgtgatacaaatatttatgtttttaaaatagcacaaattgttaacttttatacattcatatatttatgtaaacttttagttataggttttaagtgtgctgtacttgtgtattaaaaacatataagaaaatggacaataaaaacctaaaatgaaaatggatcctaaatgtgtaataataaagatagcaataaaggctttttttctgggctatgtgttattccatagcaaggataatatcttattaatttttgtaattatcttccaatccctaggactgggactactgtgactaacatttggtagattactcagtaattctttgataagcaatgaaattaagaaaactctttggttttaaagataaaaaaacatgtttcatctggtcgacttataagtgaaatagaaatgatctatccttagcattgtgtaaaactatgttctaatgttgattaattaatacattctggttttaattataatttgatatttccccaaatagggatttcacatctgtctaagatcactgactattaaaattgcaatagtaatttataaaaactgcattgacagaaaattaactatatactgagggcttataatttgctgaatacttaaataccaatatttatacttaattaatacttaattaccaattagtattcagcaagttgtaagctcttagtatatagttaattttctagtctgtgttcttgtttttagatatatcactagacttttcttcctgtatgaagtcatatatatatatagtgtgcgtagctctagctgttttgaatcttgcatctacaattattaacgtataggtttaattcatagtatttttttttttttttttgagatggagtctcgctctgtcacccaggctggagtgcaatggcacgatctcggctcactgcaatctccgcctcgcaagttcaagtgattctcctgcctcagcctcccgagtagctaggattataggcatgcgccacccgcctggctaattttgtatttttagtagagatgtggtttctccatgttcgtcaggctggtctcgaactcctgacctcaggtgatccgcctgccttggcctcccaaagtgctgggattacaggcatgagccactgtgcccagccaattcataatatttttaaaggtgaaatcttttcagctttataatcatcattttcattttgctttagttcgttcttcttagtttatgtgttgtgtgcaaagtggcttcaagctgtgtgttcttctagccttggccaaacaccctgttaatatatgtcatgaaattacagtattggtttaatattaattgttaaaagttaatagaaaagttgcatctttaagatacaattatttttgatggtttacccccaagaaaatagatattcagaaacaatgaacatgctgtatatggttttaaatgcatctaacacattaacattcttataattttaggggtcgaactggaaaaattagagtgcagagtctgaagattggattaatgtctctctccaaaggtctcttggaagaaaaatacagatgtatgtaagacctttcttataccaacagtgtttttagtaataataatgattataacaatttattggaaacttaaattatataatttgttagtagtaatagttctctctctttttttaacccttactgtgcctataccaagttagacagagggtggcagtgcaaagacttggggctttgtgtgaaatggaaagctgattataactaagaggtgaggtgccaggatggagtgagacccaactacaaattatacttcatttaattcttagaataatccctccataatgtaggcatttgagattttcattttctagctgagaaaattaatgctgagataggttaagaatctagtctaagactgcagagctgataagggatggggctagaattagatactaggtttttctgactccaaagcctaaacttttttttatttctttatacttccaatgcttaaaagaaaaagatgaactagaacctttacagtcatagacgataatcctaaataaatatattttacagctgtgacaaaataaaacatgatttttaaatttttattatatttggatttatcaaataaatcaacagtgttcctttacctgtcagttaatgaaaggtatattggctttggaaaagacttgtgttcaggagccaaggagacctgtcttcaaatctctaccacttagtagctgagtgtctttgggcaggttatgtgatttcattgaatattgccaactaagaggtaatagtattccaattttacagttcaagaagctgaaatttagcaaattttcttcaactgaaaaaatgaagctaataattcctgcttggagaataattaggagtaatgtttaaggtacctagaaatagcagttgttgaataaatggtagcagttgctgctgagtccccaaacccttaactactatcacatatcttttgatttatttttgtccataaaatgtgaatttgatcccaccatgcatattcccagatgattctttacagataaatccatacatttgtgggagaggtttagggatattccatgaatggagagatactaaaaaacaataggatgtttgattataggccctgtaaactgagttaagttttgtgtcttatgtcaacatgcatacattttaaaagcttttattttctgggatttctgtgaggttattggattttgaatttcaggtctagaccatgatggcttgttttttctacatagtttgacaagaatgtcagtgaaaagaaatgtggatttatataaaatgaaaagctgattgtaggattaggagataaggtgctatgacggagtgagagcctagttagccatgcagaagaaagctttgcccaagacttttgctttgtggcactttatccagaattgaagtagtttttggaatcataatcatgaaaagatataatttcaacagctgaaaacgttatctttttataatgatcaggaaaggaaaatgttaatgaaaacaccaatgttacaaaattagaaatggattttttatcatctctgatttggggtttcttgtgcttctgaaacaattagggttctctgaaagtaacagttatagtgtggagcttactctgaaatatttgcaaattcaacctcaaagcttacattgtggataattcaacattaactttcagattttggcaggggaagcagaaggctctgccgtgaaatttctgatatttaattgaatccaggaagtatgccattttagaactaattaaatatgaaatctcttgggttttaatctttaatctaaatctttactgggatatctagactttggaatgtcctggggttttattttgctttttactttgaggaccttcaccactctgattccagtttctgtgatatcattattgtttcctttattagaattaatattcaagacagtttgctcttcaaatgcaatggcagggccgccattcaagatcattggtatctgtctgaacattgattttattaatacaatgcccaatgtcagtgtcttcaccccataacaccttcttctcttggtcctttcctaagaatattccttgtttagtttctaacagtgccctggcctttatgcttatagctggctagcttccttgcctcatcaaaaacacatttacagaccaggcacagtggttcatgcctgtagtcctagctacttgggagactaaggtgggaggatcacttgagccccaggaatcggaggctgcaatgagccatggtcggaccaccacacttccagcctggatgacaaagcgagaccttaaaaaaaaaaaaaaagtacacattttcaaaccatccttttaaattatcattagtatctcttctgtgcttatttattagaatttgagtttttagattatgactttcttattacctgcccctttaccctgacactgctttttgtatcttactataatgttgagaatgtgaacttttgtaggaacttttataaggatttatagaaatatgtcaaaatgtctaaggacacttttgtccttatgttttgtgagtagttttactttaatagtggcatagtggtatagccatatgcctcaaaagaggaaagttgggcatagttgatcttgctgaaaatgtgcacttttctgcaaagattattatacatatgcatcaacttttatttacttaacagacctcttcccagggactggtttaaaataaacatcatgctaagactactggataaatatttttgtctatgatagtcttattgtttttaatggaaagaaataagtagagctctaaccaaatctaagtgaaaaaattataataaaaatcaaatttatcttcattgaatttgctttccctatgtatgcttataattaaagccatacttcattataattactgtgtcaatatcactgagcttggttcagtttgaaatttcaccactgacagtgttagatctagcattatattccttataaaaagagagaatggaccaggcacggtggctcacacctgtaatccccagcactttgggaggccgatgtagggcagatcaactgtgatcgggagttcgagactagcctgaccaacatggagaaaccctgtctctactaaaaatacaaaattagctgggtgtggtggtgcatgcctgtaatcccagctactcaggaggctgaggcaggagaattgcttgaacccggtaggtggaggttgcagcgagccaagatcgtgccattgcactccagcctgggcaacaagagcaacactccatctcaaaaaaaaaaagagagagagaaaatgatgcattttgatctgatatcaggtactgtttgaaaatagttttagaatccaataaatatttactccactttcttctattcttggaaaatgtcacatgaagagcatttagattttaagtacttttgaatttttagaacttgaaaatttatttccaaaaagtattaatttctataatgaagtagattgtttgtatttgaaatttcttcctcttccaaaagtaacttatcttaggatattagctttattgttgaaaataatatataattttgatcttcaaagtattgtatatggtgaataaaaggtaaaccaagagtggacaaaatagaagagttttaattttactgaattaagaaaattataaaacaaatcagttttttaatgaatggaaaaacctaaaaactgtatgaaaatatgcacaaatttttaaatttgattaaatgtatttcattacatgaagtaaaacaaaaatagtggttatagctaataaggaatgggagactggcccaaaggagaaaaaacacaccttcttgtactttttagtgtttcttatataaaatagatgtgagtataaaagtctttaaaataagttataatatatatacatttagtagaatattgaatttaggagtgaacacacaaagtttgtaaacaaatctgttaaaatttaaaggtttgttatttaaggtacgtttattcctttgtgtttttttatttttttttgagttggggtcttgctatgttgcccaaactggtctcaaactcctggctcaagtgatcctcctgccttagtctctccagtagatgagattacaggcatgcaccacagcacccaactacatctattcctttgacaagtcatgaaggaagctttgttttggctcattctttctcaataagaaggggagttcttatgaagatcataaaattaattcatatgcatttattgtatcattttaaaaaggaaatttgcatttattgatttatattatatatgcatgatttatgtttatatgtatacataacccattcttgcaggaacgggttaactacatgcttcttaaaataatctaatatcatatgtaatgcagaatattaagatcagaatattaaggtcattggaattcaggagacaacgaatcagattcatgtccttctgaaatttttttaatctgcatggttcagtccacattaccaaagatatattttaagtaaaagaacatggtagacagatgaaagttaacctcttgcctctctttgcagatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacaggtaagcatgaaggatcactggtgtgtaggatgtgttggcgaagggttttgaggatgttctgagacatggaatagggaactcgggctggagccaaatactggaagactttgggtaccatccaacaagtggtgtattttatttcctaaggctcatttgcttcaaaaaatagcaacccttgcaaagagacttgctgtttttctttgataaaatctacaatctttaacctgtgccattagattgctgtttgtcctgcccttttcctggcctcatctcctaccattcctctccttgctctccgctttccagctgcactgttttatttccttgattcctgcctcagcagtgcctttggacctgtgtctgctgtttagacgttcttccttccccattgcccactacctcccttctcatacctaatctttatttgatctttagattttagctttagctattacatcctctgaaaatctttctctgacctcttcagataatgctgtattttcctattatattcacctaatatcgtccacctcttccttctcatactcagtgcaattataattacacactgaattatataattcatggcttagtgtttgtttcttctctaggaacctaagctccatgaagacaaggactacggctatcattttactgttgtatcctgtcttagttcattcaggctgctgtaacaaaataccataaactggatggcttttaaacaacagaaatttattttctacagttctggaggctgtccatgatcaaggtgctagcagattcagtatctgctgagggcccaccttctggttcattgcaacctttcttgctgtttcctcatatgacagaagaagtgaatgatctctcttgggcctctttttttgtttgtttgttttgtactttaagttctggggtacatgtgcagaacgtgcaggtttgttacataggtatacatgtgccatggtggtttgctgcacccatcaacccatcatctacattaggtgtttcccctaatgctatccctcccctagtcccccacccactgacaggccccagtgtgtgatgttcccctccctgtgtccatgtgttctcattgttcaactctcacttatgagtgagaacatgtggtgtttggttttctattcttgtgttagtttgctgagaatgatggtttccagcttcatccatttccctgcaagggacatggactcatccttttttatggctacatagtattccatggtgtatttgtgccacattttgtttatccagtgtatcattgatgggcatttgggttggttccaactctttgctattgtgaatagtgcctcagtaaacatacgtgcgcatgtgtctttatagtagaatgatttataatcctttgggtatatacctagtaatgggatttctgggtcaaatggtatttctggttctatatccttgaggaattgccacgctgtcttccacaatggctgaactaatttacactcccaccaacagtgtaaaagcattcctatttctccacatcctctccagcatctggtgtttcctgactttttaatgatcaccattctaactggtgtgagatggtatctcattgtggttttgatttgcatttctctaatgaccagtgatgatgagctttttttctatgtttgttggctgcataaatgtcttcttttgtgaagtgtctgttcatatcctttgcccactttttgatggggttgtttatttttttcttgtaaatttgtttaagttctctgtagattctggatattagccctttgtcagatggatagattgcaaaaattttctcccattttgtaggttgcctgttcactctgatgataggtgttttttgttgttgttttgtttttgtttgttttttgtttgtttgtttgctgtgcagaagctctttagtttaattagatcccatttgtcaattttgccttttgttgccattgcttttggtgttttagtcatgaagtctttgcccatgactatgtcctgaatggtattgcctaggttttcatctaggatttttatggttttaggtcttacatttaagtctttaatccatcttgagttaatttttgtgtgaggtgtaaggaaggggttaagtttcagttttctgcatatggctagccagttttcccaacaccatttattaaatagggaattctttacccattgcgtgtttttgtcaggtttgtcaaagatcagatggttgtagatgtgtggcattatttctgagatcttgggcctcttttataagggcactaacctcattcaagagggctccaccctcatgacctaatcatttcctaaaggctctacctcctcgtaccatctcctaagtggttaggtttttaacatatgagttttgggggacaaaaatattcagattattacatttcctgtgccttgaacatcataactactttaataaatatctgctaaagaactgaattaaaatgtcctgagttctttttaagacaagatttttaaaatatatatacattaaagatgttattaaagtatcagttttttttctttgagactatgcatacaaaagaaagatgtacgaagttttatactgatctaagttactaatttgaaactgagaaagcactttcatttctttttaatgtttactgcatataaagacattttagaaatgttactactgatgttatacatatgcataaagtacaagtctacagatattttggcaaagcatatccagtgatttatcattgctagggaaaaaaaaggctcacaccgtgtctttgaggagaattgatgtcatgggttattacattttataatggccctttttcttattttagaaatacaaaaaatatcaaatgcaaattctaaatatgatttatagtcatacatgtaggttcacagaatgacctcaacagcaacaggaggataaaattggtagatatttagctttgcacataggaaaattacttagtattgggaattgaagagggattggggagttttatgtaatttatcctgataaattctgcaaagtacatccatagcaatatgctttctgtgtgatgatataatgggactagagcaggacacacaaaaatgacagcttttatttagcatttataatggccttcaagtttgtaaaattatcggtgagtctttcacaagtttttactgtcttagatgaaatttttttttttttttttgagatatattcttgctctgttgcccaggctggagtgcagtggcgtgatctcggctcactgcaacctccgcctcccaggttcaagcgattctcctgcctcagcctcccgagtagctgggactacaggtgcacgccacaaggcccagctaattttgtgtgtgtgtgttttagtagagacggggtttcaccgtgttgcctaggctggtctcaaactcctgagctcaggcaatccgcttgcctcggcctcccaaagtgctaggattacaggcttgagccaccacacccggccaaatgagttttacagaattatttatgtaaaaagatgactttaaattgagtggtttgggtttttgcttttgtttctttcaaaatctgagtatattgaagtcttggtatttttttgcttcttcctatgtgacaatttctgctttttctactcataagttctagaattttcttgacttgaagaaccttaaagcattgtgacttaactgacatggaaagagttatatagtttcctcttctgcacaaattttcagaagattatgaagcaacaacactagctacagtttaaatgaaggcatttcttcacttttaatatatttcttttttcaccagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtaaggcgtgccagtgctggaggaggctattttctgtttcctttgtgtaatctcagtggtacgtccatcctccattcccattcattcccatttggaggtttgctttctaaataaatggtatgttcagtatgtctcatctatctaaaagtagcatttctttttataactactacatgaagcatattttattattgttgctattattattgtcatttacactacttggatcagaaccagagatttttatgaatgtctgtttacttaggtcacagaaatgattcatccatgaaaactgtatggctgattataaatatataaccctgatggaatttggtaaatattctgaggtcttggggtcaaacttagtaagcaggaagcaatgtttaattaccagctgagaagtaatcaaattactttgtgttatttctgccaagtttgatgtgaagtacattaacccgacttcttcccatgaggagcactgctaaatgccatactttaatgtaatcagtgtgtcagactcttcagtttgtgaccccaaagccgacagtgcagagtctgtggtttgtcctaaggtggacatttttggacatcctgatccactcctcttaacataggtatgcatttgacctcttgaatatattatatttctctactggggggaatctggaaaatagccccagtttaatttggaaatctattatgaaacaacataagcctactcagtagggaaattcaagattttgtgtgtgtctttttttatttattttttgagaccaagtcccactctgtcacccaagctggtgtgcagtggcacgatcttggttcacttcaacctctgcctcccaagttcacgcgattcccctgcctcggcctcccgagtagctgggactacaggtgcatgccaccacacccagctaatttttgtatttttagtagagactgggttccactatgttggccaggctggtctcaaactcccgaccatgtgatctgtcctccttggcctcccaaagtgctgggattacaggcgtgagccgccatacctggccctatgtgtatcttttattcgtaccagaagatcaagtaccaatacggtgattctctgagggagagtcaaatcaggagggctgggattggttgttgttgtatattgtatcagtattagtatcttgaattaaacagaattgttttcatttgactgactttatcagcataatagtttgtacgaagcatatcattgcattctctgtggatggctaacataagaaatgaaaattcaaaagttctcttctctcatgcattatggtgtagttgggaagactaaagtattgtgaggtcagagggccttgctgctatgcattctaagaggaggaaaagacaggtaggtagtgtgaagtagagtgagcattagcctggcagacagctagggtaatagatgacttccagtggaagtcaaagcacaaatgttggaagaagaagaatggtaaagtcacagtttaaatgcagcagggttcttggaatggctacatttggagtatctggtagacatagatgtatgggagagggaatagctggaatgtggcaaggtcagtctactactgggaagataattcaaatgagagatgtagtcatcaaagctaataatcactgctatttattgtttactttatgccagacaatgtgctaagaggtgttatatttgttattttagtcacttttcttaataactctgtaagattgggagtattacctctactttacacataaaggaactaagactccaagattagtcaacttgcccaaggccaggcagccgattgtgcagagacaaagttaggattcaaatccagaaccctttggttttccagtttgtgttcttaatcaagatggttttaaaaagcagattagatttttaggagagagagatttaatattaagaagtaattaaatggtattgaaaagagcaattgatttaaagcactaattattagaccaaaaatattactctggatataaacggtaatgtgaagccatgggaaagatccagattaattgacttgggaagagactgccatatatagatatatataaaatctgccatatatggccattggtataacctagagatgccatgagggaccatgtttctcagcatctgatggatgtagagagtgaaggagaggataaaatactctaaaaacattaaatatttgaatgacctttaaagtttcatttcttaaattaaaaatgacctgaagcaactatgtagaatattaagatttaactgagttgtgggacatggatgtttattatattctccctacttttgaattaacttgaaatatttaataagaaaaatatgaaagagcaattataaagggtgaacaacctgaagtgttaaatttcaagggtttaagtttctgctagtactatcaaattgacctgtaaatgtctctatgatagagatgtgaagttgaccagcaggtcagagattaaggttatgggaggatattcaggagatagtgtattgagaagtagctctggagtcaggctacttggatttcaatcctggatctattgtttggtgctgagactttgaataagatacttggcctgcttgaacctgagtttcttcaacttcaaattctatgagtgtttcctcataggaatagttaatacatgaaagtatctagggcagttcctatcacagagtaggcattcagtaaatgttggctctttttgttactaccaataacatcattagtgtgatagtagctaaacctatgagtgtgttgttgaacatttccattaagtggaaatgccagaaaaacctggacaatgatgttgctcagtaaaaggcaagattagagagaggtataataagggacagaacaggattcttcagagaaataaagacgcatagtgtgctttagcaagatggtagaggtgttaagtgcatcagaaagattctttgaatcagaagtcattgggaatcttagagaggattctatccgtgtcgttataaagatggctcaggaaaatacataggcgaatatgtgcaaacaacttgtttaagaaatctagctataacttaaaatatgtcaggatattgaaaattggaagatggtaagtgatatattgtcttacttttacttgcatttatatttttcctgttttctacattgagaatatagtacatctaaaatttgtatttcgaatgagagagaaatatgtccagacttgatacctggtttaggcacaagagtgagcaagcaaaggtttcttcaagctaatggtgacttaattattgcacaaagattacacatgaagggaatgaatataagaacaattccaatagtaaaatggggtccagttggaataggtctgattagtttagttgtaaagagatgcatctttctctgtggcttcagagaatgaatggaaagacaagtacagaaataaagatagaggaatatgtctattatagaataatcttaacttcattcagactgtctttctatcaagcttctacccaagatatatatatatatatttcattttccccgaacttttataaatactgctagagtttttcactaattacttccaaataaaatgttaatgaaatcttagatttacataatgttttgtaagctgggaattgtttcagttagaatcatacacaattccttaatagtagttgcataaataaattagaactttagttttctttcttgtaaacagagtgaaggtaggtaatccaagactgttctctgtgaccacctgggcccttagctctgttttcatgcactgtcatccctaacatgtggcttccatcttcaaagtcacttcatgctaacaaagtgactcttctggatgtcagatccattttccagtggggaggaagaggcagcatgcctcttcccagctaactcagtcccttgaaattccaattagaacccccacccaataactttggtttttattgcactggtcaccaacatcagcaagagaggctaagaaacagtaattttctcaaggctcattgctaaaatgtgctaacagtacaagggtatgttaccaatgaaaaagagagaatggctatctgccaagggagtattcagcagaaaacaaaatttcatttagaaagaagatgtcagtcatacctgtcaagccatgctgataagccaagagatgtcgttagtgtatgtgattgtttcaaaccaatagcctccttggcaaaagtaagctggctgtagtatatgcagaatgatttccttaagattgatttgcaagtgatttttcaggtcattttagaagctactcagtacttagtagtttacagccacacaacttttaaattttgcttccattttcattctgttggttctatcatttaattttttttctgtagatgtgggtataatttatgttcttagttctaccagcaattctgacagaacagatttcggagaagatgttttccactcagacccatagaaacttatcgtctaaggttttgcttttgtaaataagattctgcaagtacaagtcaatgtgcagtgtcattcttacgccagagattttaaaacaccatttccattcaaggatgcattgtgatcaaggctttatttagtttttcctttgttacacagtatttcttgatttcttttttttctagtgactaatttaaaccaaatataaaagtgctcattgttgaaaactgtatctttgtgagggaattttaaaattcatttcttattggtggtataattgatattttaaaatttgatgtttcaacttaatagatataattcttttcttgcctatcattttccattcgtattcaaacattaaaagaaatcttctgacatgcatatttgtctccctctcatgtataaacagatagaagcatgtttcagagacttgaactccaaaattttatattttattttttggtaattcggatgaatgaaatttcttaccacaaatttagactaaatgatagtaatgcaagccaataaattttcttttgttttctctaggtatagaagccttaagcattttaactatgatgtctgccagagttgtttcttttcgggtcgaacagcaaaaggtcacaaattacattacccaatggtggaatattgtatacctgtgagtactaacccactgttttgtttttaatacattgccattgaattaactagtatctaaaattttattatttatttagacttaatcttttttgaaaaaatatcactttgaagattttttttttcttttaagtaaactcatttatgttgaattaattagtgcagaaaaaaatattaacttttttaaatatctgtgttttgattttaaacttttttggtagcaaattcttttaagagctgatactgacctacactgaaaatgatactatgtaacgaaaaatcatgtttcttttagacatatttatgctttcatagttaaataccatattcatattagcaaaatacagaaaatggagatattaaaaatatagttcctaactctagctcctgaataaactaccttctaatttttccatatctctggttttaagattctatttatatttatatttatgtatctttttccctgatatttttcactcgacattccatttcgtcacacagtgtaattttttttagtcacaaaatttttaattgagtgaattactacagtttacctaaccattccctgaaatttggacatatagtttattttcaattttctgatgttataaataacactcttacaagtatctttgtgagggtagctcattccagatattatgtaaactacattgcaatagaataaagcactataagtaggttatttcagtcaatgaatatgggtattttttatggtcaaaatacttgatgtcaacgtttttttcaaaataggtttatcccaatttacattattatcacactttgttaaagtttcaattttactaagccccaccagtattggacataagttcttgtttttcctttgatttacagctattttttcctgaagttatcctcatgttctattaatagctattcttttacttccttccaaataatgcccaaatgtattcatcaagctgtctattttctttggtttagggaattgagttacttttttggatcataaattgacagaaaggctgtaatacttataaaatatacacatataaatctcacactcataggtatcttatctcaaataaataagtgccctgtgtatggagaggaaatctgtagaaaatattgctgaattataatggaggaagtgcccacatcacattatagctttaaccaggaaaaagaaatctccccaagaaaatttgtgagacatcatttattactattatcaacttattcactcaacaaattaatattgaacattttgcaggtgtcaggccctcttgtcaaagataagcaaaaccagacactagttaaagtggtaaggacagattttaatcaataatatactgattatgcacatgtatttctgtttgtacagaggtgactgggtgttttcagaagggaatagactggggaaacaaaagagggacttgagcagaggcaaggaagtgaaaaatgacaaagcattggtcagcatcagttccatcagaccagctgtgtctgtgagctggcaattgtcagagttaggattctaccattccagagagagactgggagacaggggtcctatccttcctgatgattacatttcaaagaaatggttttcagatccttgagaaagacactcctgagttgttggagatacatccacatctcaaagggacagaggaaggattccccattgtaaaccctttccagtaaatgccctaagaaagagtgagcagggacctgtcttcaggtgttggctagagtgaacagtaaattcttttggcagtctggagtttgtttttcaggcagacgctttaaggggtcagacgccttaataatcccttttttaagggtcatcctagggatgtggtcttgaactgttataaattatgttcatgtttgtttaagtcttttaatggagaagtgggtggacagggatggacaaaatgatttgtgctgaaaatttgcagcttttataggccaaggcttcagtagacaacagagcttacaggaggccaactcaaatttggtcaaggagagaatccttgtcagtaatttcagctctgatagtgtatcagagtatacccagaaagataagattgtggacttcctgctactctccctttaggaggaagaatgtgtgagaatgaacaaggaaacgaataaatggggttgttatacattgcagtaagtgcctttaaggaaatgaatggataatgagatagaatgattagaagagacattttagataaagaaatcagtaaggtttgtctgagttgacatttgagttgagaccaaagtttgagaaagattcagccctgtaaagaactagtagaagcatgtttcagaaagaagaaacagaacatatagtggtctgagttgggaaaaaggttagcgtgattgggctgcagaaagtgaagcctgttccccaaggggcgcatggaaaggagcactggttacacaactggaagtgcccagtgcaaaatgaaactggggggccccttgtttaacaattattaagacttccgagttggcaacatcagaggagtaaatgaagttcaaagcccttctgattgtagggccctgtacaactgcataagtgcaatagttcaaagcccttctgattgtagggccctgtacaactgcataagtgcaatatctttgaagctcaccctgaggctgggaaagaggtgggtgtaaccagggaacagaaagaaaccaggacaaatttgacaaaagagagacaatagtaggagatggaattaaaaagaaaggcaactatcagattgtatagaaccctggggatcattgtaaggaatttggattgggggaaaatatcatagtaatatttacatgaatagctattatagaagtttagaaaactgattataaaatgctagtatcaaaatatcataaagtaaatatatgttgttatagtaaagatatataaaattactatttttcttggtcttgaacatataataattcttaatggctttacaaaatacctaaacaatttgaaacccacatatcttcaacagttgtcatgcagtaggtgcatacttaagaatcactgatacacatatgaattccactctccaactaccaattttaaatgaaatctgtaagttacccaaaactgttcttgttgcatagtctttcaaaagtcactgtttatcatttccaagattgcagcttatcctgcattatacaaggatagcttcatttttcaagacatcctttgcccatttctgaggctttgtagtgatcttatcaacagcctacttataaatcatctgtatgacaggtcactttctgcatttgaccctacaactttttgtaaaataactagaaatatatgtaaattgaatctttaaaaagatacttgcatttaatagcaatgaatgatctgattgctattattgtagcattaatgtctttccattcattctctgaagccacagagaaagatgcatctctttacaactaaactaatcagacctattccaactggaccccattttactattggaattgttcttatattcattcccttcatgtgtaatctttgtgcaataattaagtcaccattagcttgaagaaacctttgcttgctcactcttgtgcctaaaccaggtatcaagtctggacatatttctctctcattcgaaatacaaattttagatgtactatattctcaatgtagaaaacaggaaaaatataaatgcaagtattcagaaatcattgctttctgaaatttctttctgttcacccacattctttacatttgctctactcttttaagttttatttatggttcatccatcttttactcaacatttcctaaagtcgtttcatgtctgccttagaaaatgaactcaagtgtgaatttgtttggtacagtgataataagcaacacttgagtgttaaatggatcagaccttcccatatggaccttgatgtttgcattcctcagactgcatctccctttttagttaagaagatgctccagtcaccttactgacttcatctctttccttttcaaagtcctttacagctgactctgaatgtttctatttttaagagctttctgcaatttagaaaccttattttaaatccacaaagcaccctaaatattttgccaatatatctgcttatgatttatggtaatgttttcctttagctgtaagaagactaatggtatatgaatgaactatcatgactcatgaaagtattttatgatattgataatttatatatgtatatataaattatctgaagaaatgtagcagaatttttatttctctaggaaatgattttttgtcttatttccccctactattctataatccaaatttgtacatttaagaattctttcattaggcttaataagagttgatcttcaagagacagcatgacacagatgatatttaatgcctgtcatcattctgtctccatatgtccaaatcccaccttctcacaaaaacagctcaactcccactttgtgtgtgaaatctctcccagctcctccagttttaccctcatcaaagcacttagttcaggggcctctgccaatagcctctactttaccaattaggatttgattctatgttcccttgtatcattttctaactgtggtgtttttgtcttctcaattatctttttacctccttgaggactgggatgacttttatacttttctccctgtgttagttaaatttgcctcataaaagccagatgagctcgtatctgactttataaatactagttatagaatattaaagctggaattaaagctctaagagatcatctaacttatctttattttgaagaaaaaactaagtcttagagaaggtaagtgatttgtgcaaagttaatggtatggatttagtgacttaactccattagggaaatacacacacacacacgcagttagcacattggaaaataggggtttgtgtatatccttgctggaatattatgtttgttgaatacccttttacataccaggcattttgctaggagttggaaatagagagaaaatttcatgaaggagaaaaaatacctctatgtggagaaattcaacaagactgtaatattttttagaatgattaagcttatgaatcaagagagtagtcaatttttttttgtattatccatgcattaaacctttgaattcagggattatcattttttaaataaatagttatatcttatattaaagatgttcagatttaaatttcttttttatttatgatgatttaatttcatcgtgaaaattaccctactcagatcttctttaaaatcatctttgttgtaagtaaccaaaatttaattcaaattagaaacattttcatatgttgttagagcatataaaagatagtgtgtggttttgttttttgagatgagatctagtctgttagtgaatttcaagtgtattatctgtagccacaagctgtacattaggtctccagaatttattcatcatataactgaaagtttataccctttgaccagtctcttctcttttcctccaccccccagcccctggtaactaccattctactctgtgctactatgagcttgacttttttttttaaaggtcccacatataagtgagatcatgcagtatttgtctttctgtatctgggttatttcacttagtataatgtcctccaggctcatctaagttattgcaaatgacagaattcccttctttttttatgactggatatatttcactgtgttttctttatccatttttctgttgtaggatacttagtttgattccatatcttggctattgtgaataatgctacagtgcacataggagtataaataccttttggagataatgattttattttctttggatatgtacccagaagtgggattactggatgatatgatagttctatttttaattttttaaagaacctttagattgtttttcataatgactgaaccaaagatagttctttaagttggagagttcttctttaaatttcacatgatttataaaagttcatacaattgctgacagtgagagagaagtggatagggttaaatactaaggataatggaaaatgtttagaatagctactagggtcaatcttgagtcacacagagatgagtaaactgattgctaccttgccactagagtgcagctgaggttaattgacaaggatttgtagtttgtgactccatcattgctcagcagctttggaattaaaagatgaaaagtatatttgaaggccaagggagtgaaaaattccaaggtgttaatgatactgtggttgatttgaggtatcctcatgctgaagaaatcccaaggtgggataaagggctagacgtcaagatgatggggaaagaagaggtttatttataatataagaagtgagaagaagagtcagaagattccagtcagtgaaagattttttcaagttagagattttggactaaaagtggttttaagttatgatgaggcctggggtatggccataccccaatgtgtgactgaagtgggacatagaaggttctagaaatgagatggcttttagaaggtcatcactgcatttctagaagtgaagtgacagatgatagccctgtctggcgttgtgccatcaaaggagaggggaagggcacattggctttagtagatgaagctaaggggaaaagggtgtgtaggagaggaaaaaaatatcttcttcccatcttagtttcatagttgaggctcctgtaacaaaagacagattaacaagagaaaagcatacgaattgatttaatataaattttacattatatggaagccttcatcaggaagagaagacccaaagaaacggaagcctgtgtatttttatgcttaggtttgatgaagagtggacagttgcgtagaagtatgattgaataagaagatacgacctaatgctaatgaactaggcgaacttagcaaggcctgtttgttcagattcttttctgtgtccttctgttttcagtgataaggatgtttcttccctccaggaataaggagggcacctctcaaataagggtcttatgaccctttagggaagaaggatgggagaaggtcagagagatcttgctacgtctgctgttttctcaactgccaatgtgccatatttggaggtagtgtgtcctgaacccttgccaagtgtaaacatccttttctcttggttgttatgaaaaagagattatacagccacaaatgaaaaagatgttataggaaatggcattatcatgggagcttcgggattgattcaaggagataggttgaaatactaattatgaacaaaatgtaaggtaatgtgtaaaagaacacagaatccactgtaatggagaaagaaaggtagatagataggctgtatgcatatagtgaggtacagtaaccccatccatggagagaaaatgtgaaatagagcaaggtaatggaggaaatagtaaaaggaaagaaggaggaaataagcaaggaaaggttagccaggatagaaaggtagtttgagagacatgttagctgagggagaagagacaggatatttgcaaaattttgtagcttgaaaggtcaacagcatcagctacttccagcatttcaattgcaagggtagattcattgtcaatgtcatagtttagttgctgagctttacataggactagtttgtactggtaactttgatgagtttagtgagaagaggcaacaacaggaaaaaaatacctcaatgagaaacagcttattaaattaataccactcaaaacagatttatattgcaggttttaagcaaatacagttgttttaaaagcaagaggttcaactgtattcttgttgatattgattaatatgtagggaaataaaccaaaattacatgttttccatgagaagaatcatattttcagtgagaagaattacaattttctagtaaaaaatatcgaatttctgttttaaaagataaattgtgccttttttttatgaactatatgccattggcaaaaataaaacacacacacacacaaaacacccgaaaagaacaaagaaaaaaatctagaagcagttgttttgatcaatcctttccacccctgccagcatcaatgtacttcgtaagactataaaaatcaaatattttaaaaatgctgattcattctttggaaagctctaccttgagttagggtagtttgttttttggcagtcttgtctcttcagatgtgatgtggggtgtttgccaatatactgaaaacgcagcatcacggctgtttctctgacctcagcatcctgaagtggtgtttcagctcctgctctccttacatcgttttaccagtaggtccagtgcatttagatttgtcattagcttttaaggtgaggtttgggcaaaatccattttattttggatgacttatcatcccactgattcttgactccttggtaattctgctaatgctaatttttttagcttcatatattttcattagggcttgaaagtctctgagcttttcttactgattgcatcctatccatggcattcaaatgtgtctgaatttcaacttgttgaaatcattgaaacttaaataaaaactgagaggttgttttatagttaaaaaaaaaaaacctgttaagaatatctttaaaataagtcttgtgataatgaaatgtaccgcttagcagtatgcatgtaccagttgggactactggtttctatatttaagaagtaactcttgctaatgagggtgctgttcaacaatgattttagcacttgtgcatgatccaaatgataatgtttaattattctgtttgcgtgccaagtgactttttttatataaccttgatttgcctctttgtaagcctttgttttcctctgtatgtaacttattcatatttgtaattaacaatttaaatccactgtttggagcattaaggaattagttaatactgatatctcaagttaagaagtgactccccaaaaaaaagttgtggggagaattaaaacaaatattttctgttttgttttgtttctttatttgtggttctttatcttgttttgtttaaattgtttggtaattagaagttatttacgggatttaggttatttggtagcattgtaaatagcttcctttcatgtgttgctttgccggtctttggggataataataagagtcctttgagctgacctagtaaagccgtttattcaaggatcacttgattatgaatactgggggaagggggttagcttttctacattctagattcttctataccttatccttgctgcttcttgtgatacatattagtgaaaagggaactttcagccatgtattaatgcttttgaagttcagtagtgcatagatttcagcataaagtaagattatacagtttgcaatatgaacagggacatatagaaggatacacatgcattcatatagagatatacaaactcaagcaaaagatagagtaactctaaattatgttccatgtgatgtatctatatttgttctctgtcaaggataaaatggaagaaaattgaaaatttcctaactgtattttggttggtaaaatacaatctcaaaagtaaaaaattatttgatttcgccttaaaagtgattttgtttagggtttttctttagggttttgctacagatagatgtatcacagggtacattttataattcagtgatactttccatattttatttattcatttatattagttggtggggaacaagtaaaaaattgattaattcttattatacaggtaagttttcattgttttacggctacttaatagcagtacagtggagtaaagcacattttcagaattcacatgcccacttatctgtgtaggttcagttctaaaatgtttttcacagtgagtcactgtcattagctttccaaaaatgacaatttcaaggacagccctaatttgtacatgtgaatttttatgtgcttgttgaaaatcagtccagaggcatctggggaagatggtggtagcatggcatcagagtttttttgttgttgttgttttatttttttatttttatttttatttatttatttatttatttttttgaaatggagtttcgctcttgttgtccaagctggaagcaatggcgcaatcttggctcactgcaacctctgcctcccgggttcaagtgattctcctgccttagcctcctgagtagctgggattccaggcatgtgccaccacgcccagctaatttttgcatttttagtagagacggggtttcaccttgttagccaggatgatctcgatctcctgacctcgtgatccgcccgcctcggcctccccaaagtgctgggattacaggcatgggccaccacacctggcccagagtttttccatgtcttttgcctttgccattttccttccattggtaaagcagttacatttataaagagacatttgtaaagagaataactagacagcaaaactaaaacgtacaatgtttgcaaccaaactagatgacaagagagatccaaaataaatccaggtggcgataagccaccaccagccacaaaacgtacaagacatcactgcctgtatgagaggaaagacaaggaagtgagggtgcctaagaaccagatagcccccaaaataggcaacagatatttaatggaaagctggcttgagagcagagctaaacctggaagggttttgccatgcgcagaggctagggtaaaaaaggtgtgacatttctagaatgctcttgcctgctgtgagctctcagactggacccatcagggcttccttctagaaagaaggtctcatgctgagcaaaacttctgggaatagaatcaatatggagcatctcaaggcaacagaaatgaaaggagaaggcctagtccaaactgttcctacgtgctggtagagggtatgggggaacaggaccaggaagtctcaaactcaagtactgctatgaatggaatgtttatgtcccccaaaaattcatgggttgaaatctaatccctagtgtgatagtgttaggagatggggccttggaagtgattaggtcatgaggatggagctgtcataaatgaaattagtacattcataaaagtgaccccagagagctctctcttcccttccaccatgggaggacgcagtgagaagacggctgtgtatgacccaggaagcagactcactggaccacagatctaccaatcctttgatcttggacttgccagtctccagaactgtgagagataaatctctgctgttttatttaagccactcagtctatagtattctgttatagcagactgaatagattgagacacatgctgtaattgtaaataccacacaaaagcaaaagaagaggaatctctgtgaagttagaaaagctctcctcaacctcattttgttataaaagtttaggaaaattaattatacaaccaaaaaaatgagcaacaaaagtatcaagaccaaatctcatataaaggaattttaagaaaaagagataaggaacaaaattatatcactacaaataaagcatgccagtgtaactactttatgaatgggaggaaaatggaaaagtaaatctatattttaatgttttcactaatcatgtgggtggtagtattggtattagtgttctaagactattgtgtacgtaatatgataaaaagcaaatgaataattatgggattgtctaggtctatcatctcttgtgtccttgagaaccagatttttggttttgaaaaaaggagatagaggtgtattagaaaacaagttaagttaaatcagaaatttgaattggaatcatcaatgtaacttcaagagaaattttaccttcaaatgcatatttcccagctctgtgcaaagaaaaagcctgttaacactgaaaaggcctaaaaggtgtgcttggaacatcttgtaatagtagctaataaggaagctgttgaagactgttagagtcacattaaaagttgccaactgaacttgaccttcaataatgagaattgcaatagattgaaacccatcaaatacattaaaatctcatgatatttaaaatgaacaaaagcattgatcatctttggaaaataataggaaaccatttcatgatactgaaaattagtcaacacagtaaaatatttatcctgacttttctaaatgaactgtaccacagagtacctaaatgttagacatggtgatgtttctttataaaagtatgtattaggcagggctgtctagagggtcagaactaataggatagatgtatatatgaatgggagtttattaaggagtattgactcacatgatcacaaggtgaagtcccacagtaggctgtctgcaagctgaagagcaaggaagccagtttgagtacccaaacctcaaaagtagagaagccgacagtgcagccttcagtctgtggccgaaggcccaagagcccctggcaaaccactggtctaacagtccaaaagttgaagaacttggagtttatgttcgagggcaggaagcttccagcacggaaaaagatgaaggccagaagactcagcaagtctgctcttccatcttctcctgcctgctttgttctagccatactggcaagtgattagatggtgcccactgattagatggtacccaccgggtttgagggtgtatctgcctctcctagtccactgactaaaatattaatctcctttggcaacaccctcacagacacacccaggaacagtactttgcatccttcaatccaatcaagttgacagtattaaccatcacaaagtattccaagtaataaatgaaaaatgaatgatagaatgacaccattttgcaattcccaatgaatggatacggacacttagcatgaacagctgctaagatcacctaagagaggtgacagctattatgtgcctcctataacactgccaaataccactaattgtcttgacaaaagtctgctgcattatctggatcaagttgcagatttgtaggaggttatcaagaggacagacgaaagtactgagctgtaccaaaaatagacattctgtaaaatccagactctggaaaactctgcaggtcaaattgcctgagttttccaacagacaaactgtagggaaatggcaggtgtggaggagggacctgtaaattaaaagtgatttaaaatatgtcagatttttttttaataagcaaaacaaattaaggatagacattggagtgataaaactatttttgaaacataattcaagttatgtactacttcaaaaaatgaagttgatggtaataatggagaggggaagaaagttttgcctggaagcggcttctcgaatgtgcagcagtgttccattttctgactgataatatttcattaagccatacttttttgtgtatatattttgttttactttaaaataaaaagaattctaaaaataaatcagtctagtcaccaaaattttacaaatggctgtctctggatggtcaaatagctggcaatttttattttatttttattccttcatgtatattttatttttctttctagttgtacttataccaaacgtgttatatacaccatttaaatcttttttaagtagctgggactgcaggcacgtgctgtcatgcctagcttttttcctttttttttttttttaaatttttttttatagagatggggttttgccgtgttgcccaggctggtctcgaactcctgagttgaagcaatctgccctccttggcctcccaaagtgctggcattacaggtgtgagccactgcatccagcctatttataaaatgacattttaatataattttttagaaaaccaaccacatggcatctaatcagtacattatttaaaatgaaggacaaatttaggatgcaatattagatattttagtcaatggctatggattctttccctttcaaaacttaaaacagttccatttttctagaagcagtgacatagtcttgtaaaaaggctcaagttttcaagaacatttttttccttactgaacttggttggagtccatcaaaggcttagtgtgagtttacttaggcttcaaaaacctgatgataatctcctcagaggccatgatggttaaatgagattgaaggaaaacaatttataaggtacaaggtcctatgctaacctgttacccttgtgtttgatctaatgggatctgcaaaatctgttctccttttcttacagaaataaacagaaaccgaatcttccaagaaatgcatttaaaatgttgggtaatttgtgtagtaatgattgttcctttcaattttatctttctatcataatatcaaaagttatttccttaaaaaaaagaaaaatgtattatacctagtgtaaaggcagagttgagtttgattatatttattatggtaagtgggtggttctcttttttctttctttctttttctttttttccaaaccaaaccattactttagcattttaaaatagagaaatattaggtactactattatataataaaaatcaaattggaccaagtatatataaatgttttaacatttcggtgcaaaaatgggttaaattcactttattggctctatcccagctgaagaattacattctgataacctgaatataatccctaattccttgggatgaattacttttcactttttcttttaatattgcataaagtttatggcaataatgagttaatgctcttagattacaactctttgtgctagcttttccccaaggaaataaaaataagctatttctgtgtgtgtactaacttttaaaaacatgtaaatatgagtattattagaaactctaatttcaataactactataacttttggggacagcaagtagttgtttgttattttgtgcatgggatagaaaggggttgtttttgttattggtggttttgctttggtctttcatgtcttgaaaatatttagctaaagaatgtatgctgtggaattgaactggcacttttgaataatttgtcatttttttcacaagcaagagttcatgttggaactcaaatatagataaactagaagaactgatgctaagtaaaagaagcaagtcataaaagaccatatattatattaatttgtttatatgaaatgtccagaataagcagattcatagagaaaatagattaatgcttgccatgggttgtgggaggcgaagggtcatgggtacagagtttctctttggggtgatgaaaatgacctgtaattagatagtggtgattttttttaactttatgaattcactgaaaaccactgaagtgtaaactgtaccttaccctttctgaggcacactgggtaaggggcctgatgccttgcccacctggcctttcctctcacccactcactccactcagggctgtgaattgaagacctggatatggcttgaaaaccactggcctaagagatcaaaacttttacattgctaggtatggagtttactcccaagtaaaagctggagtccattgcttattaagtatttctctatattaacagtgtactaagaacagacaaagaaataaattgggtcataaatgcttattcttatacacgggtcctctttatgcatttctattatggaaacttctttttttccttccttaccaagacatttagggtaagcatatctctacactaaattatctgcagttgtgataaccattgcaaaagatgtgaaaatcgtttatagtagatgatatatccttttggctttattctgagacccagatattgcttctctaaaagtttccttatttgctcccaactacaatctgttgtttttttttttttccttttctgcctggtaagagctgaatactctcaaaccgtcagatcttataacaacccttttttctccacagggtttccttgaattctttttcttttcatgaatacctttttcttctgcacttttgctttgcatttgggaagccctatatccatataactgcagatcattatgtagttaatattcagttattcaggaaaagatgggtcattgtgaatctgatggcaaagcctggtgatagcatggggctggcaccttgttgcaggttgtttgttttgtcagtgtaaaaactgatgaattttaaatgataagtagctgcggcttaatcatgtctcatctctgctttgcaagccaagagaatcaaaagttcccttaattattgactagaagcagacatgttttgatagaaggggaatggatagaaagtggcaaaactatataagggttaactcagaacttagttgttttcaaaaatagtttggtttttgtttttgtttttttcaatttttggttgggtgcagtggctcacacctgtaatcccagcactttgggaatctgaggcaggtgaatcacttgaggtcaggagtttgagaccagcctggccaacatggtgaaaccccgtctactaaaaatacaaaaattagctgggtgtggtggtgcgcacctgtagtcccagctactcaggaggctgaggcacgagaatcggctgaacttgggaggcagaggttgcagtgagctgagatcgtgccattgcatgccagcttgggcaacagagcgagactctgtctcaaaaaaataaaaaaagtttctgtctgcaaaacaagtttctgtgagtcctgggcatgcatgttgtgaaggaaaagctgaagggcagggacagggagcaggcagcaggtaagcaaatatacttatcattcagtgtctgtgattacaagaaagtttctctctccttctccccttctcctcctccgccgcctcctcctcctcctcctcctcctcctcctcctcctctctctctctctctctctctttctgtctctaagaggagggagtgaggtataatgagtggtaggttgagcagccaagttggagccagaggatcatgggcttcattaagttctgtgcaggtaatgtaaatattttaaatgcatcttcggaaggatcacagttgatatctgtattgtaaatagaaactagaattgtgatatacagtagaaaactggggcttggagaacaatagttcatgggataggatgatggggtgggtggggttgggatagtgttagtccatatcaccctaaatgattatcaaactaatcatttagaaatacctaagggaacagtgacattttataccactattaaaaatgtagttcaggtaaaataattatatgtctgcatagttgggaaaggacaaagaaattgacagtattccttcccaaacagagcaccaatgtggccctgctctttctctcttatttattgtcttacctttttccccactagaatatatgctggcttgtgtgtagccagcatcggctctatgactaatttccattaacacagcttggttaaaaccattgtggttaaaaccacaatactctgtcatcactatattaatagcaaattgaaaatttttttagtgataagaaccagccaatagtttggaaaaattagtttggaaaaatttcaaaactaattatactttttggcccaagttttaaaatattggggaaatgaactaggtatggtttattttcaacagagaatgaaaaagtataaacatatcactggatatatttagtgatgagttcttattgccaagtgttttcatgagactgctttatttcaaaaatgcataaaactaccaaaactgttgacatttaattgcatcaatttacatcggctctgattttgttatagatagttattgccttccattttactgagagaagtgtaattgttttcaaccttatagacaacatctggggaagatgtacgagacttcacaaaggtacttaagaacaagttcaggtcgaagaagtactttgccaaacaccctcgacttggttacctgcctgtccagacagttcttgaaggtgacaacttagagacgtaagtttgattttaatattaaatctagtgtgaacatttatatctgatgttgtcttttttatgttagtaacacaagagaaattgtttaataccaactgcattttagaggaggtaaattaaacttggaatcagtcttcacaacatgaatttttacaattcacttttgacaatgtcacagccaaaatttcaattttaaccttgcacatgtccttaaattttaaaaatatgtattaatatgtcaaccttaatacacactggtcatctcttttgttggtcatctcttttctttttaaaaacacttaaagtgtggcattatatagtctttcattatttattttcctttttttccccttatggggggtgttttactatttctcagagtatgttttatactctttttgcatctctttaatataaatttattaataatacttaatctgttgattcagatatttatgctaaaattctaaagtatcacattatgattctaatctattttttattgaaaatgaagacagcaaactgagatagctttatatattacataaaatagaaaaaatttattcaaagtgtataatttgagttggttagcatacatgaaagtttcaagatggtgaaattaccatgtgattataaagcaaagggaataagaatttatggcctgaagtgaaaagaaaaaaaatgtttttcaatgacccagaaaaaatgcaaagaagtaattttaagatactaaacaattatgtgttaagatccaaatagatagattttaaatctttgaattgctttttcatatgtcaggataaatattcctgctaaggccattttcttgtggttgaatcttggggaaaatgaacttttattactaatcatcaacagagtgcccagttgtatagcataatgaagttctagtcagagaaagacaccgtctcagatgactagagaagagaaactcaaaagtgtgaagttttctactttataaaaaatagagaaaattgtagtaagaagtataaaaaatgtcaagtgcaatttttgtgaaatgaaactttagccttcagattcatagttcattttattttgtacatgatagaaaatcaggaagtagtaatattttagtgctttgtgatagtcaatgtctcaaacatgtcaaaatagaagaatacagtatttggtctgcagaccaaaatagatttttttaaatccctgtagacctcaaactttgctaaatttatgtaccagtttatctcttttatttgtggaatggctaagaaatagaagaaagaacacagccaaagcataggagatacctttttccctctataggtaatgtcgtgtgtgtgtaaacagaaagaaatacaatgcaaatgcatatttagataggtccatgtataacacatacacatacaaaaggtaagaaaaaatttcaactgtgtgattactgtgcttgatatcaaactgtgtacacttaagatatattctttccacttgatatcaaactgtgtacaattaagatctgtgtctttctaaacattcttttgcatagtacaatttagaaaaagttttaataaagcaatttcaattgaaagagagctgttcgaatacattcaggaacagtagacttttggtcctctttttgatttgtgggtatgcttttgtcctttccttcaaaaggttgtgtgataatagattcttatttgtcttagtatctaatatatgtttaactgtgctgatgccttaggataaagacaaaattgtactttttttgtatcccatccagttaacctttggaatggataattctgaggcacagaattattacttggtgctttaatttacgggataatttgataggtttgaactaagcgatgtgccttttaatcttttgctaaaccattggcattttgcatcacaaatatctacacgctttacaggaatcatgcagatagatgcatattttatactcctttaaaacatttttaatttgcctttcaatgtcaaaataatcattggtgtcagtcatcctattctgagtgactctattaggtaaaaattaacagaaaagcatgccaaataattttgtgctgtgattttggggtgtaattctgaaaatgcctcgcctcaattcattcaattgaaaatgaatttatgagcattttttgtgagaggaaaacaagagaaaaaaaggaagaagtgtaagcttgcatcagatgcaccaagatcctttttggacagatttatgaactactagatatagtgggcaggttttctttttttaatcctagaccaagctctcgggatttgatatagttcacttttcggctgagccctttctagtacagggccgcttaatcttctggtgtaacaatttatgtgagtgggtaataaaaaagtttgattttgtttattctcctatttgtgggaggagaacattggagaaaaaccagcgaagtggcaaatgtgttgaagttatttatgaagctaattagaattttcttttgcttctttctttttcatccttgcaaaatgtagcattttgtcctctgcccagtagttacacatgcatgcatggaggaggggatttatggggaaaatgagttattactaaaagggagtaaacaaatccatgctaaggtttattcgattaattttataactatgcaaaattttccagaaaataaatcaataaatgagtagagtttgattaaagaatactccattgaaaataaatctgaggaacaagctaaaatagtagcaaaagtaattcaagggttgtgagaattattattggctaaagagataggttggtttccctaaagattaaaaaaagtaaaatagacacctctccctggtattggttaaaggggagtaaatgagtttaaagatttttttaagagcctttgctatagcaagaaacaaatacactataagtttaactacagttgcagttaacatccgactagaaggaagtatgacagccaagttgagacctgaaagattaatagggctaagtatgatgtgtttgatgtgggaggttgagagggagagtttctggtccaaggaagcattttcaaaagcttggaggcaagatagtttcagaaactggggtggaaaactatcaacaatggcaagaaatggcagtggagagagaagatggaaccatataatgaagggccttctaagccatgccaaagtgtttggagtttattctgagagcagtggggagcctttgggggtctttgagtaaaagcagcagggatcccacttaccctgctctggagcaaatggattgaagaaggcagaagacaaagaacaaggaagagtctaatgacaatttaaggcactaaaagggtcattaagttcttcaaaatctgggttttatatataaaaccattatatatatatatacacacacacacattgtatatatatacacatatacaataaatatgtatatatagtatatatacacatatacaataaatatgtatatattgtatatatatgtatatatacacaaatataatacatatgtatatatattaatatagcattttatttatatatatatatatatatatatatatatatatatatatatctttttttttttttttttttttttgagacggggtccagttctgtttcccaggctggagtgcagtggcacaatcacagctcactgtctcattgcagcctcgacctcccaggctcaagtgttcctctttggaaattcctaggcagtatgtgaagttggtggtgggggggggtgtccccccagcgttaagaatgacgctgaatgatctggctccagacataagcctgtgagtcaagcagaacaagttttcttgtatcagtttgtaaattaacttctgggtgaaattttcagcctcccaagaagctgggactataggcatcatgacaccacgcacagctaatgtgtttattttttgtggagatggggtctcattatgttaccaaggctggcctcagacacctgggctcaagtgatcctcccgcctcagcctcccaaagtgctgagattataggtataagccaccgagcctggcctgtgttacattttacatgatactaagtgatcctcttgcctcagcttcccaaactgctaggattacaggcacaagctaccgaggctggcctgggttacatttcatataatatctaagtatttgtagcagagtctgctttctggaatattagtgtgtgattgacaaaatcacctgttcagcccccatgctggagagcagggataggctgcgttctgaagcctgggctaacacacacattgttcttatttccaaggctttgtaatgataggttgtaactatgcagtttcttattttctcctttcagaattaaatgaaaaagcttatcatttaatctttttttctacaaatcaaaattttctgaagtcaatgaagcccaaggtttgacttttttatctctatttctttttttagaaatttttcaaatatataacaaaacttgagaaacccttcagttcagttctctacccttgccattctcattttttaggtcatggatcacttttgtgctaactggattaagttagcaagaaccagtcaagcaatttgacagagctttcccaaggttgattaagacaaaaaaaatacacacttttcttctatttgaagttcgtggcatatgttttgctacacttgaattttggaaataatctcttaagcagttactgtttttagaaagtatatagcatatcattcacctgacatttaacatattcagggttaatgaagaacagtgacgtggaaatagtattgactaatactatgttgttttattgttattgtatctattttacacatatgtaaattaagtttactgacagtatagatattctgacaaacagtctggataaatgcctggttctgcagtgagaacacatggacacaggaaggggaacatcacacaccggagactgttgtggggtggggggaggggagagggatagcattaggagatatacctaatgctaaatgatgagttaatgggtgcagcacaccaacatggcacatgtatacatatgtaacaaacctgcatgttgtgcacatgtaccctaaaacttaaagtataataataataaaagaaaaaataaataaataaataaataaataaatgcctggttctgaaaatagatctgaagagtcttagtttttcatcccaataagataatgttcaaaagtctttgctgtgcaggcatcaacctgcacttcactataggagatgaagagaaaagtaggcattatagatacctactttctttgtctaagtaggtatgtataatagaaataggagaatcaaggagttttggaataattttgtttcaaacactgttagcttttgcagacttttatttaattaaatagctaattttctttgtactgtaaatgttctacattcatttactctccttcctcctcaaaaagctagggttggaactagcttttaattaggatcagttgttttcaaaagtatttcatggagacttgggaattcttcctaggcagtatatgacatccccagcattaagagtgacactgaatgatctggctccagacacaagcccctgagtcaagcagaacaagtttttttgcatcgattcatagtttaaacttctaaaaaacttttttttgaagaaaatgtatcatgatctcaggaagttgccttcagtgttatttatgatgtgacatttttggtgggatctaggggtggtatctaggttgcatgtttgttcaatgtgtgtgtgaggttgaggtattttgggtacatctgggtttggatgtttacatttaaaattacatgaagaacagaaaagtctaattttattgcacctctgccatcaacatataatgtagtgtttcatttttaacttcatctttctaaccaagtttcttctctaggaaaaacaaaaatatgattgcatcccccttggtatattatagaatggtatctttacattattctataattttgagttatttttgagcattctggttttttccccagtatgactgtttaaagatgtgtttgctatccttgaacaaatatcctgtaatatctgtgaaaaggcccctgcagactcttgaatacacggcgacttctctagaatacactgtgacttctgttacttttgatttccccatggtggctctcagggcaaccacatatatgagcggaagataattgagaatctccccacacccccactgcttttgtcttaaattgctctaaagtgtttgttctgtgacttttgtctccctctcccctctttgcagtcctatcacactcatcagtatgtggccagagcactatgagtgagtattcatagcccacgtgcaggagaggtgttctgatcagtggtactagcatgggggtcttactaaactcttggtctaaaataatacttctgtgttccgggtaacaatcctagtggtctgtttgcatggcagattcattacttaagtaacctaacatttctaatagtaacacctatcaatatttgggcataaaattattgctttgtttttttcttttaaagcccctcacaatctcctcaactgtttcatgatgacacccattcaagaatagaacaatatgccacacggtaagaaactttgatcagagccctccactgcactgccacccagaatgtatctatgtctaattaatctaatatcattaatataccttgatttaagaaatgcagttttgcaggagttatgattccattatatttggaatttgggctctcatattttcatgacacagtttgcactttaccaaacacctgctatatattctatgaaaagtaaacctaaccaggatgtgattctccagctaatgagaatccaaacactgtacaagcaggatttagatggtgtaaccaagtttcagtaaatgaaagtgggattgcaggtattctcaggagatggtgcacatgtgaattacaatatgtaattaaatttatgctaatgctttaggataggggtttattttagagtctctaaataatatataggctggtcttgatggtgtgcacagactttcagaaaagtggtatatactaggtgtctgtgattctagtaagtagctttgcctagaaaggttaattcaagcatcataaaaatggtaacatttgaactgggtctaggccaactagaatttctaggggaaagtcttggactaatggaataatatactcaaaagcattgagctgggaaagggcatggtttgtttactgaactgcaggtaggggaaagagaaatagatgagaaagtgaaggacacagaagttgaggtctgataatgaaaaacccagccactgaagagttggatcatgtccttagttgaagggaagtcatggagagtttttgttatgagaggaacatcattttatttgtttgagaatgtcacgctcacttagatgtagaccaactagagggttaaggaaagcctaggtctgggagctcaattagaagattaggtcagttaggagactttacaacatggcgtaagataaaggcctacaggcattaaggcagtggtgatagaaaggtagctcaacatgaaacgttttagttttacagtcgtgttaggagatttggatctttctatgttttgtcagaattttgacaatttaaaaatgattaaggatgtacgtccaattgaccatgtcctatatggccatgttgtctaacctccttatttttattttgcagactggcccagatggaaaggactaatgggtcttttctcactgatagcagctccaccacaggaagtgtgtaagtaaatcatgaaattagtgctgcctgggaaggctagttcttgtattatggctgtcagaaacaatcttcactgatgtggctctgaatcttgatcccaatcaaaattattaagtgtggttccaaaaatttctacgtagattttatgctttcaaaccatgatagtataaactcaatatgtttatttactttgtttcatataagttaatgaaaaaaatcttacatttgtcaacttatataccccacgaaaatcagattgttttatttaggataacaggtgtatatattcattccatttgtcttatatttcttattaatttaacaaaggtaatttgacagaatatgtgccctttctgtgaaatcctctttcttccactagctaacattttttccataatatctgcatttagcacctctgacccacacatacttagatatatactcctacccttcattgaaaactgttaactcctctgccaatattttattttattagcaactaagaaaagcctcattgactttagaatactaaaaagatattatatactaaaaagctttctagccaattagtttatttctgatttccccatatgtgtatattccacttggttgtggaactttctcagcaaatattttatcactgattatcccactattgtgtgtactcttacttttggaactttttattcttttttttgtgccctggaattcacatttttaatcctgaataatatctaaaagactaatactgtcaagcttatgtgactaacaaagctctattgtggtttggatctgatgggaatctgtaaagtagacagaaaagttgtcaaacatagtagttgggtgttttcactaaaaaaaaaaaaaaactatggagagtgctaggttaaaatacttaaagtgctcaaatatagaatattctctttccatattttctaaaacttgttttatttattatggttataaataaaagttatcaggaggtttttcaatttcaaatttcaaagattgcatcttaatacttgacagtaatgtagtagagatttatacattatcattcatgtactatgagtgtgaaacaattcccaaatcaaaataaaggtgtattcataatgtttgtttcatatttaacctactggtgtgcatttcatgtaaagtagttaagtatcttgaatctttcctaaatcaacaaatttcctcaaggctgaccatagccaaagcgttaaaggaaataaaagataataattcagaacaaaatcttacttctttaaaatgttttgtcatgccctgtgaacacagtaaaggtaatgctcaaatttagtatattgtatcttaaaataggaataaatactattttcagatttagcactgtttcagaaaagattaacattttttaaaaagaaaagaaaaaagtcagaagattaacagtcagatacattttaatatactgtcattatatatattaactcattcacccatccaacagacagttgttattaatatatacctaccatgtaatggtatgctggagccaattgtgagagctgattgttacattttcaggatgtttgtaagctgttaaacagagcctttttaaaaataatttatatacatgtatatacagttacaattaaataaattagattaaaacaaaaacaaaagtaattctcaaaactcatcacaccctaatgattttacttcatttcactaatatctatgcccttgggattatttattataaacttgtccatcctgcaacccacaggccacatgtggcccaggacagctttgaatgcagcccaacacaaattcataaactttctgaaaacattataagatttgtctgtgatttgttttttgttttttgttttttgttttttttttgcttttttagctcatcagctatcattagtgttagtgtatttaatgtgtggcccaagaaaattcttattctttcaatgtggttcctggaagccaaaagattgaatactcctgattcattatctctgtcaggtggtgtacaaatgtgtatcttttcccagttccacattcagtgaagtcatgaacttgaaattggccatgatcaaaaagtatttaaatcacagaagttgcaaatgccacaaatcaaggtctttttctcttggagaacctgttaaacatttaccaactcacgaccgccatgcacccaatactgcaataggtctatagatgcagatactgtctccatgaatcttataggctagaaaggaaatagataagtagtcctaccagaagaacatgatgaaggcatttgtggtaaacagaatgatggccccccaaagatgtccacatcctaatccctgaagcctatgaatatactactttacttggcaaaagggactttgccacaggtttttaattaaggaccttgaaatagagagattatcctggataatccagatggccccagtgtaatcccaagggtcctcataaagggtaggaaggagagccagagtcagagaaggagacgtagcaatggaggcagaggtcagagagagatctgcagatgctgctgtgttggctttgaaaatgaggaatgcaggtgacctcaaggtgctagatgatgcaaggaaacaaataatctcctatgaaccctaggatgggcattattatgagtcctattttataaacaaggaagctgacatccagaaagataaatgacatgtccctgatcacccatatatctattacaattagatacatgagtacgttcgattgactctggacaatttaaaaggaaattgatgttacgaatactacatatctttgaaggaaaaattgagcagtgacatctcaggacaggataggactcatgacggttctggggaatctcagaagtgggaacgcaaggacaattccttgggccatggctatcaggacgtctcactccatctgccatctgcccttgggtgacactggaaagaaagaatggggaggctgactgtggtttacacaggcattgcagtttgcaaatctgaaacctagaacagaacaatccttaaaagaaagaaaatcattatttttatttatgtcttgtctactttcaaaagttcattgaatgaatcacagtttttttgtcatctgatatgtactaattttgtaatctagatagtgtttactatgtgtgacttaactgtagtataattatattccatctaatgatatttccttggtgcaaacctattatttttgcaacattttctattttagcccaagacatacgattgatgtttaatgtccctgatctggtacctcatgttctatctgcatttaaagagtttgttattggtttttactatatgtaattaagaactagaatgtatctatttttatattcaacatttagacctaataatctgtgaaaaacacttaagactaaaattgtatgttttatataaatgattgttaaattcttatttttgtgaaaactgccttaactctcttccagataccataatgaaagaatgcaatgatagtggggatgataattataataatgtgttaaactctatcagcttccccagagaagtgaatctatatgtatgttgacaacaaaaatacatctcaaatctaattttggctggtttcactatggatagtcagtctccaaatctttaaaacaaaaatttacttggtattaatattaagcactgaagttaatccatgaggtcaggtgctgtagtaaatgttctgagggcataatggtggcttgtgatcttggaggaactctacgccaggatctgtggtcaaatcatggccacaagatcagccacatagcttaaagggatccaagttttcttttaattcttgttgtccttatattagttcttattttaagtcttttctttccatatttattattttcttttaggtatgttattgataggtatcatagaactaattttttgtttgtttgttttgtttgttgttttgttttgtttttgagacagagtctcactctgtcgcccaggctggagtgcagtggcacaatctcagctcactgcaaccttggcttcccgggttcaagtgattctcctgcctcagcctcccgagtagctgggattataggtgcccaccaccaagcccaactaatttttgtatttttagtagagatggggtttcaccatgttggtcaggctggtctcaagctcctgacctcaagtgatctgcccatctcgacctcccaaagtgctgggattacaggcgtgagccaccgtgcccagccaactaattgtttttttaactaatattagaataagtttacctctatttttatcgtaacacctgagattaccatctactttagttccattttgcattatccttgctcattctttctttcatatgctatgtggacaaagtgctttgcctgtacacttgaatgacctgcctggtcatatggatggataggttaggactgtagatattgctccattgtctttggacatttaatattatggaaaataggaagctaaacctttttccaccgctgaacatgatttactgttttattttgatttctggcagattgcttgtgatactttatctttaaaatacagacattttccagggatacatatgaatgtgcttcttttgttattattatttttgggtactctgtctttatagtttctatactcagatctttttcatcctgagaaatgagaaatatttacaggatgttctactgaactcttattttgctgttttattttatatctatctactatatctttacgctttgtccatttgtcctatccatatgttagagctgctcttttgtcatgttttatcacctctctcttcacatgaacttggtgaggtgcctccaggcatcgctgactttgcattgtgtaattcactgcagctcattggtgtcctggtggtgttgagacattagtcttacagcttgcttctgccccggataacacagctaggtttagggtgttggccatttacttcctatgaggaaaatatacacatacacagacccatatctccctgccagtctgtttgatttagctacatgggaaactgaggagcttttggattgctttcaaatgctgctctctgcagtggtgcagtacccatactctcttcttctcgtccttctaaacccaggaacaagcatggggttcttgcagaggttccttcattcatttcccagtgatgctgcgttttctcaggaaagggaatcaaaggataatgccgcagcttacttcaatccttaacccactggtgttccttatttccagttgctaactgtgttgtaagggtcccaccccatcctcttttaaaatttatttgataaaagcaagaaggtcaggttaggtacttattattatattgtggccttaaccaaagtatatgacctttatttaaatatatatatactcacatacacacatgttcatatctatatctatatatttctagagggagagaaaaagagagggggtttattgatgaagaaagcaaaataaatcaacaagtggcacatctgaacttttgctttggctgtttgacaagcataataccagaacgttcagttttctcaattgcttcatctagctctctgatctcaatgcttaggataaaccttttctaggaattcaccaactgtctgatacaatttcaagtcccttccttgttagagtaaactgcagtaacaccaagatgaattttcaaaccagaattacaagtaccagaggtcttccccagcatcaagtgttactcatcagctcaagggcacaggtaatctcaaggctctggtgaagctgagagaggcccaggactgccagcaccacacaccaggttctttctggctgcaacaggatgctgtctgactccagagtaacagaagaagtctctaagggatgttcgcagcccccatcgcttacacaggaaggagctgcttcagtcatgagatagccccatttgacactctgatagctacataactgacatgaggttttcctgctgccctatcctgtaaagccatcgatttccaggacttgtttaccaaaagccatcaaaacggaccacgtgccatctgctaatggactgccctgctagtattagccaggagattggtatttgcacatttataagatctcactggatctctcttgttgaaagaagataagaaattccgagtctgctagaaagcattttcttgccataaatatatcaactttgttagacattcacttatgtcagttactaattcaaccacgttactgctatgtctagttcattagacaggtagttagataagtgggagaacccacatgcattaaatgtagtttcttgttctaatgcagagtgatcaaccctaaaaatgacctgctaataatataaagtaaaatatctgtagagacattataaatatctacaattataatttgtgctgagctatttaaataaaagaacataaggattataaaccttgtcatatgggttacaaagcatttcaaagttactttcaacgaaattctaaagacagtgaagtcagatgattcttaattcagtagtcttttaatcaactctttaggcatggagtaattgattttgtctacagtagcttttatactaaatgctgttccttatttttgttttttctgctgagtaagatatcccttctgaagtttatgagatagagctgttagatgaaagagaagcctgaaatgttgactcatgtaatatccatgctctgctagatgaacttcttcctagagttttaaaagggaggtcatggagacactgagctctaagacaaacttggcccagccactatcctgtccatcattatttctacttcctttatgtccaaaaacatcaccatccagatgtgagcctctgggtctgtttcctttgtcttgctagggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaaggtgtgctaggcctgggagaaggaaatatgtcatcctttcttttgtatgaatttcactgtagcccccatttattctctttttcaagactattgtctaagaaatctcagtggagtgaaaattttagaggctattaacaaactgggatgctggctgcaatacagcagcatttgggggttcattgatgatgtctactgggacacttgcttaaaactacaattttattcctgcatgctcatcctgctattaatacacatttttatataagaggaactagcatgagctaaatttgaacctcacagacgattttggagagacgataatgcacgtggtagtcattctgtttctccctctttctgtattagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcaggtagggtgtgtagaattcagcgtcacacctccccaggccatctgtccactgccctgggagatgatggtccaggtgtcaggagaggcagagaagtccactttcaatttcttacctccgtagttaattcagactggcttagaaatttccttttacatgtaagcatataaatcctcattggcacacaaaaatgtgtttgcccagcttacaatggaatttcccagtcttctttaacaatgaagtccgcctcagctctgaactgtttgagagaaaatatcctatgacatatatcttcctaaattatacatgggaagcatctgtattaaggaacagcaagagacctgaaatcggcattctaaagctttcttccagtgagacaagaatgctgactccaagaatcattattttctattctcaagaaattgagttaaagatggttattaatttgctactattatttcctaacactggaccatgttttatgggagttgcttgcaagctttctggatgataagaaatacaatttacattaagatgaatacatgcatgtatggagaatacaaaataatacttgcctttatagagaaatgccagctcttattttctattttccctttcttcctccctccctttcttccttctgtttttctttcttaatgctggtcaggacctactaaattgattctataactcatcggtgggttattgcattcagttttgaaaaacactgttctttgagatataaaagaagcatcaatacagtttctgcctttctggtgcctgccatcttgttagagatcacagcaagatactttcatatgtgaagacacagcacactgtagggaattaagtgcttgatggcacatagtagttaggaataggagtgatgtctcagaagtagtgatggagagacctttgcagcaggtgcagagagcgtagagtcccagcacaggggccaagagctcctctctcttgaagaatccctgacatcaacatgcatgtcatctttagtctttttctctagcctgtgctgtgtggagctcctatgtgatataataggagtgcctttctccagaaatgatttattgactcaaagcaggaacaactttctctccagtgattctctcaaattttagaaaactgccttttcacagttgctctcagtctttttaacttaccagaataattcaaaacagtgtcatttctgccttacctacacagaaatttgtgtaggcaattcataatttgaccatacacttttctctatgtctctcagtgtttcagaatttgggtgaggctgttcaatggaaggcttacttcagggcctctcaatcccacaatttggaaagtaagagtttcccaagagtgacccaagacgtgggtttcttgaagcccttcggaatgtttgagtcttacttagtgccagccacatacattgaaaacgttacatttttcattccgcgaacttgaagtttccaaatggtgctgtgtaagggatggattttctcttgcaatctcttgtttagaatatgaagtgttagtgttaacaacttagtgcataggtggaattgctacagaaggaagctgtgctcaaaacctttatttgccatggctggttgatgcccacaggagagcaaaaggcttttctgttcacccttgccttcccctactccctccatcccattagacagtgctgcctgatggctcatgtgccttgagaatcacatagcaatgcttttagagatagctaatatccaaatggcttctatatccaagactgcagagctcttatctcttctaaacaatttaggatgatgaatgctagaagtagatggaaaattcaactctaatagtaaaaactagcagaactaccaggcttcaactaatatagatttaatggaaaaatctgcatgaaaaacttgtaacatctgcattccctatatgatggctcacactttctaatttgaccatatatttgtcagcgtatccatattgaagatttgcgtgagtgcctttacgaagtatttactaagtgtcaggctgttctaaccattttagaaatagtcattcttcactcccctcacaaaactctataacacagcactattattaccctccccattttacaaataaagaactgaaagcatggaaggttctacagttttcccagaattacacagcttatgagtggcagagtgggaattagaatccaggcaatctgaatccataatcatgcttctaatcactctctcaatattgccttggagtatgagctgattttgaaattggataaatttactgtattagaaacccagtgctgatgtttaaaatatgagtgaactatgcttatgaattcacttaacattaaaacaacagaaaaattgagggataaaaatggtgttgataaatgagtctggcagcataaccaagtggattcttcaaggtgtccaagcggaaagagaaggaccaaagcccccaccaagctgatgctaaaatgtatggaaaacatctgaaggcaaagacttctatatgatttaattatccatggtgagggcggggaagttaaaaaggaaatgtttttccttatgattatttgaatcctttctctgctttaacctctgaatgtggttccagcctgaatctgattcccgaatcaatggtgtttccccatgggcttctcctcagcattctgcactgagctactcgcttgatccagatgcctccggcccacagttccaccaggcaggtcggtgtccccagcacacagctcctctgctgagtctgctttgtgctttgccattagtttgtgtttcctgttaagtaacattcctacacactggtgccttaggaagtaaaagagttttttgtatttggtcttaaataggtgcaaatccatttcaacaatatcaaaaagcaaacattttcaaataagctataatacacttgtttatataatctgtagaagtggattgaagtttggatgaaaaagcctcctctgccctttagaatgagcaagaaattaaattatttgcttatgaatgatttttttagtacactttctgtctctaaaatgttacattggtgcatattcaggactaataatattacaccaaacattatggttgtatctgccaaggtgtggaaactcatttattcacttttcttcgtcctagtccacttagacattgtcttgcctgtcccatcagaggcagcggtcccacgcagcctgtccttggtcacaatggggacctgtcactgatgctaggaaggactcagtaaactaggtgttaaccaatgacattttgttatcaattaaattaaaattctagaattttactgagaacgatatattgtaaccaaattaatttcttggtgggatatcttttggtacattaaccagaaaaaaattaaaatattagctggatgcagtggctcccgcctgtaatcccagctctttgggaggccatggtgaaaccccatctctactaaaaatacaaaaattagccaggcgtggtggagcactcctgtagtcccagctactcgggaggctgaggcaggagaattgctggaacctgggaggcggaggttgcagtgagccgagatcgcaccaatgcactccagcctggtgacggaggctccatctcaaaaaatatatatattaaaatattaagattattttcatattttttaaataagagaactatcttgactatggattataggataaaaaacacatcctagtgaaaagtatcttaaataagatgcctttacttttgtggcaggataagctggcctaagctgaagtctccaaaaagaaaggaggacagaaaaagaaattggtgaaattttttttgtatgaaaacatacctgtggtgcaaaaataatagatttctcattcaaacactgaaataataagaccatattacttgtttttcagtctcatatttttcagtcccctggtgtgtggattctttctacacaaacaaacagctagtacgtgtcaattatgtaaaattatattaccaacactcaagcaaaaatgttttgggtatattcccctaaaattgtcctttgcaatgggaaatcttttcacattgatatttagaggctggttggagtatttcctcctgaatttgggttttagtggaaggctagacattaatttgagaagctttgttgttctctttatttgctgtcacagcgggagaggacctgctggccccaccgcacgacaccagcacggatctcacggaggtcatggagcagattcacagcacgtttccatcttgctgccgtgagtatgaaagattgcagcaccacagctgcacgtgttccttccctttctctttttctgcatgcggcccttcgccttcttccttaagataacaaaaaccttattacaaacaggactgaatattatttgaaaataaggcaaacattatataagaaaatgaagctcaacctagatactatcaagtaacgggggtacagtcgcaacgcaattctgctctttgagatttttcaatatgcctgatgggtgataaaatgaaagcaaataaaataataagtctggttttaagaagaaattatcctcttcgatgcaagctatcataaggaacacatcttagttcaaagaagagctttcagtggcatgccaaacaaggcatggaaacagcctttctagtgtaattccctctcttttcttcaaacattgttctccaatgtcatcagactccagtgcagaaagggattgttttcagattttccctttttattcccgctggtttcttttctcatggaataaaatagtcattgtataaaggccaaacaatttaagtcatcatagattaggatcctgtgaagtttccatctgaacaaccaagagccagaaaataaccaaattcctggggaaattatataataattcttacttattcattttttccaagtgttttgtcttcagcaccttgccaccttgcaattttggctgagctctcacctaaaacacttctggtgtttctagcagaatatatacatacaagtaaactgtatatatgtatacatatatatacacacacacatacaaatatataaatgcatataaattacttagtactataattatattttaaataatctttgacaggatttgaagacattatttgtaattttagagagatttactctcaaactgattttaaatccagggcagtcactaaaataagaattcatgtaaagcatagcctcttattttacccttgtctgtcatctccttagaaaatgccatcccaggctgggcacggtggctcacacctataatcccagcactttgggagggcgaggcaggtggatcatgagatcaggagttcgagaccagtctgaccaacatggtgaaaccctgtcgctactaaaaatacaaaaagtagccgggcatggtggcatgcacttgtaatcccagcaactcaggaggttgaggcaggagaatcgcttgaacctgggaggtagaggttgcaatgagccgagatcgtgccaccgcactccagcctgggagacagcgtgagacttcctctccaaaaaaaaaaaaaaaaaaaaaaaagccatccgaaatgatgaaaaagagattatcaattatcaggagtgtaggtaaataagatatattgacttcatttaaagattattatttactgtatagaactttgtaatttttaaaataccatcattagcagaatgtgaaaacagctatttaaaatatatttctggcccaggtgcggtggctcatgcctgtaattccagcattttggcaggctgaggcaggtggatcacttgaggtcaggagtttgagaccagcctgattaacatggcaaaaccctatctctactaaaaataccaaaaaaattttccaggtatggtggcacaagcctgtagttgtagtcctacctacttgggaggctgaggcatgagaatcgcttgaacctgggaggctgaagttgcagtgagttgagatcatgccactgcacttcagcctgggcaacagagactctatctcaaaacaacaacaacaacaaaataaatgaataaataaaacatatatttctttgtgaattttcaggaatatttgcctgaagattatattatggtttccaccagcacatgaatatatctatttgtgttttgccagtgtttcccaggttttcatttgtagatctactataatgcttctcaaagtttgcagaatcacatttacactacatcagtctccacacccacctccccacctccccaccccccaaagcacatgcatgcatgtgcacacccatatagacacacttttggcttttagagtctcacaaaagcttaagaggatcactgaatgctcacatgctaccagattgttgcttattttctaggctctgtaaccacagtaatagataaactgattaaaactagtttattaattataattcaaggtcaaatttatttagaggttttgattttcaattgttatgttacttagtgagtagataaaatctcatcatagtctttatgagccagaattaaattcttaaaggaaattactttttagttcagcttatacctaaataaccttaataattagttaaaaacaaattctgtacatcaaagctgtttagaagtttttatttaaatatcatggacattttcaattgtaaaagtcagttggcagtgacagccaggatgggaaatgtgtttcaatatacaccttgtaatatatataaaatatataatttccatattaaaaattttattctaaaaatgtgggattttttccaagttccatttcctaaagaatttactcttaaatttttctcaaagtatactctgacatccagattttacaaaagctggacccatgtcattttaaaacagaacattattaaaaataaataatcataatttagagcaaaaatgaattgtaacaggtaaatgtatgtatctctttttatggcctcactttaaaggcaagtataaaattcctattggttggggatcttgttagctgttcattgatattggtttctgagaggagtatacacagtaccttcaatgggacccacatcacagagattcatcctctcccctgcattggtcccctcttcaccaatgtcattctcagtgttcagagagtggtttatggagccctgagattccttaatgtttattaagcttgagtcacattcgtcaaaaactcaaaacctactgaaatgcaatgatttccttttaaatatgtttgtatgtaaaatacccttagccttctatctgataaaaagctgttggtttaaaagtattggtttggagcagctggcttcatgttttcatagtgttaactatgcacattcacaaatatttataatagtcatagttttctgaatgagcattactagtcatgtcttcttttcaagaattcaagcacatccatgtatgaaatgatgaaaagtgtattttagaatcctttgaaatctccatgttttaatttttggcttctgaaagttctgctattcatattttttctctggtattatatacaagacagggacagctttccataaaaataaaagctgtattgacttatttataaaattgatacatattttcatattctgcctgtaattattaaaccttttaaaaattgatgcaaaatagaaatcagcgtgggaggtagactcagtgcccagtgcatgtgtctttctctctcttttttttttttttctgagacagagactcactctgttgcccaggctggagttcaatggcacgatctcaggtctgtataacctccacctcccaggctcaagcaattctcatgcctcagcctcccaagtagctgggactacaggcacatgccaccacgcccaactaatttttgtatttttagtagagatcgggtttcaccatgttggccaggctggtctcaaactcctggcctcaagtgacccacccaccctggcctcccaaaccgctgggattacacgcgtgagccaccacacccggccccaatacatgtttctgacttgagtgaatgattacattttctagctgggaaggtttccttgtagcattcctagatagtactcagaacgttttgtaggattcatttgttcttttgtccctttaaagttgctcagccagcaaatattttaataagcctttgtgattcccaaagcttaccaaccacctttggagaatttatctaaacaaatcggattggcaccctcccaatgccaagccaatcccttgagcccctgtaactaatgagaactttaaaaatgcttgtcgccagcatacaatgaattgatcttcatgttaatcttgacttttgatcctttgtggattaaaaattagcatggccccaaatgaatttccactcttggcaatcttggaattaaaatgaaactctgtattcataaatcctaattgtgtgaattgcctattttaacatgaccgttttttaactgtgtctacacattgttgcacataacactttagaactcctttgtctgaattaatatcccagttggtcctgatagcatccttgaattatggccttttaaagtctttttaaaattatttatgttgagtcttagagcagagaagcagacatttccttcacttcctggcaaggagttaaggaaaggggtttaaatgtactgccaattaacaagtgtacttactaaaattcccactgactgcagtaactatttttattttttggtataaattttttttgtccattttttacttatgtccttcaaatgtatgaaatactggcagtaagccaactaatttttgctgatagaccaagaaatgctttcaaaattatttttgacccacaggcatatttttactatgaattgcctatgtttattaagcttgaatggcattcatcaaaaacccaaaacccactgcaatgcagtgatttcctttttaaaatatttttgtgtgatttgttcaggcaaatacccatagccttttatttgataaaaggctgtaaggttaaaagtattggtttagagcaaaatggattagacttctgtctagggtttggctatttgttatatttgttacttgcaagagaagcataactctgtctgttttaaaaagagtgtgtaaacctatggtgtacttaataataattcaactcagctatcccttggacactgtggaggtccactcttttctcctggatgtaacttacagatctgttagaactaggcttcttttagcctgatttctcccccaaataccgggcctcacactttccctccagacgttataggaagggtactcttcatgcctgctctttttttctcacatagctcccagcacacagcacatggtcactgatgtcctttctcccactcagcatagaacagtgagagatggaaggagtgcagcatgctagatgactagggacaacttttatttgaccaagaacagattgttgccattactgggggacagatctcctcttttccccccagcattgagaacgagatgatcatgtagcaaaagaggggacgaaaagcagatgccttagagaagagatggcagtggctgcccttgcaaagcccgccagatcgtcttcactgttatgggctctggaaccaaaaaggaattgagctatctgtgtggaaaggagaattagatgccatattctaacttctccgttgttcctaactgggcccatccaagggactattattatcccaagtgtccagaaggacactgaggattaggccagcactttccttgatgcaagtacttggccaccattttcctgggcgttagggtccagggtgtgtcaagggtgggtcaagagaggcagaaaccaaagacttatgccttcagtggtcccttggtcagaattagtactcagcaaagtaagtagaacatgctctgttctgatacataaaccaaatacacagtatgatttaaataggaaatgagattttttgcaagactaagtgctcagtgaatgctttagtgtatgcactaaatcttaaatcacatgggatatgagaaactaaccaggaaaactagccctcattgaagcattaagccaggaaaaaaaaaatgtgtttcttgtttttcctattagcatccatttaacaactgggctattattaccctatgtagagtgatactttccacgcatttgcatgcctgagagttggaaccaacaaagtaacaggactgccattaagtgatttcttttgttttctctttcagcaaatgttcccagcaggccacaggtaagagttaatggcttggttggctctatgttactgatcccaacctagagtaagcagattatccacgactgattttattcctactttattctccatgtaaataagtaaacttacttgacatttaaatgttagttgattctgtacaacagtttgtcagtctgggagtggggggtggctcccaagccacagataccaaaaataccatgtgtttgatcctttgtgttctaacagctttttaatggcatcttatgtgctacataaagtcactctagatagatttgaccaccactgctctctcaaatgtctacttaaggtggctatcacagaacattgacctaaaaaaaaaatgactggtaccacagaggtggttttgttactttgcaggggaaaatatttcaattttttacttaaaaattttgctgagaactgttggcagctgtacccttatgccttttagtattttctataaaccaaaaagtgtatgagacaggtttactttgccaaggttgaggacacacctgggaaaaagagagataaatttcattaggatttgtagcctgttttgttttgtttttttgttttgttttgttttttgtttttgttttttcccaaaaaggattttgagggcttcacagaaacgaaagagcaggcaggagggggtggaggaacagtcaattatgcatttgtcttatgctcagtaaatctgcgttttatataattaagataaggtatgcctagagtagaagaagcagtcaagtacacatttttctcagggtgggaggagagatgacttctagtcctgcctttgtcctgtaaagataagctgttaattcacattgtcagggtgaaattcaacaaaactctgttttagggtaaagatttggggacccttagaaatttccttgtgagcaatttgtgagggaggtcactggccttctatctttgcaagtagctgcttaggaaggtagtttttgtgtgactcagttcccacttttaatttttccctttagcatagtgagttagggatcctgagattttgttttccattcacattttcttatcacatacttttagtaataatgtgccacaaagccacagcagctttggagaacattttctttcatgaacttgtttactaatctttttgaaacaatgagccttctgaatgattgtcttattggcaagagaggctgggatcttaactaaaagacaagggtatgtgaagtaggctaggggtgtggtgagctgtgggtgttctctcctgcttgcttctgttgtctaagtgaattggaagccgggactttagcagggagtgaggttggggaggaggtgtcagaagtgcgaggagagactggaggatgtgtgatagcttcttggagaatagaagagcagatggcctgggaaatagagtgtgactataagcagcattaaaggtgccactcatgaatttaacatgaggccattctgcagggttgtaagttgccctctaggcatattcacgttcatgagcacaggcaccagaatgggctgagtattggcatttaaaaagttgaagttggggtttgacaaagtgagtacagtgattcaagggaagaggcaaagaagtgattataatgattgaaccagatgcttaagctcagtagtgaaaggaatgaggaaatgtccagtgtgggagacagaaataaagatgggaggatcaatggatcctattgtcaaaggatggataaatttgcagttgtaggggaagtaagctgtggaggtagaggtggttgtcagaagctaggttgaatgatactgaaattagaggggttgcaagtattggtaatggtccatatttggacctttgtgtgaatggctaagaaggttggaggacaggaccattggaggaaaagagcctaaagaaccaagaagccagagtgctggaagaatcatctccatgggtgttgaaatcactaacatttaaaaatggctttagagtaggggactttgagccattttttacttcaagaagtgaaggaacatgacctacggagtcagtagatgactgcataatggagtcatatagtctgatgatatgagattcaaagctgggtgtttttagggagaggagaaagaagataccccagaggccccaatgaggaccaaggaagactcatgcagtgtatgaggaatgggggagaatggggaggggaagtgctgtgtgagagggttatgagggaagctgtgtcttcaggtagatgcagatattgattagagcaagtagatgcaggcagcattcagagaagggtttgggaacatgggttttgcggatcacaggccacatgacctataggacaggtttcaagagctaggaagagtgaggcatagggtcacaaaaaggggtatgcagatctctatatgactagaatacaggtgatggaagggcaaccaggagtctagagctttttagggtggcccattaaaattagggataaagggtacaaagaggttagtcctgatggtccccaggtggaatgaggctgtgagtgacaaaggcaaggagggaagagagaatcttttaaaatcctcagatataatacaagtgctcagaatttaaagcagaaaattatctgaggaggccttctcctcctactctgtttctagattttagaaattgagtttacaaagagctaaatggttcccagttgtacagcaacttagtggatggagcaaacatgtaactcaatacaagaggcccctttcccattttcttccttccctttccatgtgttttttcctgctcttctcttttcttcattttttcatgtcttgggtcgaatggaaattcatgaaaagtatatattttcacctggagggttgggctaatatttacatagcatgatcttaaatttttagaattctgacacctaaaatgagcagtattgtgtgtccaattaatagacacatctcattctcaaggataatggagtatataggcacaattcaaaaatcctcttggctttatatttaacatgaatcagcgccagagtttcagttatcaatattaatatgtaacaaaatgttcctttctcatatggggttaatctctccccttctctgtcctcaaaccacttctttgaatttactgtggccggcacttacctcatattacaattgaatgaggctgcctggctgagatatcttccacacctgcttcacaggagggcctcccctcagtacaatgcctggaacccatcagtgtttgctgaatttttgctccctctaacatggcaatcaaatgttcaaaatggagaagcaagtgtctgaagaatccaaatttgaatagtcatggagaatgggctctaggccagagtcaaatgagtttgctgctttcagcatacctgggaaaaggaggggctccgtgggcagtttttccagtggcttcattaggaacatgcttccagggagcaggataaagtcccccataaaataaggtgtaaagacagatggaatatctttcctgagggtccagaaaggccttttatgatttatgaggcatggaccagtttggatgatttcattttagcactttttttttatttttttctaatttcaaaatccttttagaagaccaaatgtttgaccttcccttcaaaaggttgataccacttccatgagtgtggcctggatttatattgtctctgacctgggacatttaactttaactggcaccactaaacacccttgggttatgattcctgccttgccttcctcttctctggactccagcttgggatcaagatggttggcattgttagggtaccccctctacagatgacctcccacagtcccccaggaagacatgggatattttcaccagcctcattcgctcaccattggtaccttcagcagaaagaaatgaagtcctctccattttaactttgcttccagcctggccaagagaaaagactttcagacttccctctaaatcagctgcagtgatagaaagcagactaggtaacttcagcatgagagggagggacctcattgcaggaagcaaaagtcacagtagagttaagactcttgaaagaagcacttttattttcttgaagaattgacagatctctgcttcctgtaatgttttgtgcaaatttctgacagtgctattttcccttcccataggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaagatgactttgatattcttcagctggattcactgatagaatgtgagttttgaatgcacatttatgaaaacaagatatagagatagcctgtgtcctgatacatctacattttttcctgcagtttctctcatacacactaatacagtctcctgttgctctcattctctctctctccccatctcttacacatacatataattatatgattctcaatttattttccagatagaaggtttattgatagagaaaagtaatattggatgtaaaaatgtgtacataaaacctgttgagtgttttaataactagatgctgttgacattaagttcctttcaaatgtacttttagtttcatgctctcaaatactgtatgctttttatccgtacactggattttaaccactctagtaggtttaatcaatttctgaagccattcagtgggaaacaatgttgagaatcatgttgctttattctaaaattaaaagctgtctatgaactagaaaaatcatctaaaatataatttgttaaaataaagaaaactgatacattctgatgaacaaacattttaaacatcctgtgtaccactaagtaatgctgacattaagcattcctgaaaaaacacttgatttccagcaacttgttgactaggtagctgaaaatagaagtgcgaacaaatgaacaagttttgctttcatactgctgtggtttgaatgtgtcacccacagttcatgtgttgaaaatttaatccccgattccatagtgttgaggggttggacctttaagaagtgattggatcatgaggtcagaggtcatgaatggattaatgtcatcacagaagtgtgtttgctatctcaagtgggtttattaccaaagcacgttgggttctctcactttctcttgcatgttctctgccctgtcaccttccaccataggatgacgcagcaagacaggccttaccagatgctggcaccttgatattggacttcccaacctccagaacgctgagaaataaatttcttttctttgtaaattacccaatctgtggtattctgttatagcaacacaaaatagaataaagatgtatactgtgccttcaagttgttatatatcacatatatatataatatatatgttacaatcaaggcacagtatactatatatactgtgaaggcatagagatagatgatagatgatagatatagatagatagatagatagatagatagatagatagatagatgatagatagatgatagatagatatagatagatgatagatagatagatagatagagatagacagacagataatctttgtagtttgctcctgtgtatcttttctcccacccacattcactgtttcagtatgccagctttttcaaaggcctttctaaattcattagtggagaatttaatgataatacagtaaaccaccactaacgctactacttaaacctatgagtaggatccaaaagcttcactgacatacaatgtcagcttgtgtttttgtgaggttaattaagtaaccagaatgaggctgctacagacagcaggagataatcacaattacatcgcatccactgcctatggtatcagttatctattgccacagtcatgctgcatgggagccataaaatcttaataataagaatttatttagctcatggtatatggggttcagctactctgggcagactcttctgatctcagttagacttgctcacacatttgtggccagctttggatcacttgagggctctgctgatcctggctgggttgcacccaggtctgggagctgattggctgttgaccaatgtggcatggttaacctaggatgactggggacacttggatgagttccttgattcactagcaggctaacctagggatgttctcatgcaatgacagaagtgtgggcatgcagaaggaggcctttgctgaaacgtggcacatctttacttcagccaaattctgttggtcaaagcaaattacacatcttggtatggggaatacatttcatgtctgtactgagagaaactgcaaaagtcaaggataaaggataggtatagctatagaaagcataatgaactggtggccattaggtttcattatgtaaaccttgagataggcaaagcggagaacttggagccagaatataaagtatccatttccttaggcttcatgtccactgctccagtggaaggaaaaggcagtagcctctttacaggggcttcttttaaaacaaaggtcgaaaagatcagccctttcactccaaactaacaaagcaatttcaaaagaaaaaacaagtaggaaaatctatcatgcctgtgcctaaagtcccaagagaagaagacctcagaactgatactaaaattaggaaaaataaaaacaggaaaggaaaaaaactgtgagaaatggaataaagatgctacaataaactgctcagatgaacctttgttcaggtttagcattaaaaaattttagctggaagaacacacaacatgtaggaggctcctcactttgaccaaatcagtagggcacatgtgctacagtgcccctcccaaggggcatgcttaaaagcatgcaatttatttgcactttgcataaacttacaaacttagctctaatctctcattttagaggccttcaaattgtggcatattttagagtatttgcagttgacacatatgcttaaattcagatattcttttagagacagcttcttttttggtagttttgaattttgtgggtaattaggagaaatgaactgacaatttgccttcagcttagctctgtcctcagaccagaaatcacaaattttgaatttgtaatggtattagagttctccagagaaacagaaccaataggatagatatagatatgtagaaagagattgactatgaaatattggctgacatgaatgtggaggctgaggtgtcccaccatctgtcgtctgcaagctggaagcccaggaaagctggtggtgaagttcagtccaaaacccaaaaacctgagaactaggggaaccagtggtgtaagtcccaatctcagcccaaaggcctgagaacccagagtgctgatgtctgaaggcagaagatgggcttccaggcttgcacaggaagaccaaatctgcccttccccccacctttttgttctattccagccttcagtggactggatgatgctttcacattggttagggcaatcttctttactcagtgtaccaattcaaatgctaatctcttacacaaacagcctcacagacatacccagaaataacattttaccagctatctgggcatcccttaccccagtcaagatgacacataaagtcaacatcatcataattaaatgagaagagtttccaggttgccatgggatgtaattacgcttagtccttgatattattttttctagggccatttttcaaaaatattaaaatattgatttttaaatgttttgtttgtttctttgcctaattaagaataggaatttcctggcttctcctataactgactaaaacatccaaggccaagcatggtggctcgtgcctgtaatctcagcactttgagaggctgaggcaggaggaccacttgaggctgggagttccagaccaaacctgtgcaacatagtgaagcccctgtcgctacaaaaaaaaaacgatttgttttaattaggcaggtatagtgatacgtgcctatagtcctagctactcaggaggctgaggtgggaggattacttgagcccagtagtttgaggttacagtgaactgtgatcacaccactgcactctagcctgggtgacacagcaagatcctatctctaaaaaaaaaaaatatattatccagttggaatgtgactgccatgtaataaatacaactgtaaggaccatttagtttctctcttccaacctctcctttattttgaaggtctggctcttttgcatacaggtaaaagcttactcatatttctcttcagatctttttttctttttttaagaagaacaatgctgtagatcgtcacagcctatttgaaatattttataactctattcctttagtgttttgagaaagcatgtactaattcttaaatttatttctcataatattgataacaaaaggaattctatatagcaattactggaaatgtgccctgtgaatataaactaattctcttgagattaatcatcaagtatcagttctctttagttttatcaccacccgtagataaattaagtggagttcctgaatcagaacagcttaggaccaaacccatacatataaggacaccagagtatatgtcactgtatttgtcctagcctcagagacgaattgtttagtcattttaactttaactggttttgcaagtttaaacacaactttatattagagcagtaaattgtggtcctcatagcaccctcctcagaatcatctggagtctcggtagactctccccaaaaatactgaatatgaagctccacagaccatgctcaggaatctgtgttatatatgtctgccggtttcagacaaatgccaccaaaataagctattgatggtacaaagctgtgctatttttaaaagccataagagaacagtccttgacagtttttgtggcatctcagaggggaaacatcttgaatgggattgcataaggagaatgctgtaatagttgaagattgggagacgtagcaaggcaaaggttttgaggcaaagattttgaagaatcttggggaaaacagctgtttgatgctattaaataatttaacagtttgatgttcatacaagtgaagttttagaaaatttttggaacagataagttacaatatagtcatgatcttgaagacagaggaatatcaaagctatgttagtgaagataatgaacgcataaagtcatgtcaatgtagagaaagctgcatgggtgtaagatgcttttggttctcagcttcttcagccagagttaaaggataaatcattaatatctggaggcaggatcaagccacaccttcaccgcaatttggagtgtcatgattatgtattatattcccaggatggtcttttcaaccactgtaagtgtcaggttttcctgttccttttgttggatgatcatttgttggaccgttacatgggacaatggctgcacagagtatgcaaaatgctggagatcacaaattcaagttctgcaacctagaagaagagctgctgtaaaaatgagctgctgattaaagcagctctattctcaaccaccacttgctcaatttcatgaacgtcgcaggccaggacttctatagtcttggtgatattgtctaactcccctgctagtatatgaaatgtagtatgtatgattcttttaattttttggacttctctcttgaaaagagaagaaagtaacccagaatgctccttgaatagttatggctccaaatcaagtcaaaatttttatccttcttgaaatgttatcaaacaatctctttgtctaagaaaaaaactgattggccaaaatatattctgattgatgtcagagattatccagaaagtgggcatcagtttaacaacacaaggagcccctaatccaggcagtagccaaaaatccaatacttgtcactggggaaccatccaataatctttctttctttcttttttagccaaaatatccctatgaaacaatggtgaacccttgccaagaaattttgaacaattttcatacaattcatcaaaagtggcatgacaccagacaatgaaatttgtagtattgatatcattagatggagataaagaaaagggaaagtgtgccttttaagagctgcaaaagtttaagacagccgtcaaatatataccctctgtttccaagttctatttctgtgaaagttcagtgccaaagactagctttcatgaaagttccccgaatatagtcttggcaggggtaggaaccaacctttctaggtaagatgttgatatgttttggctctatgtccccacccaaatctcactttgaattgtaataatccccacatgtcaagggcagggccaggtggagataattgactcatgaagatggtttcccccacactgttctcattatagtgaataagtctcatgagatctaatggtttttacaaatagaagttcccctgcacaagctctcttgcctacgaccatgtttcttgtgactttgcctctcctttaccttcttccatgattgtgagacctcgcccagccaatgtggaactgtgagtccattaaacctctttcctttataaattactcagtttcgggtatgtctttatcagcagaatgagaacaggctaatacagtgaattggtaccaggagtagttgtagaggaacagaattctaaggatgaatttatttagttggttttggggtttctggaggtggatgcttaatattattagaccccaaaatgctaaggactcgacttctaatagtatggagaacactcatacttcttggcaagaactgtttcaagggttatgcaaaataaatgcattcaatactcctaattcactgcttgtgagaggcaaggagtttagtgactctatacataacacttttgactatatgtggagaaccaaggaatataatgaagttggttggttgctcctaagttcgctaggcaaaatgatgaaggaaaacaatgaactcagggattctaactccctgttccagaagcacatactgaacctcaaatctgctaagattgccctgagttagagtcttatctcctgtagagaaagagctgaaattgtggaaaatcagacacaagctcttatcatgtgagtggctgacctgcaaagaaagggccacacgcagcctcgccagatgtctactgttaaagtgtcaacttgattggattgaattatgcaaagtatttttcctggatgtgtctgtgagggtgtggccaaagaagattaacatttgagtcagtggactgggagaggcagacccaccctcatcctaggtgggcaccatttaatcagctgccagcataaaagcaggaatggaaagagtagactggctaagtcttctggcctccatctttctcctgtgctggatgctttctgcccttgaaccacagactccaagttcttcaccttttggattcttggacttacaccagtgatttgccaggggctcttgggcccttgaccacagaccgaaggctgcattatcgaattccctacctttgaggttttgggacttggactggctccccggctccccagcttgcagatggcctaatgtgggacttcactttgtgatcatgtgagtcaattctcctaacaaactccctttcatatatacatctatcctattagttctgtcactctagagaaccctgactaatacaaatgtgataagggttttagatttccagtgatcagtccttttgtgatatttgcatttaaaaagttatctcattgttgaatccaagtacctaagaagtcaactaactcattacaaagaaatgataggaagagaagcagaatatttctcaaagggatggtgcacaaacgaaaccgtacatttggttgtatgccagttctcaaggaaattctagatagacattgaatttagacgtaggagtgactaagaatgcaaaaaaaatatattagaaagaggtgccttatagataacatagttaaaggcaaactgaaacaagcaaaagaggaaacaagatagctaggaaaataacaaaataattcattttaaagcatgatagtctgtggctttgtttcataaatccaaggtgaattcagaagtcttggtggaagctatttcctcccaaagtctgtttatagaggttaacttgaggtcttcacagaggacttcatcttccatttctaggatggtttatgcttgactgaaagacatagctccaagaataaaccccttggatttttactgtcctgctaattgttaacagtacctcaaggggtactgtgcatcagggtttcagggctgtctttctctgatataatttctagaagacccattctctaggtttcagttcatgtaaagataacttaagaggcagaaagacagctcccacctgttcacggtaggactaagtgtattgcctgaatccccagcattctttggccatggctgcttgcaatcgtgtggacatattcctaagtccagatggacacatacactcctgaataagtggcagagcttttcaaagctcttgctaagccccagtaaaatgggttttccatcactaaagtgatagataaataattcccaggtttgggaacacaaaataaaaaaatatatatttttggctactgttagagctgtaaatgtctgatgaaaggcttcaatccaactacaaattaacagatattgatcaggacatattcaaaagtcatcacagaatgcatatatatgaaatcaatttggaagggttctgaggcttggctcttgtccacgtcccatctttatagcttttattagaattgtgctgttgacatatgattcatgtatcagaggacccttgaccattttggtaaagttttgctgctgatgttgactgagtgtagaggcaaatatgtccttgctagggtggatagttccatgtaaaattttgcaaactttctttgctactgagggccatccttaaagtgcctgaaatcacccctgggaagtttgcaactacatatttcccagtatcctttctttatgctggagtcaaatcctagccttctgaaatagcttctttgaacatacccaaagatttggcttcttagggtaggatccttgtgaaggctgcctgaactccttttgtacaagttcctaccttattatagctactgccttaagaagcattagcacactgaaaattcctttaatttgctaaacatttttatttgagatttctacaaaagtcaagaacccctgttggtttgcaaagccttccaaaattgtgaactactcctaaagcttgtccactctcagtgtgtattttagctcatttatctttagctaactgacaagctctgatgagagcattaagttttagcacctggtagattttgcttctataaggagtcatattttaggaacaatatgagacctgatacagtaggttttacctaaaattatatttttctgtttagtcttaagatatggtccatcaacaaacaaaactaaatcttgatttcctagtgtagtttctcgcatatctattcagggaatagatagtttgaaaagagaggttagagagtcataggtgtccctgttttaaagaaaatgaaagaagagttgcaaaattcagtaattaatagagatatgcaaataaagagagagaaatagaacttctaggaggtaagcttacttactgatagttatcgtttattttcagtgagagacaaagaccagatattgggagggaccatcaagtttaaagaactttctaaaaatcaagtgaacagagtctccctagtttagctgctgtggctatcacccttaggcaaggtgagtagacttttgccactgagataagagagaaactgtagtgagcttttggtctctgattattcacaagaagttgaattagaacacacagggcttattcaaatctctcacattatatatgaatagacaagtttatgataattaggttggcatagaatgagatgttattgaagagttaattttaacttttgaaaggagtgtttgtgttggggttctcagagaagagctttggttaccaagggatatagtttggctctgtgtccccacccaaatctcgtcttgaattgtaatccccatatgtggagggagggacctggttggaggtgatggatcatggagaagatttcccccatgctgttctcattatagtgagtaagttctcatgagatctgatggcttaaaagtgtttggcacttcctccctgtctctcctgctgccctgtaagacgtgccttgcttccccttcatcttcagccatgattgtaagttttctgaagcctccccagccatgcagacctgtgagtccattaaacctctttcctttataaattacacagtcttagatagctttttatagcagtatgaaaataaactaatacagaaaatgtttaccagcagagtgggtcactgttataaagatacctgaaaatgtggaagtgactttggaactgggtaacaggcagaggctgaaacagtttggaaggcttaggaagatgaggaaagtttgaaacttcctagagacttgttgaatggttgtgaccaaaatgctgatagtgatacatacaatgaagtccaggccgaggcagtcttatatggagatgaggaacttattaggaactggagtaaacctcactcttgctatgctttaggaaacagactgacggcattttgcccctgccctagagatctgtggaatttgaattgaaaaaaaatgatttagggtatctggcagaataaatttctaagcagcaaagcattcaagaaatgatttggctttttctgaagcgtacaatcatatgtgttcacaaagagatgatctgaaattggaacttgtatttaaaagggaagcagaacatagacgtttggaaaatttgcagcctgaccatgtggtagaaaagaaaaatccattttccagggaaaaattctagccactgcaaaaatttgcataagtaacaaggagctgaatgttaattgccaaaataatggggaaaatgtctccagggcatgttagagatcttctcagcagctcctcccatcacaggtccagaggcataggaaggaaaaatggtttcatgggctgggctcagggccccactgctctgtgcagcctcaggacatggtgccctgtgtcccaggtgctctagctcagccatgacctaaaggggccaaggtacacctcagaccattgcttcagaggattcaagcccaaagtcttggtggcttccatgtagtcttgggcctgtgggtgtgcagaagctaagagttgaggtttgggaaccttcacctagatttcagaggatgtacagaaatgcctggatgtccagacagaagtctgtgcagggatggagcccttatggagaacctctcctagggcagtgtggaggaaaaatatggagttggagcccccatgcagagtccccactgaggcactgcatagtggagctgtgagaagagggccaccattctccagaccccagaatggtagatcaactgacagcttgcactgtgtgcttggacaagctgcaggcactcaatagcagcccatgaaggcagctgtaggggctgtaccctgcagagctgcagagcagagctgtccaaggccttgggagcccaccccttgcatcagtgtgccctggatgtgagacataaagtcaaaggagatcattttggagctttaagatctaatgactaccctgctggatttcagacttgcatgggcctgtagcccctttgttttggccaagttttcttaattggaatagaaacatttacccaatgcctatacccccattgtatcttgaaagtaactaacttgctttggatcttacaggcacataggtggaaggaacttgccttgtctcagagaagactttggacttggacattggtgttaattctggaatgagtttagactttgggggactgctgaggaggcatgatttcctcttgaaatgtgaggatatgagatttgggaggggcccagggtggaatgttactgtttgactctgtgttcccacccaaatgtcatttcaaattttaatcttcatgtgttgagggaggaatctggtgggaggtgattggatcatggggatggtctcccccatgctgtcctcatgatagtaagtgagttcttatgagatccgatggtttaaaggtatttggcagttcacctctctctttctctcttctctgctgccatgtaagacatgcctcacttctccttcaccttccaccataattgtaagtttcctgaagtctccgcagccatgtgtaactgtgagtcaattaaacct

SEQ ID NO: 2 - DNA, 585298 bp, Homo sapiens
aggtttaattgactcacagttacacatggctgcggagacttcaggaaacttacaattatggtggaaggtgaaggagaagtgaggcatgtcttacatggcagcagagaagagagaaagagagaggtgaactgccaaatacctttaaaccatcggatctcataagaactcacttactatcatgaggacagcatgggggagaccatccccatgatccaatcacctcccaccagattcctccctcaacacatgaagattaaaatttgaaatgacatttgggtgggaacacagagtcaaacagtaacattccaccctgggcccctcccaaatctcatatcctcacatttcaagaggaaatcatgcctcctcagcagtcccccaaagtctaaactcattccagaattaacaccaatgtccaagtccaaagtcttctctgagacaaggcaagttccttccacctatgtgcctgtaagatccaaagcaagttagttactttcaagatacaatgggggtataggcattgggtaaatgtttctattccaattaagaaaacttggccaaaacaaaggggctacaggcccatgcaagtctgaaatccagcagggtagtcattagatcttaaagctccaaaatgatctcctttgactttatgtctcacatccagggcacactgatgcaaggggtgggctcccaaggccttggacagctctgctctgcagctctgcagggtacagcccctacagctgccttcatgggctgctattgagtgcctgcagcttgtccaagcacacagtgcaagctgtcagttgatctaccattctggggtctggagaatggtggccctcttctcacagctccactatgcagtgcctcagtggggactctgcatgggggctccaactccatatttttcctccacactgccctaggagaggttctccataagggctccatccctgcacagacttctgtctggacatccaggcatttctgtacatcctctgaaatctaggtgaaggttcccaaacctcaactcttagcttctgcacacccacaggcccaagactacatggaagccaccaagactttgggcttgaatcctctgaagcaatggtctgaggtgtaccttggcccctttaggtcatggctgagctagagcacctgggacacagggcaccatgtcctgaggctgcacagagcagtggggccctgagcccagcccatgaaaccatttttccttcctatgcctctggacctgtgatgggaggagctgctgagaagatctctaacatgccctggagacattttccccattattttggcaattaacattcagctccttgttacttatgcaaatttttgcagtggctagaatttttccctggaaaatggatttttcttttctaccacatggtcaggctgcaaattttccaaacgtctatgttctgcttcccttttaaatacaagttccaatttcagatcatctctttgtgaacacatatgattgtacgcttcagaaaaagccaaatcatttcttgaatgctttgctgcttagaaatttattctgccagataccctaaatcattttttttcaattcaaattccacagatctctagggcaggggcaaaatgccgtcagtctgtttcctaaagcatagcaagagtgaggtttactccagttcctaataagttcctcatctccatataagactgcctcggcctggacttcattgtatgtatcactatcagcattttggtcacaaccattcaacaagtctctaggaagtttcaaactttcctcatcttcctaagccttccaaactgtttcagcctctgcctgttacccagttccaaagtcacttccacattttcaggtatctttataacagtgacccactctgctggtaaacattttctgtattagtttattttcatactgctataaaaagctatctaagactgtgtaatttataaaggaaagaggtttaatggactcacaggtctgcatggctggggaggcttcagaaaacttacaatcatggctgaagatgaaggggaagcaaggcacgtcttacagggcagcaggagagacagggaggaagtgccaaacacttttaagccatcagatctcatgagaacttactcactataatgagaacagcatgggggaaatcttctccatgatccatcacctccaaccaggtccctccctccacatatggggattacaattcaagacgagatttgggtggggacacagagccaaactatatcccttggtaaccaaagctcttctctgagaaccccaacacaaacactcctttcaaaagttaaaattaactcttcaataacatctcattctatgccaacctaattatcataaacttgtctattcatatataatgtgagagatttgaataagccctgtgtgttctaattcaacttcttgtgaataatcagagaccaaaagctcactacagtttctctcttatctcagtggcaaaagtctactcaccttgcctaagggtgatagccacagcagctaaactagggagactctgttcacttgatttttagaaagttctttaaacttgatggtccctcccaatatctggtctttgtctctcactgaaaataaacgataactatcagtaagtaagcttacctcctagaagttctatttctctctctttatttgcatatctctattaattactgaattttgcaactcttctttcattttctttaaaacagggacacctatgactctctaacctctcttttcaaactatctattccctgaatagatatgcgagaaactacactaggaaatcaagatttagttttgtttgttgatggaccatatcttaagactaaacagaaaaatataattttaggtaaaacctactgtatcaggtctcatattgttcctaaaatatgactccttatagaagcaaaatctaccaggtgctaaaacttaatgctctcatcagagcttgtcagttagctaaagataaatgagctaaaatacacactgagagtggacaagctttaggagtagttcacaattttggaaggctttgcaaaccaacaggggttcttgacttttgtagaaatctcaaataaaaatgtttagcaaattaaaggaattttcagtgtgctaatgcttcttaaggcagtagctataataaggtaggaacttgtacaaaaggagttcaggcagccttcacaaggatcctaccctaagaagccaaatctttgggtatgttcaaagaagctatttcagaaggctaggatttgactccagcataaagaaaggatactgggaaatatgtagttgcaaacttcccaggggtgatttcaggcactttaaggatggccctcagtagcaaagaaagtttgcaaaattttacatggaactatccaccctagcaaggacatatttgcctctacactcagtcaacatcagcagcaaaactttaccaaaatggtcaagggtcctctgatacatgaatcatatgtcaacagcacaattctaataaaagctataaagatgggacgtggacaagagccaagcctcagaacccttccaaattgatttcatatatatgcattctgtgatgacttttgaatatgtcctgatcaatatctgttaatttgtagttggattgaagcctttcatcagacatttacagctctaacagtagccaaaaatatatatttttttattttgtgttcccaaacctgggaattatttatctatcactttagtgatggaaaacccattttactggggcttagcaagagctttgaaaagctctgccacttattcaggagtgtatgtgtccatctggacttaggaatatgtccacacgattgcaagcagccatggccaaagaatgctggggattcaggcaatacacttagtcctaccgtgaacaggtgggagctgtctttctgcctcttaagttatctttacatgaactgaaacctagagaatgggtcttctagaaattatatcagagaaagacagccctgaaaccctgatgcacagtaccccttgaggtactgttaacaattagcaggacagtaaaaatccaaggggtttattcttggagctatgtctttcagtcaagcataaaccatcctagaaatggaagatgaagtcctctgtgaagacctcaagttaacctctataaacagactttgggaggaaatagcttccaccaagacttctgaattcaccttggatttatgaaacaaagccacagactatcatgctttaaaatgaattattttgttattttcctagctatcttgtttcctcttttgcttgtttcagtttgcctttaactatgttatctataaggcacctctttctaatatattttttttgcattcttagtcactcctacgtctaaattcaatgtctatctagaatttccttgagaactggcatacaaccaaatgtacggtttcgtttgtgcaccatccctttgagaaatattctgcttctcttcctatcatttctttgtaatgagttagttgacttcttaggtacttggattcaacaatgagataactttttaaatgcaaatatcacaaaaggactgatcactggaaatctaaaacccttatcacatttgtattagtcagggttctctagagtgacagaactaataggatagatgtatatatgaaagggagtttgttaggagaattgactcacatgatcacaaagtgaagtcccacattaggccatctgcaagctggggagccggggagccagtccaagtcccaaaacctcaaaggtagggaattcgataatgcagccttcggtctgtggtcaagggcccaagagcccctggcaaatcactggtgtaagtccaagaatccaaaaggtgaagaacttggagtctgtggttcaagggcagaaagcatccagcacaggagaaagatggaggccagaagacttagccagtctactctttccattcctgcttttatgctggcagctgattaaatggtgcccacctaggatgagggtgggtctgcctctcccagtccactgactcaaatgttaatcttctttggccacaccctcacagacacatccaggaaaaatactttgcataattcaatccaatcaagttgacactttaacagtagacatctggcgaggctgcgtgtggccctttctttgcaggtcagccactcacatgataagagcttgtgtctgattttccacaatttcagctctttctctacaggagataagactctaactcagggcaatcttagcagatttgaggttcagtatgtgcttctggaacagggagttagaatccctgagttcattgttttccttcatcattttgcctagcgaacttaggagcaaccaaccaacttcattatattccttggttctccacatatagtcaaaagtgttatgtatagagtcactaaactccttgcctctcacaagcagtgaattaggagtattgaatgcatttattttgcataacccttgaaacagttcttgccaagaagtatgagtgttctccatactattagaagtcgagtccttagcattttggggtctaataatattaagcatccacctccagaaaccccaaaaccaactaaataaattcatccttagaattctgttcctctacaactactcctggtaccaattcactgtattagcctgttctcattctgctgataaagacatacccgaaactgagtaatttataaaggaaagaggtttaatggactcacagttccacattggctgggcgaggtctcacaatcatggaagaaggtaaaggagaggcaaagtcacaagaaacatggtcgtaggcaagagagcttgtgcaggggaacttctatttgtaaaaaccattagatctcatgagacttattcactataatgagaacagtgtgggggaaaccatcttcatgagtcaattatctccacctggccctgcccttgacatgtggggattattacaattcaaagtgagatttgggtggggacatagagccaaaacatatcaacatcttacctagaaaggttggttcctacccctgccaagactatattcggggaactttcatgaaagctagtctttggcactgaactttcacagaaatagaacttggaaacagagggtatatatttgacggctgtcttaaacttttgcagctcttaaaaggcacactttcccttttctttatctccatctaatgatatcaatactacaaatttcattgtctggtgtcatgccacttttgatgaattgtatgaaaattgttcaaaatttcttggcaagggttcaccattgtttcatagggatattttggctaaaaaagaaagaaagaaagattattggatggttccccagtgacaagtattggatttttggctactgcctggattaggggctccttgtgttgttaaactgatgcccactttctggataatctctgacatcaatcagaatatattttggccaatcagtttttttcttagacaaagagattgtttgataacatttcaagaaggataaaaattttgacttgatttggagccataactattcaaggagcattctgggttactttcttctcttttcaagagagaagtccaaaaaattaaaagaatcatacatactacatttcatatactagcaggggagttagacaatatcaccaagactatagaagtcctggcctgcgacgttcatgaaattgagcaagtggtggttgagaatagagctgctttaatcagcagctcatttttacagcagctcttcttctaggttgcagaacttgaatttgtgatctccagcattttgcatactctgtgcagccattgtcccatgtaacggtccaacaaatgatcatccaacaaaaggaacaggaaaacctgacacttacagtggttgaaaagaccatcctgggaatataatacataatcatgacactccaaattgcggtgaaggtgtggcttgatcctgcctccagatattaatgatttatcctttaactctggctgaagaagctgagaaccaaaagcatcttacacccatgcagctttctctacattgacatgactttatgcgttcattatcttcactaacatagctttgatattcctctgtcttcaagatcatgactatattgtaacttatctgttccaaaaattttctaaaacttcacttgtatgaacatcaaactgttaaattatttaatagcatcaaacagctgttttccccaagattcttcaaaatctttgcctcaaaacctttgccttgctacgtctcccaatcttcaactattacagcattctccttatgcaatcccattcaagatgtttcccctctgagatgccacaaaaactgtcaaggactgttctcttatggcttttaaaaatagcacagctttgtaccatcaatagcttattttggtggcatttgtctgaaaccggcagacatatataacacagattcctgagcatggtctgtggagcttcatattcagtatttttggggagagtctaccgagactccagatgattctgaggagggtgctatgaggaccacaatttactgctctaatataaagttgtgtttaaacttgcaaaaccagttaaagttaaaatgactaaacaattcgtctctgaggctaggacaaatacagtgacatatactctggtgtccttatatgtatgggtttggtcctaagctgttctgattcaggaactccacttaatttatctacgggtggtgataaaactaaagagaactgatacttgatgattaatctcaagagaattagtttatattcacagggcacatttccagtaattgctatatagaattccttttgttatcaatattatgagaaataaatttaagaattagtacatgctttctcaaaacactaaaggaatagagttataaaatatttcaaataggctgtgacgatctacagcattgttcttcttaaaaaaagaaaaaaagatctgaagagaaatatgagtaagcttttacctgtatgcaaaagagccagaccttcaaaataaaggagaggttggaagagagaaactaaatggtccttacagttgtatttattacatggcagtcacattccaactggataatatattttttttttttagagataggatcttgctgtgtcacccaggctagagtgcagtggtgtgatcacagttcactgtaacctcaaactactgggctcaagtaatcctcccacctcagcctcctgagtagctaggactataggcacgtatcactatacctgcctaattaaaacaaatcgttttttttttgtagcgacaggggcttcactatgttgcacaggtttggtctggaactcccagcctcaagtggtcctcctgcctcagcctctcaaagtgctgagattacaggcacgagccaccatgcttggccttggatgttttagtcagttataggagaagccaggaaattcctattcttaattaggcaaagaaacaaacaaaacatttaaaaatcaatattttaatatttttgaaaaatggccctagaaaaaataatatcaaggactaagcgtaattacatcccatggcaacctggaaactcttctcatttaattatgatgatgttgactttatgtgtcatcttgactggggtaagggatgcccagatagctggtaaaatgttatttctgggtatgtctgtgaggctgtttgtgtaagagattagcatttgaattggtacactgagtaaagaagattgccctaaccaatgtgaaagcatcatccagtccactgaaggctggaatagaacaaaaaggtggggggaagggcagatttggtcttcctgtgcaagcctggaagcccatcttctgccttcagacatcagcactctgggttctcaggcctttgggctgagattgggacttacaccactggttcccctagttctcaggtttttgggttttggactgaacttcaccaccagctttcctgggcttccagcttgcagacgacagatggtgggacacctcagcctccacattcatgtcagccaatatttcatagtcaatctctttctacatatctatatctatcctattggttctgtttctctggagaactctaataccattacaaattcaaaatttgtgatttctggtctgaggacagagctaagctgaaggcaaattgtcagttcatttctcctaattacccacaaaattcaaaactaccaaaaaagaagctgtctctaaaagaatatctgaatttaagcatatgtgtcaactgcaaatactctaaaatatgccacaatttgaaggcctctaaaatgagagattagagctaagtttgtaagtttatgcaaagtgcaaataaattgcatgcttttaagcatgccccttgggaggggcactgtagcacatgtgccctactgatttggtcaaagtgaggagcctcctacatgttgtgtgttcttccagctaaaattttttaatgctaaacctgaacaaaggttcatctgagcagtttattgtagcatctttattccatttctcacagtttttttcctttcctgtttttatttttcctaattttagtatcagttctgaggtcttcttctcttgggactttaggcacaggcatgatagattttcctacttgttttttcttttgaaattgctttgttagtttggagtgaaagggctgatcttttcgacctttgttttaaaagaagcccctgtaaagaggctactgccttttccttccactggagcagtggacatgaagcctaaggaaatggatactttatattctggctccaagttctccgctttgcctatctcaaggtttacataatgaaacctaatggccaccagttcattatgctttctatagctatacctatcctttatccttgacttttgcagtttctctcagtacagacatgaaatgtattccccataccaagatgtgtaatttgctttgaccaacagaatttggctgaagtaaagatgtgccacgtttcagcaaaggcctccttctgcatgcccacacttctgtcattgcatgagaacatccctaggttagcctgctagtgaatcaaggaactcatccaagtgtccccagtcatcctaggttaaccatgccacattggtcaacagccaatcagctcccagacctgggtgcaacccagccaggatcagcagagccctcaagtgatccaaagctggccacaaatgtgtgagcaagtctaactgagatcagaagagtctgcccagagtagctgaaccccatataccatgagctaaataaattcttattattaagattttatggctcccatgcagcatgactgtggcaatagataactgataccataggcagtggatgcgatgtaattgtgattatctcctgctgtctgtagcagcctcattctggttacttaattaacctcacaaaaacacaagctgacattgtatgtcagtgaagcttttggatcctactcataggtttaagtagtagcgttagtggtggtttactgtattatcattaaattctccactaatgaatttagaaaggcctttgaaaaagctggcatactgaaacagtgaatgtgggtgggagaaaagatacacaggagcaaactacaaagattatctgtctgtctatctctatctatctatctatctatcatctatctatatctatctatcatctatctatcatctatctatctatctatctatctatctatctatctatctatatctatcatctatcatctatctctatgccttcacagtatatatagtatactgtgccttgattgtaacatatatattatatatatatgtgatatataacaacttgaaggcacagtatacatctttattctattttgtgttgctataacagaataccacagattgggtaatttacaaagaaaagaaatttatttctcagcgttctggaggttgggaagtccaatatcaaggtgccagcatctggtaaggcctgtcttgctgcgtcatcctatggtggaaggtgacagggcagagaacatgcaagagaaagtgagagaacccaacgtgctttggtaataaacccacttgagatagcaaacacacttctgtgatgacattaatccattcatgacctctgacctcatgatccaatcacttcttaaaggtccaacccctcaacactatggaatcggggattaaattttcaacacatgaactgtgggtgacacattcaaaccacagcagtatgaaagcaaaacttgttcatttgttcgcacttctattttcagctacctagtcaacaagttgctggaaatcaagtgttttttcaggaatgcttaatgtcagcattacttagtggtacacaggatgtttaaaatgtttgttcatcagaatgtatcagttttctttattttaacaaattatattttagatgatttttctagttcatagacagcttttaattttagaataaagcaacatgattctcaacattgtttcccactgaatggcttcagaaattgattaaacctactagagtggttaaaatccagtgtacggataaaaagcatacagtatttgagagcatgaaactaaaagtacatttgaaaggaacttaatgtcaacagcatctagttattaaaacactcaacaggttttatgtacacatttttacatccaatattacttttctctatcaataaaccttctatctggaaaataaattgagaatcatataattatatgtatgtgtaagagatggggagagagagagaatgagagcaacaggagactgtattagtgtgtatgagagaaactgcaggaaaaaatgtagatgtatcaggacacaggctatctctatatcttgttttcataaatgtgcattcaaaactcacattctatcagtgaatccagctgaagaatatcaaagtcatcttgtgttaaaattacttttattcaggatgaaaaatacaatatgtaaccagattagatgatagtctgtgattagttctttaccacatatttcaaaagaactacatacttacttcccattgttactgcaatatatttctttttatttattattacttagaaggttacaatgtagtgttttacgtagcttttctttaatagcagatagaggacattttgcatacaaatacaggcagaaaaaaaattaacacatgactttttaaagtaagaacaaggaagacaccaaatctacaacttggagttgagagctcagggaattgttttttctttaaataggtgctttcttgggtatgacatggcctgataaaagctctagactttgcagactgcagcagcataaagcagtttccaatgcaatggatgaagatggatctgaggtagaaaggtggtcatggctttcctttttatataaaacaattttcttcttttcaaaatatctctgctgcaaatagacacccttgccccccaacccacccaacctattctaaaataatagcaatttctaactttaagcctccttctggccagatcccagctaaagagaacccaaagttaaaatgtctttatgtttttatgtctttaggtttgaatcaaaacatattattttcacctttttttggttcctctacatttgctaattaagtaacatgtttaaactgaatcaattaaatgttaaatcagaagctaaaccaaaatacataattgaatgcactcaaaaagatgtaggtggaggtaccatcacctaagcattaatttcattcttctgtagaagcagtgacatagacttttgataaacattctttccaaatatattgatcaagtgaagggtataaaaacatctgatctttcacccgaaaggtaaaataagccgtgcactaaatgtgtgtctgctttcaacaagaaaacaactaggagtttcaagaactattaaggacttgaaaatacaaaacaacaataaaattctctttgaagggaaccaaagacaatgatgtgttctggtatcacaataggtaaaggtctgctgtgcatgtaatgatgaaaatcaagacatgggaactaggaaaggttgtactaaattttgtttctgtgtcaaaatgaaaatatgctcaagtgggcaacctttggtaatatgatctttgagattattataatgtagtcttctttatcaaatagattaagacataaaataaataattaattcctacttatataaaaagggaataaaatgcaggaaaaatatcccaaaagaaatgccatttaggcttataggatttttattacggttatccaagtggtcagcaaagaagtaagtgggcaacgtcaaataaagttaaacggcatacacagggctgtagcttaaaccatatgtgtgtatatataagatatttgattgaaatttatgaatttattaatgtggccaaatcacggaaacaaatacatggatctatttgggatctagttggttatatggctgataaacatatggctgataaattataaataaccaaaacattgtggtaaaagagtcaaagaaaaaatgaagtaattgtgcaaggttaatatgaacagcagaaggaatgtaaaaatgtaaagtggtcttctaattcttatgtaagctttgtcatagttattaaaaagacggtatcatattagaaagcccccacccactttcccaatgctgtatacattatacaaatccgtgacaaatgtattaccatttccaaatacctctctgttcattaatttacacttgcatagaaagggaagaagaaaacaataatatatggttattataaaaacaaaatatccatttctctttggatagtcagtgttttactctttcagtagaacacacagtcagcactcaacatcgtgggccaaggagccatggagcttctgatttaatggaacttggaattggcatttgctgaaaagggcaacactgtacgtcaggaaacattggttggccggatgaatacttcacattgcctatgggaagggaaaatagcactgtcagaaatttgcacaaaacattacaggaagcagagatctgtcaattcttcaagaaaataaaagtgcttctttcaagagtcttaactctactgtgacttttgcttcctgcaatgaggtccctccctctcatgctgaagttacctagtctgctttctatcactgcagctgatttagagggaagtctgaaagtcttttctcttggccaggctggaagcaaagttaaaatggagaggacttcatttctttctgctgaaggtaccaatggtgagcgaatgaggctggtgaaaatatcccatgtcttcctgggggactgtgggaggtcatctgtagagggggtaccctaacaatgccaaccatcttgatcccaagctggagtccagagaagaggaaggcaaggcaggaatcataacccaagggtgtttagtggtgccagttaaagttaaatgtcccaggtcagagacaatataaatccaggccacactcatggaagtggtatcaaccttttgaagggaaggtcaaacatttggtcttctaaaaggattttgaaattagaaaaaaataaaaaaaaagtgctaaaatgaaatcatccaaactggtccatgcctcataaatcataaaaggcctttctggaccctcaggaaagatattccatctgtctttacaccttattttatgggggactttatcctgctccctggaagcatgttcctaatgaagccactggaaaaactgcccacggagcccctccttttcccaggtatgctgaaagcagcaaactcatttgactctggcctagagcccattctccatgactattcaaatttggattcttcagacacttgcttctccattttgaacatttgattgccatgttagagggagcaaaaattcagcaaacactgatgggttccaggcattgtactgaggggaggccctcctgtgaagcaggtgtggaagatatctcagccaggcagcctcattcaattgtaatatgaggtaagtgccggccacagtaaattcaaagaagtggtttgaggacagagaaggggagagattaaccccatatgagaaaggaacattttgttacatattaatattgataactgaaactctggcgctgattcatgttaaatataaagccaagaggatttttgaattgtgcctatatactccattatccttgagaatgagatgtgtctattaattggacacacaatactgctcattttaggtgtcagaattctaaaaatttaagatcatgctatgtaaatattagcccaaccctccaggtgaaaatatatacttttcatgaatttccattcgacccaagacatgaaaaaatgaagaaaagagaagagcaggaaaaaacacatggaaagggaaggaagaaaatgggaaaggggcctcttgtattgagttacatgtttgctccatccactaagttgctgtacaactgggaaccatttagctctttgtaaactcaatttctaaaatctagaaacagagtaggaggagaaggcctcctcagataattttctgctttaaattctgagcacttgtattatatctgaggattttaaaagattctctcttccctccttgcctttgtcactcacagcctcattccacctggggaccatcaggactaacctctttgtaccctttatccctaattttaatgggccaccctaaaaagctctagactcctggttgcccttccatcacctgtattctagtcatatagagatctgcatacccctttttgtgaccctatgcctcactcttcctagctcttgaaacctgtcctataggtcatgtggcctgtgatccgcaaaacccatgttcccaaacccttctctgaatgctgcctgcatctacttgctctaatcaatatctgcatctacctgaagacacagcttccctcataaccctctcacacagcacttcccctccccattctcccccattcctcatacactgcatgagtcttccttggtcctcattggggcctctggggtatcttctttctcctctccctaaaaacacccagctttgaatctcatatcatcagactatatgactccattatgcagtcatctactgactccgtaggtcatgttccttcacttcttgaagtaaaaaatggctcaaagtcccctactctaaagccatttttaaatgttagtgatttcaacacccatggagatgattcttccagcactctggcttcttggttctttaggctcttttcctccaatggtcctgtcctccaaccttcttagccattcacacaaaggtccaaatatggaccattaccaatacttgcaacccctctaatttcagtatcattcaacctagcttctgacaaccacctctacctccacagcttacttcccctacaactgcaaatttatccatcctttgacaataggatccattgatcctcccatctttatttctgtctcccacactggacatttcctcattcctttcactactgagcttaagcatctggttcaatcattataatcacttctttgcctcttcccttgaatcactgtactcactttgtcaaaccccaacttcaactttttaaatgccaatactcagcccattctggtgcctgtgctcatgaacgtgaatatgcctagagggcaacttacaaccctgcagaatggcctcatgttaaattcatgagtggcacctttaatgctgcttatagtcacactctatttcccaggccatctgctcttctattctccaagaagctatcacacatcctccagtctctcctcgcacttctgacacctcctccccaacctcactccctgctaaagtcccggcttccaattcacttagacaacagaagcaagcaggagagaacacccacagctcaccacacccctagcctacttcacatacccttgtcttttagttaagatcccagcctctcttgccaataagacaatcattcagaaggctcattgtttcaaaaagattagtaaacaagttcatgaaagaaaatgttctccaaagctgctgtggctttgtggcacattattactaaaagtatgtgataagaaaatgtgaatggaaaacaaaatctcaggatccctaactcactatgctaaagggaaaaattaaaagtgggaactgagtcacacaaaaactaccttcctaagcagctacttgcaaagatagaaggccagtgacctccctcacaaattgctcacaaggaaatttctaagggtccccaaatctttaccctaaaacagagttttgttgaatttcaccctgacaatgtgaattaacagcttatctttacaggacaaaggcaggactagaagtcatctctcctcccaccctgagaaaaatgtgtacttgactgcttcttctactctaggcataccttatcttaattatataaaacgcagatttactgagcataagacaaatgcataattgactgttcctccaccccctcctgcctgctctttcgtttctgtgaagccctcaaaatcctttttgggaaaaaacaaaaacaaaaaacaaaacaaaacaaaaaaacaaaacaaaacaggctacaaatcctaatgaaatttatctctctttttcccaggtgtgtcctcaaccttggcaaagtaaacctgtctcatacactttttggtttatagaaaatactaaaaggcataagggtacagctgccaacagttctcagcaaaatttttaagtaaaaaattgaaatattttcccctgcaaagtaacaaaaccacctctgtggtaccagtcattttttttttaggtcaatgttctgtgatagccaccttaagtagacatttgagagagcagtggtggtcaaatctatctagagtgactttatgtagcacataagatgccattaaaaagctgttagaacacaaaggatcaaacacatggtatttttggtatctgtggcttgggagccaccccccactcccagactgacaaactgttgtacagaatcaactaacatttaaatgtcaagtaagtttacttatttacatggagaataaagtaggaataaaatcagtcgtggataatctgcttactctaggttgggatcagtaacatagagccaaccaagccattaactcttacctgtggcctgctgggaacatttgctgaaagagaaaacaaaagaaatcacttaatggcagtcctgttactttgttggttccaactctcaggcatgcaaatgcgtggaaagtatcactctacatagggtaataatagcccagttgttaaatggatgctaataggaaaaacaagaaacacattttttttttcctggcttaatgcttcaatgagggctagttttcctggttagtttctcatatcccatgtgatttaagatttagtgcatacactaaagcattcactgagcacttagtcttgcaaaaaatctcatttcctatttaaatcatactgtgtatttggtttatgtatcagaacagagcatgttctacttactttgctgagtactaattctgaccaagggaccactgaaggcataagtctttggtttctgcctctcttgacccacccttgacacaccctggaccctaacgcccaggaaaatggtggccaagtacttgcatcaaggaaagtgctggcctaatcctcagtgtccttctggacacttgggataataatagtcccttggatgggcccagttaggaacaacggagaagttagaatatggcatctaattctcctttccacacagatagctcaattcctttttggttccagagcccataacagtgaagacgatctggcgggctttgcaagggcagccactgccatctcttctctaaggcatctgcttttcgtcccctcttttgctacatgatcatctcgttctcaatgctggggggaaaagaggagatctgtcccccagtaatggcaacaatctgttcttggtcaaataaaagttgtccctagtcatctagcatgctgcactccttccatctctcactgttctatgctgagtgggagaaaggacatcagtgaccatgtgctgtgtgctgggagctatgtgagaaaaaaagagcaggcatgaagagtacccttcctataacgtctggagggaaagtgtgaggcccggtatttgggggagaaatcaggctaaaagaagcctagttctaacagatctgtaagttacatccaggagaaaagagtggacctccacagtgtccaagggatagctgagttgaattattattaagtacaccataggtttacacactctttttaaaacagacagagttatgcttctcttgcaagtaacaaatataacaaatagccaaaccctagacagaagtctaatccattttgctctaaaccaatacttttaaccttacagccttttatcaaataaaaggctatgggtatttgcctgaacaaatcacacaaaaatattttaaaaaggaaatcactgcattgcagtgggttttgggtttttgatgaatgccattcaagcttaataaacataggcaattcatagtaaaaatatgcctgtgggtcaaaaataattttgaaagcatttcttggtctatcagcaaaaattagttggcttactgccagtatttcatacatttgaaggacataagtaaaaaatggacaaaaaaaatttataccaaaaaataaaaatagttactgcagtcagtgggaattttagtaagtacacttgttaattggcagtacatttaaacccctttccttaactccttgccaggaagtgaaggaaatgtctgcttctctgctctaagactcaacataaataattttaaaaagactttaaaaggccataattcaaggatgctatcaggaccaactgggatattaattcagacaaaggagttctaaagtgttatgtgcaacaatgtgtagacacagttaaaaaacggtcatgttaaaataggcaattcacacaattaggatttatgaatacagagtttcattttaattccaagattgccaagagtggaaattcatttggggccatgctaatttttaatccacaaaggatcaaaagtcaagattaacatgaagatcaattcattgtatgctggcgacaagcatttttaaagttctcattagttacaggggctcaagggattggcttggcattgggagggtgccaatccgatttgtttagataaattctccaaaggtggttggtaagctttgggaatcacaaaggcttattaaaatatttgctggctgagcaactttaaagggacaaaagaacaaatgaatcctacaaaacgttctgagtactatctaggaatgctacaaggaaaccttcccagctagaaaatgtaatcattcactcaagtcagaaacatgtattggggccgggtgtggtggctcacgcgtgtaatcccagcggtttgggaggccagggtgggtgggtcacttgaggccaggagtttgagaccagcctggccaacatggtgaaacccgatctctactaaaaatacaaaaattagttgggcgtggtggcatgtgcctgtagtcccagctacttgggaggctgaggcatgagaattgcttgagcctgggaggtggaggttatacagacctgagatcgtgccattgaactccagcctgggcaacagagtgagtctctgtctcagaaaaaaaaaaaaaagagagagaaagacacatgcactgggcactgagtctacctcccacgctgatttctattttgcatcaatttttaaaaggtttaataattacaggcagaatatgaaaatatgtatcaattttataaataagtcaatacagcttttatttttatggaaagctgtccctgtcttgtatataataccagagaaaaaatatgaatagcagaactttcagaagccaaaaattaaaacatggagatttcaaaggattctaaaatacacttttcatcatttcatacatggatgtgcttgaattcttgaaaagaagacatgactagtaatgctcattcagaaaactatgactattataaatatttgtgaatgtgcatagttaacactatgaaaacatgaagccagctgctccaaaccaatacttttaaaccaacagctttttatcagatagaaggctaagggtattttacatacaaacatatttaaaaggaaatcattgcatttcagtaggttttgagtttttgacgaatgtgactcaagcttaataaacattaaggaatctcagggctccataaaccactctctgaacactgagaatgacattggtgaagaggggaccaatgcaggggagaggatgaatctctgtgatgtgggtcccattgaaggtactgtgtatactcctctcagaaaccaatatcaatgaacagctaacaagatccccaaccaataggaattttatacttgcctttaaagtgaggccataaaaagagatacatacatttacctgttacaattcatttttgctctaaattatgattatttatttttaataatgttctgttttaaaatgacatgggtccagcttttgtaaaatctggatgtcagagtatactttgagaaaaatttaagagtaaattctttaggaaatggaacttggaaaaaatcccacatttttagaataaaatttttaatatggaaattatatattttatatatattacaaggtgtatattgaaacacatttcccatcctggctgtcactgccaactgacttttacaattgaaaatgtccatgatatttaaataaaaacttctaaacagctttgatgtacagaatttgtttttaactaattattaaggttatttaggtataagctgaactaaaaagtaatttcctttaagaatttaattctggctcataaagactatgatgagattttatctactcactaagtaacataacaattgaaaatcaaaacctctaaataaatttgaccttgaattataattaataaactagttttaatcagtttatctattactgtggttacagagcctagaaaataagcaacaatctggtagcatgtgagcattcagtgatcctcttaagcttttgtgagactctaaaagccaaaagtgtgtctatatgggtgtgcacatgcatgcatgtgctttggggggtggggaggtggggaggtgggtgtggagactgatgtagtgtaaatgtgattctgcaaactttgagaagcattatagtagatctacaaatgaaaacctgggaaacactggcaaaacacaaatagatatattcatgtgctggtggaaaccataatataatcttcaggcaaatattcctgaaaattcacaaagaaatatatgttttatttattcatttattttgttgttgttgttgttttgagatagagtctctgttgcccaggctgaagtgcagtggcatgatctcaactcactgcaacttcagcctcccaggttcaagcgattctcatgcctcagcctcccaagtaggtaggactacaactacaggcttgtgccaccatacctggaaaatttttttggtatttttagtagagatagggttttgccatgttaatcaggctggtctcaaactcctgacctcaagtgatccacctgcctcagcctgccaaaatgctggaattacaggcatgagccaccgcacctgggccagaaatatattttaaatagctgttttcacattctgctaatgatggtattttaaaaattacaaagttctatacagtaaataataatctttaaatgaagtcaatatatcttatttacctacactcctgataattgataatctctttttcatcatttcggatggcttttttttttttttttttttttttggagaggaagtctcacgctgtctcccaggctggagtgcggtggcacgatctcggctcattgcaacctctacctcccaggttcaagcgattctcctgcctcaacctcctgagttgctgggattacaagtgcatgccaccatgcccggctactttttgtatttttagtagcgacagggtttcaccatgttggtcagactggtctcgaactcctgatctcatgatccacctgcctcgccctcccaaagtgctgggattataggtgtgagccaccgtgcccagcctgggatggcattttctaaggagatgacagacaagggtaaaataagaggctatgctttacatgaattcttattttagtgactgccctggatttaaaatcagtttgagagtaaatctctctaaaattacaaataatgtcttcaaatcctgtcaaagattatttaaaatataattatagtactaagtaatttatatgcatttatatatttgtatgtgtgtgtgtatatatatgtatacatatatacagtttacttgtatgtatatattctgctagaaacaccagaagtgttttaggtgagagctcagccaaaattgcaaggtggcaaggtgctgaagacaaaacacttggaaaaaatgaataagtaagaattattatataatttccccaggaatttggttattttctggctcttggttgttcagatggaaacttcacaggatcctaatctatgatgacttaaattgtttggcctttatacaatgactattttattccatgagaaaagaaaccagcgggaataaaaagggaaaatctgaaaacaatccctttctgcactggagtctgatgacattggagaacaatgtttgaagaaaagagagggaattacactagaaaggctgtttccatgccttgtttggcatgccactgaaagctcttctttgaactaagatgtgttccttatgatagcttgcatcgaagaggataatttcttcttaaaaccagacttattattttatttgctttcattttatcacccatcaggcatattgaaaaatctcaaagagcagaattgcgttgcgactgtacccccgttacttgatagtatctaggttgagcttcattttcttatataatgtttgccttattttcaaataatattcagtcctgtttgtaataaggtttttgttatcttaaggaagaaggcgaagggccgcatgcagaaaaagagaaagggaaggaacacgtgcagctgtggtgctgcaatctttcatactcacggcagcaagatggaaacgtgctgtgaatctgctccatgacctccgtgagatccgtgctggtgtcgtgcggtggggccagcaggtcctctcccgctgtgacagcaaataaagagaacaacaaagcttctcaaattaatgtctagccttccactaaaacccaaattcaggaggaaatactccaaccagcctctaaatatcaatgtgaaaagatttcccattgcaaaggacaattttaggggaatatacccaaaacatttttgcttgagtgttggtaatataattttacataattgacacgtactagctgtttgtttgtgtagaaagaatccacacaccaggggactgaaaaatatgagactgaaaaacaagtaatatggtcttattatttcagtgtttgaatgagaaatctattatttttgcaccacaggtatgttttcatacaaaaaaaatttcaccaatttctttttctgtcctcctttctttttggagacttcagcttaggccagcttatcctgccacaaaagtaaaggcatcttatttaagatacttttcactaggatgtgttttttatcctataatccatagtcaagatagttctcttatttaaaaaatatgaaaataatcttaatattttaatatatatattttttgagatggagcctccgtcaccaggctggagtgcattggtgcgatctcggctcactgcaacctccgcctcccaggttccagcaattctcctgcctcagcctcccgagtagctgggactacaggagtgctccaccacgcctggctaatttttgtatttttagtagagatggggtttcaccatggcctcccaaagagctgggattacaggcgggagccactgcatccagctaatattttaatttttttctggttaatgtaccaaaagatatcccaccaagaaattaatttggttacaatatatcgttctcagtaaaattctagaattttaatttaattgataacaaaatgtcattggttaacacctagtttactgagtccttcctagcatcagtgacaggtccccattgtgaccaaggacaggctgcgtgggaccgctgcctctgatgggacaggcaagacaatgtctaagtggactaggacgaagaaaagtgaataaatgagtttccacaccttggcagatacaaccataatgtttggtgtaatattattagtcctgaatatgcaccaatgtaacattttagagacagaaagtgtactaaaaaaatcattcataagcaaataatttaatttcttgctcattctaaagggcagaggaggctttttcatccaaacttcaatccacttctacagattatataaacaagtgtattatagcttatttgaaaatgtttgctttttgatattgttgaaatggatttgcacctatttaagaccaaatacaaaaaactcttttacttcctaaggcaccagtgtgtaggaatgttacttaacaggaaacacaaactaatggcaaagcacaaagcagactcagcagaggagctgtgtgctggggacaccgacctgcctggtggaactgtgggccggaggcatctggatcaagcgagtagctcagtgcagaatgctgaggagaagcccatggggaaacaccattgattcgggaatcagattcaggctggaaccacattcagaggttaaagcagagaaaggattcaaataatcataaggaaaaacatttcctttttaacttccccgccctcaccatggataattaaatcatatagaagtctttgccttcagatgttttccatacattttagcatcagcttggtgggggctttggtccttctctttccgcttggacaccttgaagaatccacttggttatgctgccagactcatttatcaacaccatttttatccctcaatttttctgttgttttaatgttaagtgaattcataagcatagttcactcatattttaaacatcagcactgggtttctaatacagtaaatttatccaatttcaaaatcagctcatactccaaggcaatattgagagagtgattagaagcatgattatggattcagattgcctggattctaattcccactctgccactcataagctgtgtaattctgggaaaactgtagaaccttccatgctttcagttctttatttgtaaaatggggagggtaataatagtgctgtgttatagagttttgtgaggggagtgaagaatgactatttctaaaatggttagaacagcctgacacttagtaaatacttcgtaaaggcactcacgcaaatcttcaatatggatacgctgacaaatatatggtcaaattagaaagtgtgagccatcatatagggaatgcagatgttacaagtttttcatgcagatttttccattaaatctatattagttgaagcctggtagttctgctagtttttactattagagttgaattttccatctacttctagcattcatcatcctaaattgtttagaagagataagagctctgcagtcttggatatagaagccatttggatattagctatctctaaaagcattgctatgtgattctcaaggcacatgagccatcaggcagcactgtctaatgggatggagggagtaggggaaggcaagggtgaacagaaaagccttttgctctcctgtgggcatcaaccagccatggcaaataaaggttttgagcacagcttccttctgtagcaattccacctatgcactaagttgttaacactaacacttcatattctaaacaagagattgcaagagaaaatccatcccttacacagcaccatttggaaacttcaagttcgcggaatgaaaaatgtaacgttttcaatgtatgtggctggcactaagtaagactcaaacattccgaagggcttcaagaaacccacgtcttgggtcactcttgggaaactcttactttccaaattgtgggattgagaggccctgaagtaagccttccattgaacagcctcacccaaattctgaaacactgagagacatagagaaaagtgtatggtcaaattatgaattgcctacacaaatttctgtgtaggtaaggcagaaatgacactgttttgaattattctggtaagttaaaaagactgagagcaactgtgaaaaggcagttttctaaaatttgagagaatcactggagagaaagttgttcctgctttgagtcaataaatcatttctggagaaaggcactcctattatatcacataggagctccacacagcacaggctagagaaaaagactaaagatgacatgcatgttgatgtcagggattcttcaagagagaggagctcttggcccctgtgctgggactctacgctctctgcacctgctgcaaaggtctctccatcactacttctgagacatcactcctattcctaactactatgtgccatcaagcacttaattccctacagtgtgctgtgtcttcacatatgaaagtatcttgctgtgatctctaacaagatggcaggcaccagaaaggcagaaactgtattgatgcttcttttatatctcaaagaacagtgtttttcaaaactgaatgcaataacccaccgatgagttatagaatcaatttagtaggtcctgaccagcattaagaaagaaaaacagaaggaagaaagggagggaggaagaaagggaaaatagaaaataagagctggcatttctctataaaggcaagtattattttgtattctccatacatgcatgtattcatcttaatgtaaattgtatttcttatcatccagaaagcttgcaagcaactcccataaaacatggtccagtgttaggaaataatagtagcaaattaataaccatctttaactcaatttcttgagaatagaaaataatgattcttggagtcagcattcttgtctcactggaagaaagctttagaatgccgatttcaggtctcttgctgttccttaatacagatgcttcccatgtataatttaggaagatatatgtcataggatattttctctcaaacagttcagagctgaggcggacttcattgttaaagaagactgggaaattccattgtaagctgggcaaacacatttttgtgtgccaatgaggatttatatgcttacatgtaaaaggaaatttctaagccagtctgaattaactacggaggtaagaaattgaaagtggacttctctgcctctcctgacacctggaccatcatctcccagggcagtggacagatggcctggggaggtgtgacgctgaattctacacaccctacctgctccagcagctgtcggaggcggtggagctgagactccagctgtttattgtgatcttctaaaatctgcatcctagcctccagccgacctttgtgctgcctgaggagttttgcttctgctataagttctgaatcctcagacgtgtgatggggagatataatcgactctggcggtgaaccgacagggagcccccttcggaggtgctggtccttcagctgctcatactccacctgtagatttctaatacagaaagagggagaaacagaatgactaccacgtgcattatcgtctctccaaaatcgtctgtgaggttcaaatttagctcatgctagttcctcttatataaaaatgtgtattaatagcaggatgagcatgcaggaataaaattgtagttttaagcaagtgtcccagtagacatcatcaatgaacccccaaatgctgctgtattgcagccagcatcccagtttgttaatagcctctaaaattttcactccactgagatttcttagacaatagtcttgaaaaagagaataaatgggggctacagtgaaattcatacaaaagaaaggatgacatatttccttctcccaggcctagcacacctttgttcttcctccaggtcagcaatgatcctctccagttctccacgttcttccctctctactgacttcaggatctgagctgggctctgcggctggctcactggggactctcctccgagtgtttggcaatactgctggatgagggcgtgctcgtcttccctagcaagacaaaggaaacagacccagaggctcacatctggatggtgatgtttttggacataaaggaagtagaaataatgatggacaggatagtggctgggccaagtttgtcttagagctcagtgtctccatgacctcccttttaaaactctaggaagaagttcatctagcagagcatggatattacatgagtcaacatttcaggcttctctttcatctaacagctctatctcataaacttcagaagggatatcttactcagcagaaaaaacaaaaataaggaacagcatttagtataaaagctactgtagacaaaatcaattactccatgcctaaagagttgattaaaagactactgaattaagaatcatctgacttcactgtctttagaatttcgttgaaagtaactttgaaatgctttgtaacccatatgacaaggtttataatccttatgttcttttatttaaatagctcagcacaaattataattgtagatatttataatgtctctacagatattttactttatattattagcaggtcatttttagggttgatcactctgcattagaacaagaaactacatttaatgcatgtgggttctcccacttatctaactacctgtctaatgaactagacatagcagtaacgtggttgaattagtaactgacataagtgaatgtctaacaaagttgatatatttatggcaagaaaatgctttctagcagactcggaatttcttatcttctttcaacaagagagatccagtgagatcttataaatgtgcaaataccaatctcctggctaatactagcagggcagtccattagcagatggcacgtggtccgttttgatggcttttggtaaacaagtcctggaaatcgatggctttacaggatagggcagcaggaaaacctcatgtcagttatgtagctatcagagtgtcaaatggggctatctcatgactgaagcagctccttcctgtgtaagcgatgggggctgcgaacatcccttagagacttcttctgttactctggagtcagacagcatcctgttgcagccagaaagaacctggtgtgtggtgctggcagtcctgggcctctctcagcttcaccagagccttgagattacctgtgcccttgagctgatgagtaacacttgatgctggggaagacctctggtacttgtaattctggtttgaaaattcatcttggtgttactgcagtttactctaacaaggaagggacttgaaattgtatcagacagttggtgaattcctagaaaaggtttatcctaagcattgagatcagagagctagatgaagcaattgagaaaactgaacgttctggtattatgcttgtcaaacagccaaagcaaaagttcagatgtgccacttgttgatttattttgctttcttcatcaataaaccccctctctttttctctccctctagaaatatatagatatagatatgaacatgtgtgtatgtgagtatatatatatttaaataaaggtcatatactttggttaaggccacaatataataataagtacctaacctgaccttcttgcttttatcaaataaattttaaaagaggatggggtgggacccttacaacacagttagcaactggaaataaggaacaccagtgggttaaggattgaagtaagctgcggcattatcctttgattccctttcctgagaaaacgcagcatcactgggaaatgaatgaaggaacctctgcaagaaccccatgcttgttcctgggtttagaaggacgagaagaagagagtatgggtactgcaccactgcagagagcagcatttgaaagcaatccaaaagctcctcagtttcccatgtagctaaatcaaacagactggcagggagatatgggtctgtgtatgtgtatattttcctcataggaagtaaatggccaacaccctaaacctagctgtgttatccggggcagaagcaagctgtaagactaatgtctcaacaccaccaggacaccaatgagctgcagtgaattacacaatgcaaagtcagcgatgcctggaggcacctcaccaagttcatgtgaagagagaggtgataaaacatgacaaaagagcagctctaacatatggataggacaaatggacaaagcgtaaagatatagtagatagatataaaataaaacagcaaaataagagttcagtagaacatcctgtaaatatttctcatttctcaggatgaaaaagatctgagtatagaaactataaagacagagtacccaaaaataataataacaaaagaagcacattcatatgtatccctggaaaatgtctgtattttaaagataaagtatcacaagcaatctgccagaaatcaaaataaaacagtaaatcatgttcagcggtggaaaaaggtttagcttcctattttccataatattaaatgtccaaagacaatggagcaatatctacagtcctaacctatccatccatatgaccaggcaggtcattcaagtgtacaggcaaagcactttgtccacatagcatatgaaagaaagaatgagcaaggataatgcaaaatggaactaaagtagatggtaatctcaggtgttacgataaaaatagaggtaaacttattctaatattagttaaaaaaacaattagttggctgggcacggtggctcacgcctgtaatcccagcactttgggaggtcgagatgggcagatcacttgaggtcaggagcttgagaccagcctgaccaacatggtgaaaccccatctctactaaaaatacaaaaattagttgggcttggtggtgggcacctataatcccagctactcgggaggctgaggcaggagaatcacttgaacccgggaagccaaggttgcagtgagctgagattgtgccactgcactccagcctgggcgacagagtgagactctgtctcaaaaacaaaacaaaacaacaaacaaaacaaacaaacaaaaaattagttctatgatacctatcaataacatacctaaaagaaaataataaatatggaaagaaaagacttaaaataagaactaatataaggacaacaagaattaaaagaaaacttggatccctttaagctatgtggctgatcttgtggccatgatttgaccacagatcctggcgtagagttcctccaagatcacaagccaccattatgccctcagaacatttactacagcacctgacctcatggattaacttcagtgcttaatattaataccaagtaaatttttgttttaaagatttggagactgactatccatagtgaaaccagccaaaattagatttgagatgtatttttgttgtcaacatacatatagattcacttctctggggaagctgatagagtttaacacattattataattatcatccccactatcattgcattctttcattatggtatctggaagagagttaaggcagttttcacaaaaataagaatttaacaatcatttatataaaacatacaattttagtcttaagtgtttttcacagattattaggtctaaatgttgaatataaaaatagatacattctagttcttaattacatatagtaaaaaccaataacaaactctttaaatgcagatagaacatgaggtaccagatcagggacattaaacatcaatcgtatgtcttgggctaaaatagaaaatgttgcaaaaataataggtttgcaccaaggaaatatcattagatggaatataattatactacagttaagtcacacatagtaaacactatctagattacaaaattagtacatatcagatgacaaaaaaactgtgattcattcaatgaacttttgaaagtagacaagacataaataaaaataatgattttctttcttttaaggattgttctgttctaggtttcagatttgcaaactgcaatgcctgtgtaaaccacagtcagcctccccattctttctttccagtgtcacccaagggcagatggcagatggagtgagacgtcctgatagccatggcccaaggaattgtccttgcgttcccacttctgagattccccagaaccgtcatgagtcctatcctgtcctgagatgtcactgctcaatttttccttcaaagatatgtagtattcgtaacatcaatttccttttaaattgtccagagtcaatcgaacgtactcatgtatctaattgtaatagatatatgggtgatcagggacatgtcatttatctttctggatgtcagcttccttgtttataaaataggactcataataatgcccatcctagggttcataggagattatttgtttccttgcatcatctagcaccttgaggtcacctgcattcctcattttcaaagccaacacagcagcatctgcagatctctctctgacctctgcctccattgctacgtctccttctctgactctggctctccttcctaccctttatgaggacccttgggattacactggggccatctggattatccaggataatctctctatttcaaggtccttaattaaaaacctgtggcaaagtcccttttgccaagtaaagtagtatattcataggcttcagggattaggatgtggacatctttggggggccatcattctgtttaccacaaatgccttcatcatgttcttctggtaggactacttatctatttcctttctagcctataagattcatggagacagtatctgcatctatagacctattgcagtattgggtgcatggcggtcgtgagttggtaaatgtttaacaggttctccaagagaaaaagaccttgatttgtggcatttgcaacttctgtgatttaaatactttttgatcatggccaatttcaagttcatgacttcactgaatgtggaactgggaaaagatacacatttgtacaccacctgacagagataatgaatcaggagtattcaatcttttggcttccaggaaccacattgaaagaataagaattttcttgggccacacattaaatacactaacactaatgatagctgatgagctaaaaaagcaaaaaaaaaacaaaaaacaaaaaacaaaaaacaaatcacagacaaatcttataatgttttcagaaagtttatgaatttgtgttgggctgcattcaaagctgtcctgggccacatgtggcctgtgggttgcaggatggacaagtttataataaataatcccaagggcatagatattagtgaaatgaagtaaaatcattagggtgtgatgagttttgagaattacttttgtttttgttttaatctaatttatttaattgtaactgtatatacatgtatataaattatttttaaaaaggctctgtttaacagcttacaaacatcctgaaaatgtaacaatcagctctcacaattggctccagcataccattacatggtaggtatatattaataacaactgtctgttggatgggtgaatgagttaatatatataatgacagtatattaaaatgtatctgactgttaatcttctgacttttttcttttctttttaaaaaatgttaatcttttctgaaacagtgctaaatctgaaaatagtatttattcctattttaagatacaatatactaaatttgagcattacctttactgtgttcacagggcatgacaaaacattttaaagaagtaagattttgttctgaattattatcttttatttcctttaacgctttggctatggtcagccttgaggaaatttgttgatttaggaaagattcaagatacttaactactttacatgaaatgcacaccagtaggttaaatatgaaacaaacattatgaatacacctttattttgatttgggaattgtttcacactcatagtacatgaatgataatgtataaatctctactacattactgtcaagtattaagatgcaatctttgaaatttgaaattgaaaaacctcctgataacttttatttataaccataataaataaaacaagttttagaaaatatggaaagagaatattctatatttgagcactttaagtattttaacctagcactctccatagtttttttttttttttagtgaaaacacccaactactatgtttgacaacttttctgtctactttacagattcccatcagatccaaaccacaatagagctttgttagtcacataagcttgacagtattagtcttttagatattattcaggattaaaaatgtgaattccagggcacaaaaaaaagaataaaaagttccaaaagtaagagtacacacaatagtgggataatcagtgataaaatatttgctgagaaagttccacaaccaagtggaatatacacatatggggaaatcagaaataaactaattggctagaaagctttttagtatataatatctttttagtattctaaagtcaatgaggcttttcttagttgctaataaaataaaatattggcagaggagttaacagttttcaatgaagggtaggagtatatatctaagtatgtgtgggtcagaggtgctaaatgcagatattatggaaaaaatgttagctagtggaagaaagaggatttcacagaaagggcacatattctgtcaaattacctttgttaaattaataagaaatataagacaaatggaatgaatatatacacctgttatcctaaataaaacaatctgattttcgtggggtatataagttgacaaatgtaagatttttttcattaacttatatgaaacaaagtaaataaacatattgagtttatactatcatggtttgaaagcataaaatctacgtagaaatttttggaaccacacttaataattttgattgggatcaagattcagagccacatcagtgaagattgtttctgacagccataatacaagaactagccttcccaggcagcactaatttcatgatttacttacacacttcctgtggtggagctgctatcagtgagaaaagacccattagtcctttccatctgggccagtctgcaaaataaaaataaggaggttagacaacatggccatataggacatggtcaattggacgtacatccttaatcatttttaaattgtcaaaattctgacaaaacatagaaagatccaaatctcctaacacgactgtaaaactaaaacgtttcatgttgagctacctttctatcaccactgccttaatgcctgtaggcctttatcttacgccatgttgtaaagtctcctaactgacctaatcttctaattgagctcccagacctaggctttccttaaccctctagttggtctacatctaagtgagcgtgacattctcaaacaaataaaatgatgttcctctcataacaaaaactctccatgacttcccttcaactaaggacatgatccaactcttcagtggctgggtttttcattatcagacctcaacttctgtgtccttcactttctcatctatttctctttcccctacctgcagttcagtaaacaaaccatgccctttcccagctcaatgcttttgagtatattattccattagtccaagactttcccctagaaattctagttggcctagacccagttcaaatgttaccatttttatgatgcttgaattaacctttctaggcaaagctacttactagaatcacagacacctagtatataccacttttctgaaagtctgtgcacaccatcaagaccagcctatatattatttagagactctaaaataaacccctatcctaaagcattagcataaatttaattacatattgtaattcacatgtgcaccatctcctgagaatacctgcaatcccactttcatttactgaaacttggttacaccatctaaatcctgcttgtacagtgtttggattctcattagctggagaatcacatcctggttaggtttacttttcatagaatatatagcaggtgtttggtaaagtgcaaactgtgtcatgaaaatatgagagcccaaattccaaatataatggaatcataactcctgcaaaactgcatttcttaaatcaaggtatattaatgatattagattaattagacatagatacattctgggtggcagtgcagtggagggctctgatcaaagtttcttaccgtgtggcatattgttctattcttgaatgggtgtcatcatgaaacagttgaggagattgtgaggggctttaaaagaaaaaaacaaagcaataattttatgcccaaatattgataggtgttactattagaaatgttaggttacttaagtaatgaatctgccatgcaaacagaccactaggattgttacccggaacacagaagtattattttagaccaagagtttagtaagacccccatgctagtaccactgatcagaacacctctcctgcacgtgggctatgaatactcactcatagtgctctggccacatactgatgagtgtgataggactgcaaagaggggagagggagacaaaagtcacagaacaaacactttagagcaatttaagacaaaagcagtgggggtgtggggagattctcaattatcttccgctcatatatgtggttgccctgagagccaccatggggaaatcaaaagtaacagaagtcacagtgtattctagagaagtcgccgtgtattcaagagtctgcaggggccttttcacagatattacaggatatttgttcaaggatagcaaacacatctttaaacagtcatactggggaaaaaaccagaatgctcaaaaataactcaaaattatagaataatgtaaagataccattctataatataccaagggggatgcaatcatatttttgtttttcctagagaagaaacttggttagaaagatgaagttaaaaatgaaacactacattatatgttgatggcagaggtgcaataaaattagacttttctgttcttcatgtaattttaaatgtaaacatccaaacccagatgtacccaaaatacctcaacctcacacacacattgaacaaacatgcaacctagataccacccctagatcccaccaaaaatgtcacatcataaataacactgaaggcaacttcctgagatcatgatacattttcttcaaaaaaaagttttttagaagtttaaactatgaatcgatgcaaaaaaacttgttctgcttgactcaggggcttgtgtctggagccagatcattcagtgtcactcttaatgctggggatgtcatatactgcctaggaagaattcccaagtctccatgaaatacttttgaaaacaactgatcctaattaaaagctagttccaaccctagctttttgaggaggaaggagagtaaatgaatgtagaacatttacagtacaaagaaaattagctatttaattaaataaaagtctgcaaaagctaacagtgtttgaaacaaaattattccaaaactccttgattctcctatttctattatacatacctacttagacaaagaaagtaggtatctataatgcctacttttctcttcatctcctatagtgaagtgcaggttgatgcctgcacagcaaagacttttgaacattatcttattgggatgaaaaactaagactcttcagatctattttcagaaccaggcatttatttatttatttatttatttattttttcttttattattattatactttaagttttagggtacatgtgcacaacatgcaggtttgttacatatgtatacatgtgccatgttggtgtgctgcacccattaactcatcatttagcattaggtatatctcctaatgctatccctctcccctccccccaccccacaacagtctccggtgtgtgatgttccccttcctgtgtccatgtgttctcactgcagaaccaggcatttatccagactgtttgtcagaatatctatactgtcagtaaacttaatttacatatgtgtaaaatagatacaataacaataaaacaacatagtattagtcaatactatttccacgtcactgttcttcattaaccctgaatatgttaaatgtcaggtgaatgatatgctatatactttctaaaaacagtaactgcttaagagattatttccaaaattcaagtgtagcaaaacatatgccacgaacttcaaatagaagaaaagtgtgtattttttttgtcttaatcaaccttgggaaagctctgtcaaattgcttgactggttcttgctaacttaatccagttagcacaaaagtgatccatgacctaaaaaatgagaatggcaagggtagagaactgaactgaagggtttctcaagttttgttatatatttgaaaaatttctaaaaaaagaaatagagataaaaaagtcaaaccttgggcttcattgacttcagaaaattttgatttgtagaaaaaaagattaaatgataagctttttcatttaattctgaaaggagaaaataagaaactgcatagttacaacctatcattacaaagccttggaaataagaacaatgtgtgtgttagcccaggcttcagaacgcagcctatccctgctctccagcatgggggctgaacaggtgattttgtcaatcacacactaatattccagaaagcagactctgctacaaatacttagatattatatgaaatgtaacccaggccagcctcggtagcttgtgcctgtaatcctagcagtttgggaagctgaggcaagaggatcacttagtatcatgtaaaatgtaacacaggccaggctcggtggcttatacctataatctcagcactttgggaggctgaggcgggaggatcacttgagcccaggtgtctgaggccagccttggtaacataatgagaccccatctccacaaaaaataaacacattagctgtgcgtggtgtcatgatgcctatagtcccagcttcttgggaggctgaaaatttcacccagaagttaatttacaaactgatacaagaaaacttgttctgcttgactcacaggcttatgtctggagccagatcattcagcgtcattcttaacgctggggggacacccccccccaccaccaacttcacatactgcctaggaatttccaaagaggaacacttgagcctgggaggtcgaggctgcaatgagacagtgagctgtgattgtgccactgcactccagcctgggaaacagaactggaccccgtctcaaaaaaaaaaaaaaaaaaaaaaagatatatatatatatatatatatatatatatatatatatataaataaaatgctatattaatatatatacatatgtattatatttgtgtatatatacatatatatacaatatatacatatttattgtatatgtgtatatatactatatatacatatttattgtatatgtgtatatatatacaatgtgtgtgtgtgtatatatatatataatggttttatatataaaacccagattttgaagaacttaatgacccttttagtgccttaaattgtcattagactcttccttgttctttgtcttctgccttcttcaatccatttgctccagagcagggtaagtgggatccctgctgcttttactcaaagacccccaaaggctccccactgctctcagaataaactccaaacactttggcatggcttagaaggcccttcattatatggttccatcttctctctccactgccatttcttgccattgttgatagttttccaccccagtttctgaaactatcttgcctccaagcttttgaaaatgcttccttggaccagaaactctccctctcaacctcccacatcaaacacatcatacttagccctattaatctttcaggtctcaacttggctgtcatacttccttctagtcggatgttaactgcaactgtagttaaacttatagtgtatttgtttcttgctatagcaaaggctcttaaaaaaatctttaaactcatttactcccctttaaccaataccagggagaggtgtctattttactttttttaatctttagggaaaccaacctatctctttagccaataataattctcacaacccttgaattacttttgctactattttagcttgttcctcagatttattttcaatggagtattctttaatcaaactctactcatttattgatttattttctggaaaattttgcatagttataaaattaatcgaataaaccttagcatggatttgtttactcccttttagtaataactcattttccccataaatcccctcctccatgcatgcatgtgtaactactgggcagaggacaaaatgctacattttgcaaggatgaaaaagaaagaagcaaaagaaaattctaattagcttcataaataacttcaacacatttgccacttcgctggtttttctccaatgttctcctcccacaaataggagaataaacaaaatcaaacttttttattacccactcacataaattgttacaccagaagattaagcggccctgtactagaaagggctcagccgaaaagtgaactatatcaaatcccgagagcttggtctaggattaaaaaaagaaaacctgcccactatatctagtagttcataaatctgtccaaaaaggatcttggtgcatctgatgcaagcttacacttcttcctttttttctcttgttttcctctcacaaaaaatgctcataaattcattttcaattgaatgaattgaggcgaggcattttcagaattacaccccaaaatcacagcacaaaattatttggcatgcttttctgttaatttttacctaatagagtcactcagaataggatgactgacaccaatgattattttgacattgaaaggcaaattaaaaatgttttaaaggagtataaaatatgcatctatctgcatgattcctgtaaagcgtgtagatatttgtgatgcaaaatgccaatggtttagcaaaagattaaaaggcacatcgcttagttcaaacctatcaaattatcccgtaaattaaagcaccaagtaataattctgtgcctcagaattatccattccaaaggttaactggatgggatacaaaaaaagtacaattttgtctttatcctaaggcatcagcacagttaaacatatattagatactaagacaaataagaatctattatcacacaaccttttgaaggaaaggacaaaagcatacccacaaatcaaaaagaggaccaaaagtctactgttcctgaatgtattcgaacagctctctttcaattgaaattgctttattaaaactttttctaaattgtactatgcaaaagaatgtttagaaagacacagatcttaattgtacacagtttgatatcaagtggaaagaatatatcttaagtgtacacagtttgatatcaagcacagtaatcacacagttgaaattttttcttaccttttgtatgtgtatgtgttatacatggacctatctaaatatgcatttgcattgtatttctttctgtttacacacacacgacattacctatagagggaaaaaggtatctcctatgctttggctgtgttctttcttctatttcttagccattccacaaataaaagagataaactggtacataaatttagcaaagtttgaggtctacagggatttaaaaaaatctattttggtctgcagaccaaatactgtattcttctattttgacatgtttgagacattgactatcacaaagcactaaaatattactacttcctgattttctatcatgtacaaaataaaatgaactatgaatctgaaggctaaagtttcatttcacaaaaattgcacttgacattttttatacttcttactacaattttctctattttttataaagtagaaaacttcacacttttgagtttctcttctctagtcatctgagacggtgtctttctctgactagaacttcattatgctatacaactgggcactctgttgatgattagtaataaaagttcattttccccaagattcaaccacaagaaaatggccttagcaggaatatttatcctgacatatgaaaaagcaattcaaagatttaaaatctatctatttggatcttaacacataattgtttagtatcttaaaattacttctttgcattttttctgggtcattgaaaaacattttttttcttttcacttcaggccataaattcttattccctttgctttataatcacatggtaatttcaccatcttgaaactttcatgtatgctaaccaactcaaattatacactttgaataaattttttctattttatgtaatatataaagctatctcagtttgctgtcttcattttcaataaaaaatagattagaatcataatgtgatactttagaattttagcataaatatctgaatcaacagattaagtattattaataaatttatattaaagagatgcaaaaagagtataaaacatactctgagaaatagtaaaacaccccccataaggggaaaaaaaggaaaataaataatgaaagactatataatgccacactttaagtgtttttaaaaagaaaagagatgaccaacaaaagagatgaccagtgtgtattaaggttgacatattaatacatatttttaaaatttaaggacatgtgcaaggttaaaattgaaattttggctgtgacattgtcaaaagtgaattgtaaaaattcatgttgtgaagactgattccaagtttaatttacctcctctaaaatgcagttggtattaaacaatttctcttgtgttactaacataaaaaagacaacatcagatataaatgttcacactagatttaatattaaaatcaaacttacgtctctaagttgtcaccttcaagaactgtctggacaggcaggtaaccaagtcgagggtgtttggcaaagtacttcttcgacctgaacttgttcttaagtacctttgtgaagtctcgtacatcttccccagatgttgtctataaggttgaaaacaattacacttctctcagtaaaatggaaggcaataactatctataacaaaatcagagccgatgtaaattgatgcaattaaatgtcaacagttttggtagttttatgcatttttgaaataaagcagtctcatgaaaacacttggcaataagaactcatcactaaatatatccagtgatatgtttatactttttcattctctgttgaaaataaaccatacctagttcatttccccaatattttaaaacttgggccaaaaagtataattagttttgaaatttttccaaactaatttttccaaactattggctggttcttatcactaaaaaaattttcaatttgctattaatatagtgatgacagagtattgtggttttaaccacaatggttttaaccaagctgtgttaatggaaattagtcatagagccgatgctggctacacacaagccagcatatattctagtggggaaaaaggtaagacaataaataagagagaaagagcagggccacattggtgctctgtttgggaaggaatactgtcaatttctttgtcctttcccaactatgcagacatataattattttacctgaactacatttttaatagtggtataaaatgtcactgttcccttaggtatttctaaatgattagtttgataatcatttagggtgatatggactaacactatcccaaccccacccaccccatcatcctatcccatgaactattgttctccaagccccagttttctactgtatatcacaattctagtttctatttacaatacagatatcaactgtgatccttccgaagatgcatttaaaatatttacattacctgcacagaacttaatgaagcccatgatcctctggctccaacttggctgctcaacctaccactcattatacctcactccctcctcttagagacagaaagagagagagagagagagagaggaggaggaggaggaggaggaggaggaggaggaggcggcggaggaggagaaggggagaaggagagagaaactttcttgtaatcacagacactgaatgataagtatatttgcttacctgctgcctgctccctgtccctgcccttcagcttttccttcacaacatgcatgcccaggactcacagaaacttgttttgcagacagaaactttttttatttttttgagacagagtctcgctctgttgcccaagctggcatgcaatggcacgatctcagctcactgcaacctctgcctcccaagttcagccgattctcgtgcctcagcctcctgagtagctgggactacaggtgcgcaccaccacacccagctaatttttgtatttttagtagacggggtttcaccatgttggccaggctggtctcaaactcctgacctcaagtgattcacctgcctcagattcccaaagtgctgggattacaggtgtgagccactgcacccaaccaaaaattgaaaaaaacaaaaacaaaaaccaaactatttttgaaaacaactaagttctgagttaacccttatatagttttgccactttctatccattccccttctatcaaaacatgtctgcttctagtcaataattaagggaacttttgattctcttggcttgcaaagcagagatgagacatgattaagccgcagctacttatcatttaaaattcatcagtttttacactgacaaaacaaacaacctgcaacaaggtgccagccccatgctatcaccaggctttgccatcagattcacaatgacccatcttttcctgaataactgaatattaactacataatgatctgcagttatatggatatagggcttcccaaatgcaaagcaaaagtgcagaagaaaaaggtattcatgaaaagaaaaagaattcaaggaaaccctgtggagaaaaaagggttgttataagatctgacggtttgagagtattcagctcttaccaggcagaaaaggaaaaaaaaaaaaacaacagattgtagttgggagcaaataaggaaacttttagagaagcaatatctgggtctcagaataaagccaaaaggatatatcatctactataaacgattttcacatcttttgcaatggttatcacaactgcagataatttagtgtagagatatgcttaccctaaatgtcttggtaaggaaggaaaaaaagaagtttccataatagaaatgcataaagaggacccgtgtataagaataagcatttatgacccaatttatttctttgtctgttcttagtacactgttaatatagagaaatacttaataagcaatggactccagcttttacttgggagtaaactccatacctagcaatgtaaaagttttgatctcttaggccagtggttttcaagccatatccaggtcttcaattcacagccctgagtggagtgagtgggtgagaggaaaggccaggtgggcaaggcatcaggccccttacccagtgtgcctcagaaagggtaaggtacagtttacacttcagtggttttcagtgaattcataaagttaaaaaaaatcaccactatctaattacaggtcattttcatcaccccaaagagaaactctgtacccatgacccttcgcctcccacaacccatggcaagcattaatctattttctctatgaatctgcttattctggacatttcatataaacaaattaatataatatatggtcttttatgacttgcttcttttacttagcatcagttcttctagtttatctatatttgagttccaacatgaactcttgcttgtgaaaaaaatgacaaattattcaaaagtgccagttcaattccacagcatacattctttagctaaatattttcaagacatgaaagaccaaagcaaaaccaccaataacaaaaacaacccctttctatcccatgcacaaaataacaaacaactacttgctgtccccaaaagttatagtagttattgaaattagagtttctaataatactcatatttacatgtttttaaaagttagtacacacacagaaatagcttatttttatttccttggggaaaagctagcacaaagagttgtaatctaagagcattaactcattattgccataaactttatgcaatattaaaagaaaaagtgaaaagtaattcatcccaaggaattagggattatattcaggttatcagaatgtaattcttcagctgggatagagccaataaagtgaatttaacccatttttgcaccgaaatgttaaaacatttatatatacttggtccaatttgatttttattatataatagtagtacctaatatttctctattttaaaatgctaaagtaatggtttggtttggaaaaaaagaaaaagaaagaaagaaaaaagagaaccacccacttaccataataaatataatcaaactcaactctgcctttacactaggtataatacatttttcttttttttaaggaaataacttttgatattatgatagaaagataaaattgaaaggaacaatcattactacacaaattacccaacattttaaatgcatttcttggaagattcggtttctgtttatttctgtaagaaaaggagaacagattttgcagatcccattagatcaaacacaagggtaacaggttagcataggaccttgtaccttataaattgttttccttcaatctcatttaaccatcatggcctctgaggagattatcatcaggtttttgaagcctaagtaaactcacactaagcctttgatggactccaaccaagttcagtaaggaaaaaaatgttcttgaaaacttgagcctttttacaagactatgtcactgcttctagaaaaatggaactgttttaagttttgaaagggaaagaatccatagccattgactaaaatatctaatattgcatcctaaatttgtccttcattttaaataatgtactgattagatgccatgtggttggttttctaaaaaattatattaaaatgtcattttataaataggctggatgcagtggctcacacctgtaatgccagcactttgggaggccaaggagggcagattgcttcaactcaggagttcgagaccagcctgggcaacacggcaaaaccccatctctataaaaaaaaatttaaaaaaaaaaaaaaaggaaaaaagctaggcatgacagcacgtgcctgcagtcccagctacttaaaaaagatttaaatggtgtatataacacgtttggtataagtacaactagaaagaaaaataaaatatacatgaaggaataaaaataaaataaaaattgccagctatttgaccatccagagacagccatttgtaaaattttggtgactagactgatttatttttagaattctttttattttaaagtaaaacaaaatatatacacaaaaaagtatggcttaatgaaatattatcagtcagaaaatggaacactgctgcacattcgagaagccgcttccaggcaaaactttcttcccctctccattattaccatcaacttcattttttgaagtagtacataacttgaattatgtttcaaaaatagttttatcactccaatgtctatccttaatttgttttgcttattaaaaaaaaatctgacatattttaaatcacttttaatttacaggtccctcctccacacctgccatttccctacagtttgtctgttggaaaactcaggcaatttgacctgcagagttttccagagtctggattttacagaatgtctatttttggtacagctcagtactttcgtctgtcctcttgataacctcctacaaatctgcaacttgatccagataatgcagcagacttttgtcaagacaattagtggtatttggcagtgttataggaggcacataatagctgtcacctctcttaggtgatcttagcagctgttcatgctaagtgtccgtatccattcattgggaattgcaaaatggtgtcattctatcattcatttttcatttattacttggaatactttgtgatggttaatactgtcaacttgattggattgaaggatgcaaagtactgttcctgggtgtgtctgtgagggtgttgccaaaggagattaatattttagtcagtggactaggagaggcagatacaccctcaaacccggtgggtaccatctaatcagtgggcaccatctaatcacttgccagtatggctagaacaaagcaggcaggagaagatggaagagcagacttgctgagtcttctggccttcatctttttccgtgctggaagcttcctgccctcgaacataaactccaagttcttcaacttttggactgttagaccagtggtttgccaggggctcttgggccttcggccacagactgaaggctgcactgtcggcttctctacttttgaggtttgggtactcaaactggcttccttgctcttcagcttgcagacagcctactgtgggacttcaccttgtgatcatgtgagtcaatactccttaataaactcccattcatatatacatctatcctattagttctgaccctctagacagccctgcctaatacatacttttataaagaaacatcaccatgtctaacatttaggtactctgtggtacagttcatttagaaaagtcaggataaatattttactgtgttgactaattttcagtatcatgaaatggtttcctattattttccaaagatgatcaatgcttttgttcattttaaatatcatgagattttaatgtatttgatgggtttcaatctattgcaattctcattattgaaggtcaagttcagttggcaacttttaatgtgactctaacagtcttcaacagcttccttattagctactattacaagatgttccaagcacaccttttaggccttttcagtgttaacaggctttttctttgcacagagctgggaaatatgcatttgaaggtaaaatttctcttgaagttacattgatgattccaattcaaatttctgatttaacttaacttgttttctaatacacctctatctccttttttcaaaaccaaaaatctggttctcaaggacacaagagatgatagacctagacaatcccataattattcatttgctttttatcatattacgtacacaatagtcttagaacactaataccaatactaccacccacatgattagtgaaaacattaaaatatagatttacttttccattttcctcccattcataaagtagttacactggcatgctttatttgtagtgatataattttgttccttatctctttttcttaaaattcctttatatgagatttggtcttgatacttttgttgctcatttttttggttgtataattaattttcctaaacttttataacaaaatgaggttgaggagagcttttctaacttcacagagattcctcttcttttgcttttgtgtggtatttacaattacagcatgtgtctcaatctattcagtctgctataacagaatactatagactgagtggcttaaataaaacagcagagatttatctctcacagttctggagactggcaagtccaagatcaaaggattggtagatctgtggtccagtgagtctgcttcctgggtcatacacagccgtcttctcactgcgtcctcccatggtggaagggaagagagagctctctggggtcacttttatgaatgtactaatttcatttatgacagctccatcctcatgacctaatcacttccaaggccccatctcctaacactatcacactagggattagatttcaacccatgaatttttgggggacataaacattccattcatagcagtacttgagtttgagacttcctggtcctgttcccccataccctctaccagcacgtaggaacagtttggactaggccttctcctttcatttctgttgccttgagatgctccatattgattctattcccagaagttttgctcagcatgagaccttctttctagaaggaagccctgatgggtccagtctgagagctcacagcaggcaagagcattctagaaatgtcacaccttttttaccctagcctctgcgcatggcaaaacccttccaggtttagctctgctctcaagccagctttccattaaatatctgttgcctattttgggggctatctggttcttaggcaccctcacttccttgtctttcctctcatacaggcagtgatgtcttgtacgttttgtggctggtggtggcttatcgccacctggatttattttggatctctcttgtcatctagtttggttgcaaacattgtacgttttagttttgctgtctagttattctctttacaaatgtctctttataaatgtaactgctttaccaatggaaggaaaatggcaaaggcaaaagacatggaaaaactctgggccaggtgtggtggcccatgcctgtaatcccagcactttggggaggccgaggcgggcggatcacgaggtcaggagatcgagatcatcctggctaacaaggtgaaaccccgtctctactaaaaatgcaaaaattagctgggcgtggtggcacatgcctggaatcccagctactcaggaggctaaggcaggagaatcacttgaacccgggaggcagaggttgcagtgagccaagattgcgccattgcttccagcttggacaacaagagcgaaactccatttcaaaaaaataaataaataaataaataaaaataaaaataaaaaaataaaacaacaacaacaaaaaaactctgatgccatgctaccaccatcttccccagatgcctctggactgattttcaacaagcacataaaaattcacatgtacaaattagggctgtccttgaaattgtcatttttggaaagctaatgacagtgactcactgtgaaaaacattttagaactgaacctacacagataagtgggcatgtgaattctgaaaatgtgctttactccactgtactgctattaagtagccgtaaaacaatgaaaacttacctgtataataagaattaatcaattttttacttgttccccaccaactaatataaatgaataaataaaatatggaaagtatcactgaattataaaatgtaccctgtgatacatctatctgtagcaaaaccctaaagaaaaaccctaaacaaaatcacttttaaggcgaaatcaaataattttttacttttgagattgtattttaccaaccaaaatacagttaggaaattttcaattttcttccattttatccttgacagagaacaaatatagatacatcacatggaacataatttagagttactctatcttttgcttgagtttgtatatctctatatgaatgcatgtgtatccttctatatgtccctgttcatattgcaaactgtataatcttactttatgctgaaatctatgcactactgaacttcaaaagcattaatacatggctgaaagttcccttttcactaatatgtatcacaagaagcagcaaggataaggtatagaagaatctagaatgtagaaaagctaacccccttcccccagtattcataatcaagtgatccttgaataaacggctttactaggtcagctcaaaggactcttattattatccccaaagaccggcaaagcaacacatgaaaggaagctatttacaatgctaccaaataacctaaatcccgtaaataacttctaattaccaaacaatttaaacaaaacaagataaagaaccacaaataaagaaacaaaacaaaacagaaaatatttgttttaattctccccacaacttttttttggggagtcacttcttaacttgagatatcagtattaactaattccttaatgctccaaacagtggatttaaattgttaattacaaatatgaataagttacatacagaggaaaacaaaggcttacaaagaggcaaatcaaggttatataaaaaaagtcacttggcacgcaaacagaataattaaacattatcatttggatcatgcacaagtgctaaaatcattgttgaacagcaccctcattagcaagagttacttcttaaatatagaaaccagtagtcccaactggtacatgcatactgctaagcggtacatttcattatcacaagacttattttaaagatattcttaacaggttttttttttttaactataaaacaacctctcagtttttatttaagtttcaatgatttcaacaagttgaaattcagacacatttgaatgccatggataggatgcaatcagtaagaaaagctcagagactttcaagccctaatgaaaatatatgaagctaaaaaaattagcattagcagaattaccaaggagtcaagaatcagtgggatgataagtcatccaaaataaaatggattttgcccaaacctcaccttaaaagctaatgacaaatctaaatgcactggacctactggtaaaacgatgtaaggagagcaggagctgaaacaccacttcaggatgctgaggtcagagaaacagccgtgatgctgcgttttcagtatattggcaaacaccccacatcacatctgaagagacaagactgccaaaaaacaaactaccctaactcaaggtagagctttccaaagaatgaatcagcatttttaaaatatttgatttttatagtcttacgaagtacattgatgctggcaggggtggaaaggattgatcaaaacaactgcttctagatttttttctttgttcttttcgggtgttttgtgtgtgtgtgtgttttatttttgccaatggcatatagttcataaaaaaaaggcacaatttatcttttaaaacagaaattcgatattttttactagaaaattgtaattcttctcactgaaaatatgattcttctcatggaaaacatgtaattttggtttatttccctacatattaatcaatatcaacaagaatacagttgaacctcttgcttttaaaacaactgtatttgcttaaaacctgcaatataaatctgttttgagtggtattaatttaataagctgtttctcattgaggtatttttttcctgttgttgcctcttctcactaaactcatcaaagttaccagtacaaactagtcctatgtaaagctcagcaactaaactatgacattgacaatgaatctacccttgcaattgaaatgctggaagtagctgatgctgttgacctttcaagctacaaaattttgcaaatatcctgtctcttctccctcagctaacatgtctctcaaactacctttctatcctggctaacctttccttgcttatttcctccttctttccttttactatttcctccattaccttgctctatttcacattttctctccatggatggggttactgtacctcactatatgcatacagcctatctatctacctttctttctccattacagtggattctgtgttcttttacacattaccttacattttgttcataattagtatttcaacctatctccttgaatcaatcccgaagctcccatgataatgccatttcctataacatctttttcatttgtggctgtataatctctttttcataacaaccaagagaaaaggatgtttacacttggcaagggttcaggacacactacctccaaatatggcacattggcagttgagaaaacagcagacgtagcaagatctctctgaccttctcccatccttcttccctaaagggtcataagacccttatttgagaggtgccctccttattcctggagggaagaaacatccttatcactgaaaacagaaggacacagaaaagaatctgaacaaacaggccttgctaagttcgcctagttcattagcattaggtcgtatcttcttattcaatcatacttctacgcaactgtccactcttcatcaaacctaagcataaaaatacacaggcttccgtttctttgggtcttctcttcctgatgaaggcttccatataatgtaaaatttatattaaatcaattcgtatgcttttctcttgttaatctgtcttttgttacaggagcctcaactatgaaactaagatgggaagaagatatttttttcctctcctacacacccttttccccttagcttcatctactaaagccaatgtgcccttcccctctcctttgatggcacaacgccagacagggctatcatctgtcacttcacttctagaaatgcagtgatgaccttctaaaagccatctcatttctagaaccttctatgtcccacttcagtcacacattggggtatggccataccccaggcctcatcataacttaaaaccacttttagtccaaaatctctaacttgaaaaaatctttcactgactggaatcttctgactcttcttctcacttcttatattataaataaacctcttctttccccatcatcttgacgtctagccctttatcccaccttgggatttcttcagcatgaggatacctcaaatcaaccacagtatcattaacaccttggaatttttcactcccttggccttcaaatatacttttcatcttttaattccaaagctgctgagcaatgatggagtcacaaactacaaatccttgtcaattaacctcagctgcactctagtggcaaggtagcaatcagtttactcatctctgtgtgactcaagattgaccctagtagctattctaaacattttccattatccttagtatttaaccctatccacttctctctcactgtcagcaattgtatgaacttttataaatcatgtgaaatttaaagaagaactctccaacttaaagaactatctttggttcagtcattatgaaaaacaatctaaaggttctttaaaaaattaaaaatagaactatcatatcatccagtaatcccacttctgggtacatatccaaagaaaataaaatcattatctccaaaaggtatttatactcctatgtgcactgtagcattattcacaatagccaagatatggaatcaaactaagtatcctacaacagaaaaatggataaagaaaacacagtgaaatatatccagtcataaaaaaagaagggaattctgtcatttgcaataacttagatgagcctggaggacattatactaagtgaaataacccagatacagaaagacaaatactgcatgatctcacttatatgtgggacctttaaaaaaaaaagtcaagctcatagtagcacagagtagaatggtagttaccaggggctggggggtggaggaaaagagaagagactggtcaaagggtataaactttcagttatatgatgaataaattctggagacctaatgtacagcttgtggctacagataatacacttgaaattcactaacagactagatctcatctcaaaaaacaaaaccacacactatcttttatatgctctaacaacatatgaaaatgtttctaatttgaattaaattttggttacttacaacaaagatgattttaaagaagatctgagtagggtaattttcacgatgaaattaaatcatcataaataaaaaagaaatttaaatctgaacatctttaatataagatataactatttatttaaaaaatgataatccctgaattcaaaggtttaatgcatggataatacaaaaaaaaattgactactctcttgattcataagcttaatcattctaaaaaatattacagtcttgttgaatttctccacatagaggtattttttctccttcatgaaattttctctctatttccaactcctagcaaaatgcctggtatgtaaaagggtattcaacaaacataatattccagcaaggatatacacaaacccctattttccaatgtgctaactgcgtgtgtgtgtgtgtatttccctaatggagttaagtcactaaatccataccattaactttgcacaaatcacttaccttctctaagacttagttttttcttcaaaataaagataagttagatgatctcttagagctttaattccagctttaatattctataactagtatttataaagtcagatacgagctcatctggcttttatgaggcaaatttaactaacacagggagaaaagtataaaagtcatcccagtcctcaaggaggtaaaaagataattgagaagacaaaaacaccacagttagaaaatgatacaagggaacatagaatcaaatcctaattggtaaagtagaggctattggcagaggcccctgaactaagtgctttgatgagggtaaaactggaggagctgggagagatttcacacacaaagtgggagttgagctgtttttgtgagaaggtgggatttggacatatggagacagaatgatgacaggcattaaatatcatctgtgtcatgctgtctcttgaagatcaactcttattaagcctaatgaaagaattcttaaatgtacaaatttggattatagaatagtagggggaaataagacaaaaaatcatttcctagagaaataaaaattctgctacatttcttcagataatttatatatacatatataaattatcaatatcataaaatactttcatgagtcatgatagttcattcatataccattagtcttcttacagctaaaggaaaacattaccataaatcataagcagatatattggcaaaatatttagggtgctttgtggatttaaaataaggtttctaaattgcagaaagctcttaaaaatagaaacattcagagtcagctgtaaaggactttgaaaaggaaagagatgaagtcagtaaggtgactggagcatcttcttaactaaaaagggagatgcagtctgaggaatgcaaacatcaaggtccatatgggaaggtctgatccatttaacactcaagtgttgcttattatcactgtaccaaacaaattcacacttgagttcattttctaaggcagacatgaaacgactttaggaaatgttgagtaaaagatggatgaaccataaataaaacttaaaagagtagagcaaatgtaaagaatgtgggtgaacagaaagaaatttcagaaagcaatgatttctgaatacttgcatttatatttttcctgttttctacattgagaatatagtacatctaaaatttgtatttcgaatgagagagaaatatgtccagacttgatacctggtttaggcacaagagtgagcaagcaaaggtttcttcaagctaatggtgacttaattattgcacaaagattacacatgaagggaatgaatataagaacaattccaatagtaaaatggggtccagttggaataggtctgattagtttagttgtaaagagatgcatctttctctgtggcttcagagaatgaatggaaagacattaatgctacaataatagcaatcagatcattcattgctattaaatgcaagtatctttttaaagattcaatttacatatatttctagttattttacaaaaagttgtagggtcaaatgcagaaagtgacctgtcatacagatgatttataagtaggctgttgataagatcactacaaagcctcagaaatgggcaaaggatgtcttgaaaaatgaagctatccttgtataatgcaggataagctgcaatcttggaaatgataaacagtgacttttgaaagactatgcaacaagaacagttttgggtaacttacagatttcatttaaaattggtagttggagagtggaattcatatgtgtatcagtgattcttaagtatgcacctactgcatgacaactgttgaagatatgtgggtttcaaattgtttaggtattttgtaaagccattaagaattattatatgttcaagaccaagaaaaatagtaattttatatatctttactataacaacatatatttactttatgatattttgatactagcattttataatcagttttctaaacttctataatagctattcatgtaaatattactatgatattttcccccaatccaaattccttacaatgatccccagggttctatacaatctgatagttgcctttctttttaattccatctcctactattgtctctcttttgtcaaatttgtcctggtttctttctgttccctggttacacccacctctttcccagcctcagggtgagcttcaaagatattgcacttatgcagttgtacagggccctacaatcagaagggctttgaactattgcacttatgcagttgtacagggccctacaatcagaagggctttgaacttcatttactcctctgatgttgccaactcggaagtcttaataattgttaaacaaggggccccccagtttcattttgcactgggcacttccagttgtgtaaccagtgctcctttccatgcgccccttggggaacaggcttcactttctgcagcccaatcacgctaacctttttcccaactcagaccactatatgttctgtttcttctttctgaaacatgcttctactagttctttacagggctgaatctttctcaaactttggtctcaactcaaatgtcaactcagacaaaccttactgatttctttatctaaaatgtctcttctaatcattctatctcattatccattcatttccttaaaggcacttactgcaatgtataacaaccccatttattcgtttccttgttcattctcacacattcttcctcctaaagggagagtagcaggaagtccacaatcttatctttctgggtatactctgatacactatcagagctgaaattactgacaaggattctctccttgaccaaatttgagttggcctcctgtaagctctgttgtctactgaagccttggcctataaaagctgcaaattttcagcacaaatcattttgtccatccctgtccacccacttctccattaaaagacttaaacaaacatgaacataatttataacagttcaagaccacatccctaggatgacccttaaaaaagggattattaaggcgtctgaccccttaaagcgtctgcctgaaaaacaaactccagactgccaaaagaatttactgttcactctagccaacacctgaagacaggtccctgctcactctttcttagggcatttactggaaagggtttacaatggggaatccttcctctgtccctttgagatgtggatgtatctccaacaactcaggagtgtctttctcaaggatctgaaaaccatttctttgaaatgtaatcatcaggaaggataggacccctgtctcccagtctctctctggaatggtagaatcctaactctgacaattgccagctcacagacacagctggtctgatggaactgatgctgaccaatgctttgtcatttttcacttccttgcctctgctcaagtccctcttttgtttccccagtctattcccttctgaaaacacccagtcacctctgtacaaacagaaatacatgtgcataatcagtatattattgattaaaatctgtccttaccactttaactagtgtctggttttgcttatctttgacaagagggcctgacacctgcaaaatgttcaatattaatttgttgagtgaataagttgataatagtaataaatgatgtctcacaaattttcttggggagatttctttttcctggttaaagctataatgtgatgtgggcacttcctccattataattcagcaatattttctacagatttcctctccatacacagggcacttatttatttgagataagatacctatgagtgtgagatttatatgtgtatattttataagtattacagcctttctgtcaatttatgatccaaaaaagtaactcaattccctaaaccaaagaaaatagacagcttgatgaatacatttgggcattatttggaaggaagtaaaagaatagctattaatagaacatgaggataacttcaggaaaaaatagctgtaaatcaaaggaaaaacaagaacttatgtccaatactggtggggcttagtaaaattgaaactttaacaaagtgtgataataatgtaaattgggataaacctattttgaaaaaaacgttgacatcaagtattttgaccataaaaaatacccatattcattgactgaaataacctacttatagtgctttattctattgcaatgtagtttacataatatctggaatgagctaccctcacaaagatacttgtaagagtgttatttataacatcagaaaattgaaaataaactatatgtccaaatttcagggaatggttaggtaaactgtagtaattcactcaattaaaaattttgtgactaaaaaaaattacactgtgtgacgaaatggaatgtcgagtgaaaaatatcagggaaaaagatacataaatataaatataaatagaatcttaaaaccagagatatggaaaaattagaaggtagtttattcaggagctagagttaggaactatatttttaatatctccattttctgtattttgctaatatgaatatggtatttaactatgaaagcataaatatgtctaaaagaaacatgatttttcgttacatagtatcattttcagtgtaggtcagtatcagctcttaaaagaatttgctaccaaaaaagtttaaaatcaaaacacagatatttaaaaaagttaatatttttttctgcactaattaattcaacataaatgagtttacttaaaagaaaaaaaaaatcttcaaagtgatattttttcaaaaaagattaagtctaaataaataataaaattttagatactagttaattcaatggcaatgtattaaaaacaaaacagtgggttagtactcacaggtatacaatattccaccattgggtaatgtaatttgtgaccttttgctgttcgacccgaaaagaaacaactctggcagacatcatagttaaaatgcttaaggcttctatacctagagaaaacaaaagaaaatttattggcttgcattactatcatttagtctaaatttgtggtaagaaatttcattcatccgaattaccaaaaaataaaatataaaattttggagttcaagtctctgaaacatgcttctatctgtttatacatgagagggagacaaatatgcatgtcagaagatttcttttaatgtttgaatacgaatggaaaatgataggcaagaaaagaattatatctattaagttgaaacatcaaattttaaaatatcaattataccaccaataagaaatgaattttaaaattccctcacaaagatacagttttcaacaatgagcacttttatatttggtttaaattagtcactagaaaaaaaagaaatcaagaaatactgtgtaacaaaggaaaaactaaataaagccttgatcacaatgcatccttgaatggaaatggtgttttaaaatctctggcgtaagaatgacactgcacattgacttgtacttgcagaatcttatttacaaaagcaaaaccttagacgataagtttctatgggtctgagtggaaaacatcttctccgaaatctgttctgtcagaattgctggtagaactaagaacataaattatacccacatctacagaaaaaaaattaaatgatagaaccaacagaatgaaaatggaagcaaaatttaaaagttgtgtggctgtaaactactaagtactgagtagcttctaaaatgacctgaaaaatcacttgcaaatcaatcttaaggaaatcattctgcatatactacagccagcttacttttgccaaggaggctattggtttgaaacaatcacatacactaacgacatctcttggcttatcagcatggcttgacaggtatgactgacatcttctttctaaatgaaattttgttttctgctgaatactcccttggcagatagccattctctctttttcattggtaacatacccttgtactgttagcacattttagcaatgagccttgagaaaattactgtttcttagcctctcttgctgatgttggtgaccagtgcaataaaaaccaaagttattgggtgggggttctaattggaatttcaagggactgagttagctgggaagaggcatgctgcctcttcctccccactggaaaatggatctgacatccagaagagtcactttgttagcatgaagtgactttgaagatggaagccacatgttagggatgacagtgcatgaaaacagagctaagggcccaggtggtcacagagaacagtcttggattacctaccttcactctgtttacaagaaagaaaactaaagttctaatttatttatgcaactactattaaggaattgtgtatgattctaactgaaacaattcccagcttacaaaacattatgtaaatctaagatttcattaacattttatttggaagtaattagtgaaaaactctagcagtatttataaaagttcggggaaaatgaaatatatatatatatatcttgggtagaagcttgatagaaagacagtctgaatgaagttaagattattctataatagacatattcctctatctttatttctgtacttgtctttccattcattctctgaagccacagagaaagatgcatctctttacaactaaactaatcagacctattccaactggaccccattttactattggaattgttcttatattcattcccttcatgtgtaatctttgtgcaataattaagtcaccattagcttgaagaaacctttgcttgctcactcttgtgcctaaaccaggtatcaagtctggacatatttctctctcattcgaaatacaaattttagatgtactatattctcaatgtagaaaacaggaaaaatataaatgcaagtaaaagtaagacaatatatcacttaccatcttccaattttcaatatcctgacatattttaagttatagctagatttcttaaacaagttgtttgcacatattcgcctatgtattttcctgagccatctttataacgacacggatagaatcctctctaagattcccaatgacttctgattcaaagaatctttctgatgcacttaacacctctaccatcttgctaaagcacactatgcgtctttatttctctgaagaatcctgttctgtcccttattatacctctctctaatcttgccttttactgagcaacatcattgtccaggtttttctggcatttccacttaatggaaatgttcaacaacacactcataggtttagctactatcacactaatgatgttattggtagtaacaaaaagagccaacatttactgaatgcctactctgtgataggaactgccctagatactttcatgtattaactattcctatgaggaaacactcatagaatttgaagttgaagaaactcaggttcaagcaggccaagtatcttattcaaagtctcagcaccaaacaatagatccaggattgaaatccaagtagcctgactccagagctacttctcaatacactatctcctgaatatcctcccataaccttaatctctgacctgctggtcaacttcacatctctatcatagagacatttacaggtcaatttgatagtactagcagaaacttaaacccttgaaatttaacacttcaggttgttcaccctttataattgctctttcatatttttcttattaaatatttcaagttaattcaaaagtagggagaatataataaacatccatgtcccacaactcagttaaatcttaatattctacatagttgcttcaggtcatttttaatttaagaaatgaaactttaaaggtcattcaaatatttaatgtttttagagtattttatcctctccttcactctctacatccatcagatgctgagaaacatggtccctcatggcatctctaggttataccaatggccatatatggcagattttatatatatctatatatggcagtctcttcccaagtcaattaatctggatctttcccatggcttcacattaccgtttatatccagagtaatatttttggtctaataattagtgctttaaatcaattgctcttttcaataccatttaattacttcttaatattaaatctctctctcctaaaaatctaatctgctttttaaaaccatcttgattaagaacacaaactggaaaaccaaagggttctggatttgaatcctaactttgtctctgcacaatcggctgcctggccttgggcaagttgactaatcttggagtcttagttcctttatgtgtaaagtagaggtaatactcccaatcttacagagttattaagaaaagtgactaaaataacaaatataacacctcttagcacattgtctggcataaagtaaacaataaatagcagtgattattagctttgatgactacatctctcatttgaattatcttcccagtagtagactgaccttgccacattccagctattccctctcccatacatctatgtctaccagatactccaaatgtagccattccaagaaccctgctgcatttaaactgtgactttaccattcttcttcttccaacatttgtgctttgacttccactggaagtcatctattaccctagctgtctgccaggctaatgctcactctacttcacactacctacctgtcttttcctcctcttagaatgcatagcagcaaggccctctgacctcacaatactttagtcttcccaactacaccataatgcatgagagaagagaacttttgaattttcatttcttatgttagccatccacagagaatgcaatgatatgcttcgtacaaactattatgctgataaagtcagtcaaatgaaaacaattctgtttaattcaagatactaatactgatacaatatacaacaacaaccaatcccagccctcctgatttgactctccctcagagaatcaccgtattggtacttgatcttctggtacgaataaaagatacacatagggccaggtatggcggctcacgcctgtaatcccagcactttgggaggccaaggaggacagatcacatggtcgggagtttgagaccagcctggccaacatagtggaacccagtctctactaaaaatacaaaaattagctgggtgtggtggcatgcacctgtagtcccagctactcgggaggccgaggcaggggaatcgcgtgaacttgggaggcagaggttgaagtgaaccaagatcgtgccactgcacaccagcttgggtgacagagtgggacttggtctcaaaaaataaataaaaaaagacacacacaaaatcttgaatttccctactgagtaggcttatgttgtttcataatagatttccaaattaaactggggctattttccagattccccccagtagagaaatataatatattcaagaggtcaaatgcatacctatgttaagaggagtggatcaggatgtccaaaaatgtccaccttaggacaaaccacagactctgcactgtcggctttggggtcacaaactgaagagtctgacacactgattacattaaagtatggcatttagcagtgctcctcatgggaagaagtcgggttaatgtacttcacatcaaacttggcagaaataacacaaagtaatttgattacttctcagctggtaattaaacattgcttcctgcttactaagtttgaccccaagacctcagaatatttaccaaattccatcagggttatatatttataatcagccatacagttttcatggatgaatcatttctgtgacctaagtaaacagacattcataaaaatctctggttctgatccaagtagtgtaaatgacaataataatagcaacaataataaaatatgcttcatgtagtagttataaaaagaaatgctacttttagatagatgagacatactgaacataccatttatttagaaagcaaacctccaaatgggaatgaatgggaatggaggatggacgtaccactgagattacacaaaggaaacagaaaatagcctcctccagcactggcacgccttacctgaacccgacaattggacattctttacagatgttgcatttggcctgatgttttgcagtctccgctgctgccactcgatgtaaaactgggagccaaaccatggactgtggttccaaatgcatccaatctataaactctttcacacttatttctggtttattgttattctggtgaaaaaagaaatatattaaaagtgaagaaatgccttcatttaaactgtagctagtgttgttgcttcataatcttctgaaaatttgtgcagaagaggaaactatataactctttccatgtcagttaagtcacaatgctttaaggttcttcaagtcaagaaaattctagaacttatgagtagaaaaagcagaaattgtcacataggaagaagcaaaaaaataccaagacttcaatatactcagattttgaaagaaacaaaagcaaaaacccaaaccactcaatttaaagtcatctttttacataaataattctgtaaaactcatttggccgggtgtggtggctcaagcctgtaatcctagcactttgggaggccgaggcaagcggattgcctgagctcaggagtttgagaccagcctaggcaacacggtgaaaccccgtctctactaaaacacacacacacaaaattagctgggccttgtggcgtgcacctgtagtcccagctactcgggaggctgaggcaggagaatcgcttgaacctgggaggcggaggttgcagtgagccgagatcacgccactgcactccagcctgggcaacagagcaagaatatatctcaaaaaaaaaaaaaaaaatttcatctaagacagtaaaaacttgtgaaagactcaccgataattttacaaacttgaaggccattataaatgctaaataaaagctgtcatttttgtgtgtcctgctctagtcccattatatcatcacacagaaagcatattgctatggatgtactttgcagaatttatcaggataaattacataaaactccccaatccctcttcaattcccaatactaagtaattttcctatgtgcaaagctaaatatctaccaattttatcctcctgttgctgttgaggtcattctgtgaacctacatgtatgactataaatcatatttagaatttgcatttgatattttttgtatttctaaaataagaaaaagggccattataaaatgtaataacccatgacatcaattctcctcaaagacacggtgtgagccttttttttccctagcaatgataaatcactggatatgctttgccaaaatatctgtagacttgtactttatgcatatgtataacatcagtagtaacatttctaaaatgtctttatatgcagtaaacattaaaaagaaatgaaagtgctttctcagtttcaaattagtaacttagatcagtataaaacttcgtacatctttcttttgtatgcatagtctcaaagaaaaaaaactgatactttaataacatctttaatgtatatatattttaaaaatcttgtcttaaaaagaactcaggacattttaattcagttctttagcagatatttattaaagtagttatgatgttcaaggcacaggaaatgtaataatctgaatatttttgtcccccaaaactcatatgttaaaaacctaaccacttaggagatggtacgaggaggtagagcctttaggaaatgattaggtcatgagggtggagccctcttgaatgaggttagtgcccttataaaagaggcccaagatctcagaaataatgccacacatctacaaccatctgatctttgacaaacctgacaaaaacacgcaatgggtaaagaattccctatttaataaatggtgttgggaaaactggctagccatatgcagaaaactgaaacttaaccccttccttacacctcacacaaaaattaactcaagatggattaaagacttaaatgtaagacctaaaaccataaaaatcctagatgaaaacctaggcaataccattcaggacatagtcatgggcaaagacttcatgactaaaacaccaaaagcaatggcaacaaaaggcaaaattgacaaatgggatctaattaaactaaagagcttctgcacagcaaacaaacaaacaaaaaacaaacaaaaacaaaacaacaacaaaaaacacctatcatcagagtgaacaggcaacctacaaaatgggagaaaatttttgcaatctatccatctgacaaagggctaatatccagaatctacagagaacttaaacaaatttacaagaaaaaaataaacaaccccatcaaaaagtgggcaaaggatatgaacagacacttcacaaaagaagacatttatgcagccaacaaacatagaaaaaaagctcatcatcactggtcattagagaaatgcaaatcaaaaccacaatgagataccatctcacaccagttagaatggtgatcattaaaaagtcaggaaacaccagatgctggagaggatgtggagaaataggaatgcttttacactgttggtgggagtgtaaattagttcagccattgtggaagacagcgtggcaattcctcaaggatatagaaccagaaataccatttgacccagaaatcccattactaggtatatacccaaaggattataaatcattctactataaagacacatgcgcacgtatgtttactgaggcactattcacaatagcaaagagttggaaccaacccaaatgcccatcaatgatacactggataaacaaaatgtggcacaaatacaccatggaatactatgtagccataaaaaaggatgagtccatgtcccttgcagggaaatggatgaagctggaaaccatcattctcagcaaactaacacaagaatagaaaaccaaacaccacatgttctcactcataagtgagagttgaacaatgagaacacatggacacagggaggggaacatcacacactggggcctgtcagtgggtgggggactaggggagggatagcattaggggaaacacctaatgtagatgatgggttgatgggtgcagcaaaccaccatggcacatgtatacctatgtaacaaacctgcacgttctgcacatgtaccccagaacttaaagtacaaaacaaacaaacaaaaaaagaggcccaagagagatcattcacttcttctgtcatatgaggaaacagcaagaaaggttgcaatgaaccagaaggtgggccctcagcagatactgaatctgctagcaccttgatcatggacagcctccagaactgtagaaaataaatttctgttgtttaaaagccatccagtttatggtattttgttacagcagcctgaatgaactaagacaggatacaacagtaaaatgatagccgtagtccttgtcttcatggagcttaggttcctagagaagaaacaaacactaagccatgaattatataattcagtgtgtaattataattgcactgagtatgagaaggaagaggtggacgatattaggtgaatataataggaaaatacagcattatctgaagaggtcagagaaagattttcagaggatgtaatagctaaagctaaaatctaaagatcaaataaagattaggtatgagaagggaggtagtgggcaatggggaaggaagaacgtctaaacagcagacacaggtccaaaggcactgctgaggcaggaatcaaggaaataaaacagtgcagctggaaagcggagagcaaggagaggaatggtaggagatgaggccaggaaaagggcaggacaaacagcaatctaatggcacaggttaaagattgtagattttatcaaagaaaaacagcaagtctctttgcaagggttgctattttttgaagcaaatgagccttaggaaataaaatacaccacttgttggatggtacccaaagtcttccagtatttggctccagcccgagttccctattccatgtctcagaacatcctcaaaacccttcgccaacacatcctacacaccagtgatccttcatgcttacctgttggaagcagctgcgaacactaggctcaatattactgcctccaaaagctgctacttcacctagctgccgggggatctggatggcatcatgaagtaacaggcccagctgcctctggtcacacatttctgttggccctgcaacttccttaaagagatctgcaaagagaggcaagaggttaactttcatctgtctaccatgttcttttacttaaaatatatctttggtaatgtggactgaaccatgcagattaaaaaaatttcagaaggacatgaatctgattcgttgtctcctgaattccaatgaccttaatattctgatcttaatattctgcattacatatgatattagattattttaagaagcatgtagttaacccgttcctgcaagaatgggttatgtatacatataaacataaatcatgcatatataatataaatcaataaatgcaaatttcctttttaaaatgatacaataaatgcatatgaattaattttatgatcttcataagaactccccttcttattgagaaagaatgagccaaaacaaagcttccttcatgacttgtcaaaggaatagatgtagttgggtgctgtggtgcatgcctgtaatctcatctactggagagactaaggcaggaggatcacttgagccaggagtttgagaccagtttgggcaacatagcaagaccccaactcaaaaaaaaataaaaaaacacaaaggaataaacgtaccttaaataacaaacctttaaattttaacagatttgtttacaaactttgtgtgttcactcctaaattcaatattctactaaatgtatatatattataacttattttaaagacttttatactcacatctattttatataagaaacactaaaaagtacaagaaggtgtgttttttctcctttgggccagtctcccattccttattagctataaccactatttttgttttacttcatgtaatgaaatacatttaatcaaatttaaaaatttgtgcatattttcatacagtttttaggtttttccattcattaaaaaactgatttgttttataattttcttaattcagtaaaattaaaactcttctattttgtccactcttggtttaccttttattcaccatatacaatactttgaagatcaaaattatatattattttcaacaataaagctaatatcctaagataagttacttttggaagaggaagaaatttcaaatacaaacaatctacttcattatagaaattaatactttttggaaataaattttcaagttctaaaaattcaaaagtacttaaaatctaaatgctcttcatgtgacattttccaagaatagaagaaagtggagtaaatatttattggattctaaaactattttcaaacagtacctgatatcagatcaaaatgcatcattttctctctctctttttttttttgagatggagtgttgctcttgttgcccaggctggagtgcaatggcacgatcttggctcgctgcaacctccacctaccgggttcaagcaattctcctgcctcagcctcctgagtagctgggattacaggcatgcaccaccacacccagctaattttgtatttttagtagagacagggtttctccatgttggtcaggctagtctcgaactcccgatcacagttgatctgccctacatcggcctcccaaagtgctggggattacaggtgtgagccaccgtgcctggtccattctctctttttataaggaatataatgctagatctaacactgtcagtggtgaaatttcaaactgaaccaagctcagtgatattgacacagtaattataatgaagtatggctttaattataagcatacatagggaaagcaaattcaatgaagataaatttgatttttattataattttttcacttagatttggttagagctctacttatttctttccattaaaaacaataagactatcatagacaaaaatatttatccagtagtcttagcatgatgtttattttaaaccagtccctgggaagaggtctgttaagtaaataaaagttgatgcatatgtataataatctttgcagaaaagtgcacattttcagcaagatcaactatgcccaactttcctcttttgaggcatatggctataccactatgccactattaaagtaaaactactcacaaaacataaggacaaaagtgtccttagacattttgacatatttctataaatccttataaaagttcctacaaaagttcacattctcaacattatagtaagatacaaaaagcagtgtcagggtaaaggggcaggtaataagaaagtcataatctaaaaactcaaattctaataaataagcacagaagagatactaatgataatttaaaaggatggtttgaaaatgtgtactttttttttttttttaaggtctcgctttgtcatccaggctggaagtgtggtggtccgaccatggctcattgcagcctccgattcctggggctcaagtgatcctcccaccttagtctcccaagtagctaggactacaggcatgaaccactgtgcctggtctgtaaatgtgtttttgatgaggcaaggaagctagccagctataagcataaaggccagggcactgttagaaactaaacaaggaatattcttaggaaaggaccaagagaagaaggtgttatggggtgaagacactgacattgggcattgtattaataaaatcaatgttcagacagataccaatgatcttgaatggcggccctgccattgcatttgaagagcaaactgtcttgaatattaattctaataaaggaaacaataatgatatcacagaaactggaatcagagtggtgaaggtcctcaaagtaaaaagcaaaataaaaccccaggacattccaaagtctagatatcccagtaaagatttagattaaagattaaaacccaagagatttcatatttaattagttctaaaatggcatacttcctggattcaattaaatatcagaaatttcacggcagagccttctgcttcccctgccaaaatctgaaagttaatgttgaattatccacaatgtaagctttgaggttgaatttgcaaatatttcagagtaagctccacactataactgttactttcagagaaccctaattgtttcagaagcacaagaaaccccaaatcagagatgataaaaaatccatttctaattttgtaacattggtgttttcattaacattttcctttcctgatcattataaaaagataacgttttcagctgttgaaattatatcttttcatgattatgattccaaaaactacttcaattctggataaagtgccacaaagcaaaagtcttgggcaaagctttcttctgcatggctaactaggctctcactccgtcatagcaccttatctcctaatcctacaatcagcttttcattttatataaatccacatttcttttcactgacattcttgtcaaactatgtagaaaaaacaagccatcatggtctagacctgaaattcaaaatccaataacctcacagaaatcccagaaaataaaagcttttaaaatgtatgcatgttgacataagacacaaaacttaactcagtttacagggcctataatcaaacatcctattgttttttagtatctctccattcatggaatatccctaaacctctcccacaaatgtatggatttatctgtaaagaatcatctgggaatatgcatggtgggatcaaattcacattttatggacaaaaataaatcaaaagatatgtgatagtagttaagggtttggggactcagcagcaactgctaccatttattcaacaactgctatttctaggtaccttaaacattactcctaattattctccaagcaggaattattagcttcattttttcagttgaagaaaatttgctaaatttcagcttcttgaactgtaaaattggaatactattacctcttagttggcaatattcaatgaaatcacataacctgcccaaagacactcagctactaagtggtagagatttgaagacaggtctccttggctcctgaacacaagtcttttccaaagccaatatacctttcattaactgacaggtaaaggaacactgttgatttatttgataaatccaaatataataaaaatttaaaaatcatgttttattttgtcacagctgtaaaatatatttatttaggattatcgtctatgactgtaaaggttctagttcatctttttcttttaagcattggaagtataaagaaataaaaaaaagtttaggctttggagtcagaaaaacctagtatctaattctagccccatcccttatcagctctgcagtcttagactagattcttaacctatctcagcattaattttctcagctagaaaatgaaaatctcaaatgcctacattatggagggattattctaagaattaaatgaagtataatttgtagttgggtctcactccatcctggcacctcacctcttagttataatcagctttccatttcacacaaagccccaagtctttgcactgccaccctctgtctaacttggtataggcacagtaagggttaaaaaaagagagagaactattactactaacaaattatataatttaagtttccaataaattgttataatcattattattactaaaaacactgttggtataagaaaggtcttacatacatctgtatttttcttccaagagacctttggagagagacattaatccaatcttcagactctgcactctaatttttccagttcgacccctaaaattataagaatgttaatgtgttagatgcatttaaaaccatatacagcatgttcattgtttctgaatatctattttcttgggggtaaaccatcaaaaataattgtatcttaaagatgcaacttttctattaacttttaacaattaatattaaaccaatactgtaatttcatgacatatattaacagggtgtttggccaaggctagaagaacacacagcttgaagccactttgcacacaacacataaactaagaagaacgaactaaagcaaaatgaaaatgatgattataaagctgaaaagatttcacctttaaaaatattatgaattggctgggcacagtggctcatgcctgtaatcccagcactttgggaggccaaggcaggcggatcacctgaggtcaggagttcgagaccagcctgacgaacatggagaaaccacatctctactaaaaatacaaaattagccaggcgggtggcgcatgcctataatcctagctactcgggaggctgaggcaggagaatcacttgaacttgcgaggcggagattgcagtgagccgagatcgtgccattgcactccagcctgggtgacagagcgagactccatctcaaaaaaaaaaaaaaaaatactatgaattaaacctatacgttaataattgtagatgcaagattcaaaacagctagagctacgcacactatatatatatatgacttcatacaggaagaaaagtctagtgatatatctaaaaacaagaacacagactagaaaattaactatatactaagagcttacaacttgctgaatactaattggtaattaagtattaattaagtataaatattggtatttaagtattcagcaaattataagccctcagtatatagttaattttctgtcaatgcagtttttataaattactattgcaattttaatagtcagtgatcttagacagatgtgaaatccctatttggggaaatatcaaattataattaaaaccagaatgtattaattaatcaacattagaacatagttttacacaatgctaaggatagatcatttctatttcacttataagtcgaccagatgaaacatgtttttttatctttaaaaccaaagagttttcttaatttcattgcttatcaaagaattactgagtaatctaccaaatgttagtcacagtagtcccagtcctagggattggaagataattacaaaaattaataagatattatccttgctatggaataacacatagcccagaaaaaaagcctttattgctatctttattattacacatttaggatccattttcattttaggtttttattgtccattttcttatatgtttttaatacacaagtacagcacacttaaaacctataactaaaagtttacataaatatatgaatgtataaaagttaacaatttgtgctattttaaaaacataaatatttgtatcacgtaactttaattttaagcagtcttcttgccaaactatatttaatcattgattttattgatatttttactacttacactaattgatattcttccattctcaactatatgtactgaaggaagtttctgtacgcatattatgacatataaagtatgcaataaataagaaaggaaatcgtgcttagggattggtgcaatgtattttcaaagtactccctcaataggatagagtttataatttatattaaatcatatctaataaacttactgaacccttagtatgtaggtatatgacattcagaattaacctatgaagtgactaatacttaatattaaaataaacatagcccttctaagcagaatttctaaattaatataatcatttctcacaattacagaaacaccagtttcacattaaccctacagacagccatgctacaaactgtgtttctactttatattttttagaagtttcctaattatcacatgaaacagacaatgtttgcttcctttcaaaagcaggaaatttttactctctggacccagtcagacaatagacttgcagaggataacagaaggctttgtgaacgggctgagacaagtacatgaatgtggctaaggataaagtgatccctacagggaaaaatggtcaaaataatatgcattaaagcatgactcccactttactgtcacaacacaagaaaggaatatcatcaggaagacaactgatgctgtcaatcacccattcatcacaccatcaccagttacaaaggcttactgtgatcctgacattgctctgtgtactgttgggaccaagagaaaagcagaagacatgattcctaccccgatgaactcacacactagctgaggaaggtaagataggaatacaactagaaaacatatgagacaatcctttatgtatggaaatcaaacatcaagtacaagatcattgtggctgcctatcattagtgatttagtctaggtagtcattagtttcacaacatgtgacagagaagataaacccaaaatcagacatagaaggtatgtcatgccatgacagtcccaagtaggagaacatagagtatcacagagaaagcctgagcaaaggcacagaggcaggggtgtgagcatcggagataagacacattcaggcccggcgcggtggctcacgcctgtaatctcagcactttgggaggctgaggcaggtggatcacgaggtcaggaaattgagaccatcctggccaacatggtgaaaccctgtctctactaaacatacaaaaattagctgggcgtggtggcgcgtgcctgtaatcccagctactcgggagactgaggcaggaaaatcgcttgaaccagggagtcagaggttgcagtgagctgacatcatgccactgcactccagcctggcgacagagtgagactctgtctcaaacaaaaacaaaaacaaacaaataagatgcattcaggtgggtcagagacttgcatcaaggttaactggttgactgaactgtacaggttacgtgggaccagacaataaaggacactgatgtaaataagctacatggatgtgagagacaagagggagacagtaaaatatattagtgagtgacatagcccagtgttgacatatttagtctcctgatagttttcataggcaactctttaaactggtttaactataaagacatttactttataaaattataccatctttggaatagtggaacaaatgacactactgcaaatgaggttaatatttttggtagaaaaaaacacatttaaaccaagtactacagactattgctttatatcatgatttaaacacttttgatttccattaaatccagaaggaagattgtgaaattaagaccttttaatctggtaagatgactgaggctgcaaattcataaatgaaatcaattttatctttataaagtactttttacatatattagttcatttgcccttcataatcaccttttgtgtggtaagcagagtggatatttttatttcaatttttcagatgaaaaattaagatgccaatgttaagtagctgccaactcacacagcaaccagaaccaaaaatttgaattcttgtcatccatgacagatgaaaataaattttttttacaaagttcagaatatcaggaggtgggtacatgttaaaattggaaaaaaactgttcacttaaaataaagtactatgtttcctagatatagaaatatagtaagaataatcaaatgattatcaaaagactgaacactagttctttaattatgactaatatgcaataggtagataaattctcctgtctcaacgggcaaggttttcaattagtaaagagaaaagggcagaattaaagatccccaaatccttctactttgagaattctgtgatctgtgtgtgcatcactcattatcaagagctggctgaagctgaaaacaccagttctggctgtatcacatgccaggaaagaaggcagtcacgggtatatgattagtgagtgaatgtcaggacggctgaatgaatagaagtgttagaacaaggtaccattcctcagattcacagatgtatgagtctgtaatgtcctaattggagggtagatagtaatttctatctgattctcaaagaaaattattggttgaaaagagttaataactattatttagattaataaataaatcatggttgttagagaaacctgggcaaccagctctggccgtctgacattactgtcataagaataactgttttttccatagattaatccccaatactctctccaagatagaaagctacactgcatgggcaccattctgatccagcatggtctttgccatctttctttttcatagaagggaggttagtcctgaaagatttttttcctttaaaatgaaaaatgagaaatttcaagatactgtctttctaaatgagaaacagtggcaaattgtagcatttcccacatattcccatttgatggaggcaagtggaactgtgccaacatttaactccctagaatatgaatcacggcatttcacacactgcttcctcccaaccaagtggcactattccctttgggctgtccagtgaaaagagcatatgtgtgcattatgcactgaactgtgtcccctaaaatttacaggttaaggtcctaactcctagtacctcagaatgggactgtatttggagatagggtctttaaagatgtaattaagttaaaatgaggtcattagagtgggtcataatctgatatgactggtgtccttagaggaagaggagatgagcacacatcagacaaggaaaaaccatgtgaagacacagggagaagacgatcatctgcagaccagaaagagtggcttccataaagactcaacccagccgacaccttcatctcacactctcagtgtctagaactgttaggaaataaatttctcttgttgaagccattcagtctatcattctttgttatggcagccccagaaaaccaaaacagtgtgtcagagccatggacaatataaggcaactgaacctcttctccagttcttccttaaaatgtagttcaagatgtatacctctaccatattctataggactgaatggagttcctaagtattctatgaatttagcaattttcctgggatgtaaaagttaagttacaggttttgtagttaaaacacctttgaccaactattttggtgaatttactatgaaaaagcatcttctgaggattcaaattattgaagagcaacttaatggtggattaaggctaatggtaatattttaccctaggagaacttaaaatgtgcattaaaatgaaatgtattaaaaaatatcagacagagatatcgcaaatcccgtattcattatggtaactgagactcatgcttcagcaggtttcttaagagccctcaagcacacagtggctgattatttagaaagactttgttatgatatttatgaacactaaaagataaaatacttctctaattaaaaaaaatcgagagaggaggacagggaaagtttcattaattggtacaaaagtacatataggtagggggaataagttctagtgttctatagcactgtagggtgaatatagtaaacaataatttatttcacaggttcaaaagatagaacagaggattctgaatgtttccaacataaagaagtaataaatatttcaggtgatggatattttaacttccctgatttgatctttacaaactgtatacatgtattgaaatatcactgtgtacctcataaatatgtacagttattacatgtaaactaaaaggaatagaaaaaaaatccagatttttagtcagctcattgctaaagctactgtcatcattatttacttcctatacagaaccaatcagctcctgaatgtgtgcatttatgaatgatcatctatcttatttatctctaaatcaaaggttggtaaatagaagttttcatgtagctaattaatagataataactttttgggcatgagaggcaaaacaacagttctagttttcttttctttttttttttttgagacagagtcttgcactgtcacccagactggagtggagtggcacgatctcagctcactgcaacctttgcctcctgagttcaagagattctcctgcctcagcctcccaagtagctgagattacaggcacctgccacgatgcctggctaatttttgtatttttagtagagacagggtttcaccacgttggtcaggctggtctcgaactcctaacctcaggtgatccacccacctcggccacccaaagtgctgggattacaggcgggagccaccgtgcccagcccagttctagttttcttatttcatctttgcatactttaacctcccaccagaacaatgagtaattcctaatgtttcagaaatgtcagcccacagcaggtctttctagaactgactatttcacaaatgtactgtcgtattcaaaagggccaaattaatggcaaatgagttatgctgggagttgagagtgtgctttatgaacagtgagtacctaattaaatgacagatattaaagtgtcctgtagcataaattatttaaaacaccatatatatatatattatatatatatacacacacacataaccactatgcaaataaagcaaatattaaaagactacctcgttcatggccattcaaatcactcttcagttggattacaaagattgtagagcagattattatgagctaataaattactgtaattcataacaataaacagaagattttttattttgaaaaaagaaatactgtgagacattatgaaacaagaagaaagtaggacttagctatattgtttcccctagcattttggcaaagaatactataaatttgacagtctttgtaaattgaagcaacattttaaaatgaaagatgtacattcttttctgttctattgtttgttaagaagctcaatgatttgtaaaatcattcagtttcaacaacaaacataaatatttccactgggaaagtaatttgaaagcacttattaaaaaattcacttaaaaatcagacattttctattaacatatttcattcagtgatcgtattttaatgagaaaaaatataaacttacgtgtcatagacattgagcaaccaattgagacacatatcaacacagagtggaacgttgaccaggtccttatgcatttgctcaagtccatcataagttgttgtcagacagttgatgacatctggaacactgaggagctggtcattttggttcaacttgtgctgtttgaaaatttcatttgttgtactcaactctaagagatccactaaccaggagagaagaaggaatgtttacagtcattacattacattacattacataacaacatcacaacaaaggcatttctagtctcaagtatttagcttgattcttcaatttaagaatctatcctttttagctaaatttcagcttttaaagaaacaaacacatttctattcttacattttaccacactttcatacttttgaatctgaactctgttgcttcccaatcttatctcattttttgctctttggaatattaattattcctactttctttttctggctttccctttgccaggctctttttgcttttaaatgtagcaaggcataaatctctcaatctactccaaatggcagcgcatctcaaatattacactgctctcctcatcttaactcctgcaagcagcctgtgcactgctctcttcattctttgtatcacagccaaactaattgttcttaaacagtcttttatcatgtacatcattacatacaaaatttactgaagatgctccatattaaaaaacaggttttatagaaaaataacagctctccactgcctgctgaatcaagcccgatctataagattgtcacaaactggccctaacctggtttacttccgatgatgctctgacacagaggtgacctgtagctaagaagaagtactagagcagtcagtactctagacacagaggtgacctgtagctaagaagaagtactagacagcccccacatccattggtcttcacaaatttgttcccatccttactcttcatgtgtacaacatctatggtaggcatggctggggctagagccaggagggtgtgcacaggaggtgaaggcagagcccctgctctcaaagacatactgatggctttactaaaaggaggagtaaacatgccctatgagaggaatacgcaaatttctgctagagctactacttctaggagaggaaagacaactggaaaaggctccctggagaggtgcgatttgaaatgggctttgaaaaatggataaaatacaagagatccacatgaagtgaggaaagaattccaggtttagagaagtacttgagaaaaggcaagaattcactcaagcccagaggctctaaggaatggtggactgcagtgtgggtgatgcgtgacttacacacgagtggtgtttgccggcagtgaaacagacaggagaaatgcatggtccaggcacacactgcccaaggggaggcccgcaaaggcccgaaggaggagtttagatgaaaacgacaaatttttttttaatttaatcaattttaagtctttcattcactaactgaaaacaaagagacaaagcagattatcaaactaccatgtatctatctatacatttattgagtgtggagatgactcttctaaatctaaacatctgagtaaggaaaattagagtccacattaatttaaggtctgctcatagacatcagtttttataaaattctttctctgtctctgtatttaaccttttagcataaaaaaattagactagaagaactctaatcttattttttcttattttttaactttttggcattaaaaaaataagaggcaaagagaaaatagttggttatatatacacatatgttatatatttaacttttagcatgaaaaataagaggcaaagagaaaaaataaggttatatacatataaaaccaacttctttctcttcgcctgatgcaaaaactgttctctcaaaaaatatgacatattttgacagttaactaaaatgaacaaatagcttcctttgtatttatccatttgtaaccactgaataactaataattttgaatttttaaagacatgtatgaaatgtgtccatgctagctgtctgagtaacacagaattatttattttttaagttatctacaaattaaaagaactgctttaaacccatacagagtaaaatgatttcaaaaacaactcaacagggaagactttttttttttttaaagagataaacataaaacatacaagtctggataacgaaccaatccatttccttcagatgccaaatgtatcattggtaaacttaagctaataacaaaaataagtcaaataagcttcatatgagttagagaaggtgtcagaaaaaaactaagaaccatctggaattttcactgtaattcttacctcatttctttgccctgtacagttgacgcttgaacagcgccagtttgaactgtgagggtccacctacacgtggagttttttcaattaaagttaagcactgaacgtgcctgcctctcttttctcctctaccctttctgcctctgttacccctgagacagcaacaccaactgctcctcttcttcctccccctcagattaatcaacatgaagtcaacaaggatgaagaccctttatgatgatcacttccaattagtgaatattaaatatattttgtcttttactattttcttaaaattttcttttctctagcttactttgttgtagaataagagtatatattacatagcatatcaaatatgtgttaattgactgttaacatgttaagttttgggtgtcaagggtcaactgtacacagttttcaattgtaaacctctagagggcagaagcaaagtgcctgacaaaggaaagtgtttaataaagggcagtagctagggaactacagctccccacagacaccaaggaacatattcaaatatggccaaaaggctgtaagttttctgaattccaacattaattatgccagtaacacagcactgctattggatccccacatggcatcaggtgacaacagaccaaattccaaaaagcccatttcctgcatcaggctgtccttgcatttctttctgaagtctccctggttatacactctgtagctgtgacactaatttgccacatcccacagactatcatgtcttcaatttttagtgatttactctgacactttgtcttagtgcctaagtcaagcgtaaatcttcctgaagtgtgtcacatttaggtacctttaaagaactgactacatttaaatcacagaaaattatgattaagattttctcatttcaaagggagacaaatgacagctcagtcatgtggtaaatgaaacaaacagcataatcattttctatccaactttctgactttttctttaatcccacatacaaggcacaggggatggaatagaaatgcatcatcattctcctgttctgcaaaacaatgaacactgttaagcatccaatcttgggcttcagtgacacttctccaggtgtcaagctatgtggccattctttatttttttattttattattattattattattattattagcatttcccctatcttctcttccccagaaatataggcagagctcaaggtttcacatctggcatttcattctgtgagcctgaggccctcactcactcctcttacttctattattgcttctctttggatggctccagattctcttttctcctgctgatctcctgcctcaacacttgacccatgtcccattgctctgatccctacaagagctatataattctctttcaggaacctctccccataaaggcctggccttcttgtcatgatgaaatccagtctgcaaaccgtgaaatatcctaacatccttccttcttctacctgccacaatttaccaactacccaataccccgagtcatcagttcttcctcaggcagccttaaaaatccagaccctgatctcccctcctacaactcccagccagctcagctttgatcatccttcacctgaactatttacccattctctgttctctgccctttggtctttcttagatattccctaaagcatacttccacttctggccctatctctaaactcccacaatacagaaaatgcctcatggctccccattctataacgaaaaatatccaaacatgaaatacaacacaataagaacttgaggaaaaaaaccgaaaggaatttcaggaaaaatatgacgttcaaattgacctaaattaactttaaggaaatttctggatattggacaaaatagctaagctattccattcagactctataacttaatgttccttgaacaccatctacaccttaattctcacacagataactccttcccttcttatccccaattaactgccccatgcctaaatcccaggtgccttttatagcctggctcatatgcccactaatcaaggaagcctgccttcttcttcataatgagaggactctccccctcctcggaacatacttcccttttgcttttctgctattacctatcacataaagtttcaaaatcaaaatacaaaggaaaacagaaaatacatatgtgtggtctaaaagaaaataatagaacaaatacccattagtccatcacacagctgaaaaaaacagaatgttaccactatcttggaagctccttgaatcctgcctaattacatcctcttacaattatggggtaaccattaacctttgtatttcactttcagtttttaaaagtgtatatagcattagttttgcatgggtttgaactacatataaatggaacagagtggtacacattttttttctgccatttaattttttcatttaattttatagttctaagattaaatcatgttgatgctgattactagctcattgatttttgttgctgtattatatttataaatatgccaaaactgaatgagttttactatgaaaagtactgctataaatctccttggacacatcttctggagtactgctatataaccttcaaactcaaatcattcactcagtgtgtcctaagcaacccctgctctgtgccagaaattgtatgaggtcctaagtagagacgaacacagactcatccatcccatgatggagaagcaaacaataactaataaacagaatattaaaaattaccattgacactctgccttagtgcctaaaccaagcaccagaagtgtcatgtaaggaaaagaacagttctatgaggagccatagaaaacctcattaaaagagaggtgatcgacaacattgagacctacaggaatgagtgtcccagccaagggaagaacagaaggattaagttggtgcaaaagtaattgaggtttttgccattacttttaatgaaataccctaacttacttttaacggcaaaaactgcaattatttttgcatcaacctatacaaagagctaagacaagtgctttttaggcaggaggaatggaatacagagtttgccatttctatcactaagtggatgatgaaatggtgatgccccggtggagcagagggaaggaggtggacagagaggtgagccaggcaaagaccattccattctgagggcagcaggaatcttttgtaagcagggcattgggtccatgtgcaacgttctcgaaatatgagttccttcagtgtgagaatcaagtctctttatagtgttttatctcctgcacaatcttggagcccaacaaatgaatgaacaatgacactgccctctgccttatgctgggtggagatttgcacataatgagagacagccatgacctaaagtagttcacagtggagatggggcaatccaccaaacattattcgagcacacaaaggcaagcacttgtcactaaggtgagagaacctgctattacaggcaatcataaactactgggaaaaaatgtggagacgggtaggattagcttgtaaatgtttccaaaagaggtaaatctttaacagtatttgggaggaaaaaagggttacaagccagtgcagagaaagggtcagggtatttctagtaaactgaaaggaagggagaggaagaagcagattaataataaactgatgagctccaggagtggcccagaggccttggctggagggcagtgggagaaggctgtaggaaaagtgaaggtcagttggctctgaaaaaagcacctcatatacttgaaatccaatacaatctagcccttttctaactgtcatttagttgtttaattgtcattaccaatctcgtttagtttagaagttggagaagcgtcccttctgttcctctcaggtttgaggggaagagctgaggagggggtttttttcttcaggaatccaaagaaccaagagaagaaaacaccaaatgtgttaatatgcttatccacccataagtgttgtcgaaaactgggaccatgttcataatgacaaaaagcagtcttctgtcaatggaaattttgtggctgagtcatttgtcctcattttatagctcatcaggcctgagaagaacttccagacccatcaactggatcctggatgtgcagctgagcctctttcaaaactgctgtcaccatggactcctgcgcagaccaaacatcccttttgtgtgttcgtaatttacttcctattctcttttcgctcaacatactgatcagtagccagagcgtggtggctttcttttctttgtccgggtaattctgcaacacttgctgcaactactaccacctgctaattatctttgaggctctgtggattatgcaaaagtcaaggtcatctcattcttccttgcattgcctcatctggaggtgtctttcagccctgtagacttctcttccatacatagcttaagcttttcctattttcaagctttgcattgctattttttctcaatgacattatacctctctttcctcaattcttcgtgcagccagcttaaaatttattgctaacttctattgactttcaaggagcagatttttcaaccttaacatatcatttttcaaagcataattttcaaagcatcactgaactgcctagacgtatattaacagttaacaaaaggtagcaaagaagaatacttgaaacttttcaatttaccctatcttaaaagaacaggtaaatatcactttccacatcaactatctgacaaggcctagggtagactcaatcattagaactacaaccacaaatagaatccagatagcataaatctatatgctaagtattcacactgctacttaattttaggttattttgcgggaggaaatatccttttgatgaaaggactgccacagaattccactctgaacacatcctccacaggaaaaatgcattgataatactaaatgtctcaagatatatttaaaagaaaatagagccttttatctcacttgttaaggtgccagttcaaatttagatcaggaatgtgattttttagtgtttctttatatatagtggtattgagacaaactggaactctacattgccaaatgggcaaaaggtactgaaaacacatgacttaatactttctttgatttaatccttttaaattgggtggcagcacaatttttgaaaaagctttttacattactcctgtgttttggttaattttgttctccaagtaagaatggcatgtgttcagtactgcacactgatggggcaagtaataaaacatttatagaaacaaaaccaactccttgagtgaggtacactgaagaccagattaacttggcaaacactccatcctcttcatttatcttcctcttggaaaaaaaaaaaacgcaattcaagtaacagattgattaactttggtagaataactcacaacatagtgctttttgtagtcttcggattttgattgctgtacggtaggcagaaaaacgtacattattcaggtcagctgaaatagaaaaagaaacaatttgaagataggcttattattgaatatatattgaatgcccagaatgtatttggttactttggatgatgaaaaaatattatgtttgcctgaaataaaaagtcttctcccaaattccccaacacgtatttaagaaaaaagttaaatgatcattagcaccatgttgagatacatctcaaagcagtgctacagagaaaattctaagaaagtattttcaacaggtgtcagggctcagaacatggtgggttgagtactttgaaatgaaggagactggaaggcctcagtagtaaggtctctctgacctctgggtctcttgtctcctgaccctctttctccttccaaagtgataaatagaaaccagaattccccttccccaaggtgggtcatgaaaactagaacttctcttccccaaagcaagccataaaatctagcaagttcactgtcaccttctcccttctctcctgaagattctcctgtgacaggtatcctgtccctagaggaaaggaatatgctgcagggagaagccaagaagaatctgaatagataggccttgctggaattcccttctcagtctattatcattaaattataccctttcatccaatcacaattcaatgcagtcatccattcctcactcaatctaagtgtaaaaacagacacttttccctgttttctttgagtcttctgaaggttctcatgtcaggtaaaactttgattaagtaaatttcttgtgcttttctggttgacctgtcttttgttataggagggtcaccatgacccttatgatgggtgagaaaaggtaccacccctttcagccctttggtaggaaaaagaggaaggtgatgaagagaaagcacagctgtcacatggcttattaaatgcactgcacagtaggcagagggcccttcctttttttcccaataaaggagattttcctccaggggcatcttccccaaggacacttcattttcttccaaccacactgtccagttcactattcatggagctcatcttatttctatgctcctcccatcctgattgatttggttttcctgcccttttgcagatctggttcaaatgatcctacaaccaatactcaactctttggaaacaatagatattgtaatttctttctttgtcccctaaagacagagtatcagagattagtagagttaaaagaaaactcagatatcatcaaaatttgccccctcattttacaaactaagcaaaccagttctatgtcttttgtttgtccaacttttgcaggccccttcacccaccaaaaaaaaaaacactcacacagaagcccaacatttaaagagattaaaaaagggggcatcctttttattgaaatgggagagggaggcttcgggtgctgtttttccctccagcatctccttagctacccaaagagaaaacttaaaaaaaccgctggaccaaccagaggaagtaggttaaacaataagttgaaagccacattgcactagaaattaaaacaaaaccggaattctcgtctgtgttttcttgcatttttatataaaaatgaatttagcttttaacaatttagacaaatttaaactaggtgagctaatttgatggcacgtactaaataaaaagtgagccaaaagcaaatttaaggcagtggattaaagttggctatattgtaattgtatatctatatatattttttgcgtgcaaagctgaaggttaagatgactcaatacgaaggaggtaaaaactacaattacattcctccctgtaaatcaactctttttggctcacatgatttcaaaccacacaattctcctaagaaaggcaatacctgtttactgcattgcccttagaaatttaactacttttaaatgtcaatgacatgattcttttaacattaatatgccatgtaagaaaggctggtgattagctcctatttaacaatatacagttctcggccgggcacagtggctcacgggagcactttgggaggccgaggcgggtggattgcctgagctcaggagttcgagaccagcctgggcaacacagtaaaaccctgtctctattaaaatacgaaaaattagctgggagtggcggcgggcgcctgtagtcccagctactcaggagcctaaggcaggagaattgcttgaatccgggaggcagaggttgcagtgagccgagatcatgccactgcactccagcctgggcaacagcgagaatccaccttaaaaaaaaaaaaaaaaaaaaaaaaaaaaaaaaaaaaaccggttctcagttgtttaggttaatttattactattaataacacttaccaagggattgaaagagttcggtcattttaggatggtcccaacaggtggtctgtgtttgatggctggaaaaaaaaggtaaaattttaaaaataaacaaaaaatcaaaaaacttcatataggccaaaaacgaaatacccaagtagaaatgatttttttcaaatttttaaaaatacatgcaaaattatcctcattatcaaccattcagaaacccaatgcccaattgttacttaacatttgaaacattggccaggggcagtggctcttcctgtaatcccagcactttgggaggccgaggcaggtggatcacttgaggtcaggagattgagacaagcctggccaatatgatgaaatcccatcgctactaaaaatacaaaaattagccaggtatggtggtgggtgcctgtagtcctagctactcaggagggtgaggcatgagaattgcttgaagctgggaggtggaggttgcagtgagccgagatcgtttcactgcactgtagcctgggtgacagagtgagacactgtctcaaaaaaataaaaaatattaataataaattttagccaggtgtggtgcctcacatctataatcccaacactttgggagcctgaggtgggagcccaggagtttgagaccagcttggcaacatagcgagacctcatctctatacaaaagttttttataaaaattttttaataataaatttcatttgagcaactacattgtaaaaacacaaatgaaatctttgctttgcctatttcaaacagaactgaaactacaaattaaaacctagatataaaatgtgactgtcatgaacccttcggtcctggcttgatgtggccagatcaatgcaggctccagaataaacccatatctgttaaacagatgtagattatcattcagaacgaatcctccaacagcagaagtagtgctgtgggagtcactacaccttaaaagtctcgtcatatttccaaagattgcagaaacaagtttaactctgaataacatcatcccacaatctacagagcctccctcctcttctaccttgagtcgaactttcctcagtgcaaatctaccctttcttctcttcatgtgtatctggattccccactcccctcaggcaagtgtctcttgccacttagactctgtgttcctcttctcagcttcctctcattaaccagtattattattttctatatgtattaaattgttttcctcatgttcttcactttaaaagcaagttttatactttctctttttctgtaaatttcaaaactaattcatatgttagatggaagttttggggtaataaattgaggttaaaacataaatggaatgcttcaattaagtttcttaggtaaacagttcatgactttggtgggtcagtggccttacatttaaaaagagttaactgccccttatctaggtcagggtagattcataacatttaatagtgctccaaagacttcttaaatgacacctagttcttataaaactatttagtaaactaaatgaaccagcatagtacctaagagagtgatattacaacattcataaaatcaaattcaagagaaattatttttcaagcctatgtaatatatcaaaaactggggcatgtcactgggaaaagaatatcatcactgttatatatacacaggtaacaaaaaccccaaataactcatacttacctttgaaaaatatttaaagtgtgtatttgcagttgggtacgtatcccggaaatattagcaattgggtatgtatcctggaaattccaagatctcaaacaaaataatgtaactacaatgtgaagatctgtcttggaaagagatggaaagttgtcgggctcctctacccagattcttgactccaatgcagagacaaatacttctacttcatggtccactactgaacaccaacaaaaccattccaccctttcggtttgatggtagtgatactacaaattgctcaaaagaccatggagccgggtactgaagttgtttgacctaaattcttactattcatcattaggctcagagctttacagaaatgcagagtctcaaaaagaatttcctccctattaccaacaaatatggaaggatttgctgaggaggtaatgcaattccagtaaggcatcatgggctcccagtctgagagaacctactagggttcattgatctcttgtcttctctttcagggaatttcaatccccacgacaacagtactgtccagagacagacatcccatcatgatggagcaaaccaaggctcaagaaccaaactaaagccatcggtaatgtagagccagacgttatacttaaacaacaaatatgctttctctggaattacaggtgtgggtcttcacctcacacaacccctacggaatcacaagaggaaaataccactatttctcagtcaggcggaggactaagaattcaaggtgaacacctcttgctaatggctctttttagtgaaaccactactgagagctgacggaacacacacatttggcaaacagatggagggagggaacgggcatctccctttgtgaattcaataccagttgattcattaggcagaactgccaacacagaaaataaatacagcctctggttacaaaagtataactgctgcttaccaaacaacagaaataaaaaaaacaggcaatgcagttggctgctgttttttttttaagtcgggggagagggttaaagcaaaatccacaatgaacccaaaggcttaaagtatttgaacagctgcagatagctcagctcctcttgccaaaatgcctgaagttctcccagagtaggcaaccaaaacagaataaaagtagcattttcccccaaaataacaacagcttgggttctaattaatctcaaatatgaacagggagtgggacttcatattgtgcagcttgataagctctaaaataaaattatgattttattactaaaaatcctctctttaaaaggcaacagccatgggaatctatccaagaataaaattaaaaaaaaaaaaacaaaacaaaacaaaaaacaaagtagcaattaacagttaagtacaaaatcatatgaagcaaacaatagtgagaacatgtgacatgtaactaggctggccagccatccagttttgcctgtgcagggaaaaattgtgaaggtctttgttgtgggcaaaaaatgagtgggtatcctgcaaagcttaaattatctctgagctattttaaactctgcaaactgaagaaaacagatagtaatgcaaatgatttctgtccatataaatgcaaattgtgcccagtggaatgcaattgattattgtcctgtggatattgaccagtttgtcagctttgcatccagaggtaaattcattttagcatccctaatctcactataaatatgtgacattttgtattctctttggaacctattataacttcttactggttcccttactatgagttaaatgaaacatgctctttttgtatttgtataagagttaagatttttgcctattttgaaaactatccttcaagcagtataaatcctgctttatactagactgtatacaggaattacatatcagcatcctggtataattattaaaagtgcccccttactctgaagagccccagctgggataacatataatctctgcattttatggacattattaaaatattaagccaataaggttaagaagtagtatatccttccacctatctattattattcataacaatataacactgataagccacagaaagtaaaacacaaataatataagactgtagcaccaacaaataaaacaaaaaaagttgtgctgcaatactgcctaacatgtaacacaatgaaccaacagcaaaggacatgcacttttgataggctggtaaaatcttgatttctgggcaaatgactgctctgtggaagatacttcttaaacccatttgtcctcattagagtggtctcatatttttccatgaaaccttaaaggatgatcagaaggcaacttgtttctccaaaaactaacacttacccaaatatacttatttgttactagctatccaattttatgcttataactggattttgtgaggtttgttatatatcattccattccaattataattataaaggcatataacagaacaaaactaaagataagtaaaaatacaaatgtggggacaagaactatgtatattgctctgagataagacaatcaaagaaaaaaatatttcttctttgctgtgcaaagtaaaatatactaggtcaggatgtatattaatcacagtaataacatgctatttgagtgctcgatttgtaccaagtaaacttttttggataaactttttctatgtgtaaattctatttggattacaattctatgacttgggtgacaatattgtctccatcttacagatggaaaaaactagggcagagagtgcttagatagcttgtctgaggtcctatagtaagtaatagaaatgggatttaaacagagatagtctcattttaagctaagctcttgatatggaagtatatttgcataattaaggttttaaaatatttcttgatgaatctgtccaaatttgagtccatggtctatcattagaatcattacaaataacctcatctcccttgcttctctctcaccccttgcaaatcccaggcctggatcagctcaattacttgcctactctggacctgagcagctgtggataaaaacaactggagaaaatcactcaacagacagactcaatttactttaaaatatgtgatttcaaacctcaaatgtccaactcctggcaactgcactatattccctaataaacttgctttcccaaactccaaaacagaaattcactactgctatctctctccccaaactggtttatttctctgccttaatatcattttactttatctcacgcttcattgaaaacctaaatactactagatgaggactcctttctctctccaccaccaactcaggaaacttccctccaactgccagtctgttatcctatctcccctttaactgagaaattgtcccccttcttattaaaggccaattcttcccaatgatttcttaaaaatttcctgtgctgcactgtcaacccctctctcaagaagactatcctttgtagaatataaatgtttacagacgtgccatccttaaacacacacacacacacacccctacctcaaatctacattttctgctagttatcaccttttttctctccttcacaggcaaaattcaccaatgagtactgtaccatatctacttcctcgtgtcccattcaccactccagccacttctgtttggcttccaacttttctcctgcactcaaactggtcctataattattagcaatgaactccatggtgccaagtggagtggccatgcctcaggatggggaaaaataagagacgacaaacactgtaagtaagttatacagtgtattagaaggtgggaggtactatgagaaaaccagaagtctccagaaaaggaagttgacacaggcaaaatacaggttctgttaacatttactttatgtacacttatagaagttacatatatatagcaatcaagcacgagctcccaactaatcgattttgcattcaactgcctaaagtatgaagagtgaaaacaaatgttggcaatctgatatgacaacatttatttgagtaacaccttcttaaagatctgagaggtggtgtacttactttggaatttataatcttttcagtccttgtttcacccaagactagaatataggaagaatgtggagtacccccatcagtaacattgattctcactctgtgcacgtgcttgtgtgtgtgtgggtgtgggtgtgggtgtgtgtgtgtctgtgtggaaaagcccctggggagaggatggaggtagtgggtgagaaagctgcaggaataacttatatattcctcaggttatattcaacttcctcatccactcgcaaacactgtctactgtcctctaagcttttaaaggcaggaaatccaaagatatacttttagaaacaaaaattaacttaagagaaaagaagcgtggaggtcagaatttcaagaaaaaaaaaattctgtccaaaattcaaataagatatatgatcctatttgataataggtactgcaaaagtttagagtcttccttaaaaaatgccattagtatctcatgataatgaagacaggaggcaggaagacaacattgtaaataatgaataattccgtaggatttgactataaaatgcatttaagctgggcacagtggctcatgtctgtaatcccagcatttggggaggccaaagcaggaggactgcttcaggtcaggagtttgagaccagcctgggcaacatagcaagactccatctctaaaaaaagtccaattagctgggcatggtggcatgtacctgtagtcccagctactcaggaggctgaggcaggaggttcacttgaggccaggagtataagactgcaatgagccatggttgcaccactgcactctggcctgggcaacagagtgagaccctgtctctgaaacaaaatacacttaaagtaatttcacactcaagagtagatttaaagatacaaacatggaaaggactatatagaaataggctaccataccatacaccccaaaatataagatgtcaatattgcatgtatgactactagaacatttgttacaaaacaataagacaaagtttatttgtgtttgtttttaaataaagtagtagaattaatgatcaaaactgatgtgtctacgtgcgaggggagggacaggtgataattgtcttgagggtactaaattgcttggaaatataaacatgcaaatactcagtaaacccaggggatctgctagcttgataatatttctacatgagcccagaattcatagggaaccccacctcccacccaaccctaccctcatctccgtgactctcaaactggggagattcagaccatcagccaaattcctgtaggtcatttgttgttgcattggccctggggagccttgtatgcccccatctgaaggtgttaacaccaggactatgttcccacaacagttgaggggatcattgtatcctttaagtttgcttttaaaagctggatttgtagcttttagctttttattaaaaaaaattactactttatctctttcttttatgtatttttaaaagaagggattaattacttctatttttttctatatggttatatgaaatcttttactgtattattttactttataatcagcatatttctatttattttacaattttaaacattattacttctgtacttttgctaattgcaatggcagttttaaaaatttaatctttataaagtatagatatcttttttcctctctaaatggccccacagtgatccttcctacattgtatggtagaactttactaactgcatcccttaccctaaaaatcaaattgcccagtaaggctgatggtgtcactataatgcaatagagttgggtaatctagaagattccaagccaaaatactacttcatggcccaacaatatgtagactaatggcagtgaaggtgatattttaagtccttaactacctaatgtctctcaaagacaatatcaattccacctaaattacctcaattaactaggacaccagtaatacataagatttcttcccagtgacggtttgctggctgctgcagggcaggctttctactgtttagatttttagttagccaaggtatgcttatgctcatttatctgaagcccctccaagcccaggggtttagtgatcctaaggtacttacattctttcataaagcaattttgttcttacctccccatcagcagacttggcccagtgagttttaaatatttattttcagtaaaaacagagtcacagactactagaaagacagactctccagtacattttgcttatgcttctatttcatttacttctttatcattaaaaccaaaaccacaagctccagttcttgaaagagattcaaagtgcggcccaagagttctttacttaaaaaactggaaccaaaaagataccatccctcatcttcacgaaagagggaagggagaaataaagactgctgtagggacccttttggagagagctatgtttatttttcattgttaattatacctttgttacgggtttattctgttctgggataagttttctataaccgttaatgataaaatgctttatgttaattcttcgttgttgctgttacacacactttgttagctttcattttcctgttaggctgagtatttggagattgccttgctgatactcctctctgaccatatttagggaaggactatttcttctgtattgcctaagctggcgcacaattcttctaaagaagtatgcatgaattctctcctctagacggtatatgtagttctgccaagacaagtatatacaatctatgcaaatgaactgtatgactgcgataaagatcaactactcgctccccaagattttacaactattacaaatttcaattcctttcagttactgaaggattagggcaggtagagggtggccttgggaaatgagagtaggtctaaaagagctttgcaggattatcaataatgggcacaagaatggaaaataaaagtataaagagagatgtaacaaattgaggataatcttcatttggatccactcagagggggagttagaacaagggaaagaaatgtaagacagcaaattttatagatatagacaagtttatgctggttaatttcttgcaatattgaggaatgtcagttttagaaaatgtgacatgcatggtatatataaccagagattactaatatgtacataatgaaagctgtgtgttgtgtgatattgtacattgtatttagggttctatgaagaattaacatctgcactgcagactccagtgggaaaaactgagctatagaattgttaaattgtgatggtgacaccttgtcacaagaacagaatagtcatctgtagcaagactaaaggcttactgaaaagtcaacaactcaggctttagagaaggtgttataaggaaaaaggaaaatcttatttcctaactacatcttattaaattctattaaatactgtgacttaccaacaggccggatgtatagagaaccatctgtgtttcaagtcccttaggacttataagccagctttgttggccatcttactcgcagatacttaaatctaccagttgacagaaatcttcagatcatgtgaatggggaaagatagaggaaggccaaagagtgtgtttccccacctcagagttcctctcaaggtccaactggcaagcactgtgggaatgacatcttcctatctatgaaaaagcacctttgtccattaccagaccacagtgtgaaactgctttaaacatctagaaaatagatcctcctgtagaaattagcctatggaaaagcctatacaacggcagtgtggagtactggaaaaagcatgggctttgtccttggacagctggactcagttgctggcacacaggaggtgcatagtaaatggtaaccgtctatggtatgaaagaaaggatgtttgctcatactttctccactactatcctccttcctaaatataatccttcatcctattcaaagtttccatgggactaaaaacttccgtcctctgactcaactaatattggggccaggacacagcaccgcatagtgatcaggagttcaggagctgtagacaatccctgggtttgaacactagctcttctatttaccagctgtgtaatctcaagcaagctgtaagcgtgcttattaattacttttaatgcagttattgataattcattaagacttatgtgtaaatgggggtaattatagtacctatacttcacttggctaatgagagaattaaaagagatcatctatgcacaagattcagcacaacacctggcaaataaatgactgttcaaaaatgtaatttattacaatgatcattattacttcccacagcaactatttatcattattatatgttattattatttctgtggcaaactgagaaatggtgaattttacatggttaatgtgatgcattaagaaagttcaaccgaacccaaagctttcattcctcttattcctcatattccctggaagttgacttttatctgaggaaatgaacaacttgtgcaaaatacataaccaaaaatttacaatgagagatatctggcttttatggcagatttttgtatattgtgaaggcagcaagaaccattttaaattttctttttctctctctctttatttattattattattattattttttaaggagacagagtttcactctgttgcccagactgtagtgcagtggtgtgatcatggctcactgcagtcttgacctcccgggctcaagtgatcctcccacctcagcctcctgactgctgggactataggcgcatgttaccatgcccagctaattttttgtagagatggggttttgtcatgttgctcaggctggtcttgaactcctgggggcaagcaatccacccgcctcagcctcccaagcattaggattataagcatgagccactgcacccggccccattttaaatgttcttaaaccctgaatacaatgagctctcattgcactatactaggaaaaaagaaataactagatcagtttcagaaagtctaccttagaggaagcaaataaaattttcaaatgttaattttaacttaagatattaacaaatagagaggtttatgctatatagactagttttaacttaagatattaacaaatagagggatttatactatatagactagttttaacttaagatatcaacaaatagaggggtttatactatatagactctttcagttcagatttatattctttcattttctacaaacacatgagccatggagccaccgcagtgcacttcaaaatattaataaggaattacctagagagacagaaatgcagtgggaagccatcaaagtgggctttaagtgatctataaaattaaaatatgacataaaaataatttgcccttcctagtctcctttcaactttctggccatattctaacagtgaatacaaagatgatatacttaaacaccaaaaacgttgaatatttctacctgaatattattttttgttagccatatacattctaatttgctccaggaaattctcattgcatggcaatcatgcaaaatttgttttaaacatttttcttctacttttgaagccacgcaaagggaagtgtatattaaaagctttttcattctccatttgcttggttattaatttgggaattaaattttgttttcataacaattcttcacacataaatactggcttttataactctaccttcagaatttgatgttccttcttcatgaggaaataaactgttaaattacacaatgaaagatcctggttaaacaagttttgtgaaaatgggaatttgctatatacaaatgagcacatttctaaaaatttggaagacttaaaagacatttaacactaaaactacatatattttaaacaatctgatcttttactggtgatggagaagatttttttaaatgctacagtcctaaacgttattatttaaaatagtggccatcattatattatatctattttccagtgctggtaatagtgctctagccaatgggaagccaggtaaaactaacttttattctaccaatctgccccataagaactctgccccacaagaacaagaatacaatcctaccagatccttccaaaattataaacattttgaattagagaaattctgatttagacaattctcagtcatatataattaacctaaacatatagaaattcatttttaaaaaagagctaaaattaaggatggactttaaaagtcccaaaccacacagataatcatgatataaacataaagcaagatatttaattttttttatttagtaaaacccaaaaactagatccagtttgcatttttaaaaaaatcagatgataaaagactctaagtcaattcaataaattaattaatttcaattaatttgcgtgaacttcttgatttttttatagtacatgcattaattttctattgctgttacaaaaatgtctccctgggataaaatcaaagttggcagggctgaattccttctctggaggttctaagagagaatcccatttctttgccttttccagcttctagaagctgcctgcatttaaggatcatgtctgcttcctttaccttccaagctagtagctagcattctcaaatctctgcctcccctgccacttttaaaggcccctgggattacattaagcccatcaggataatccagaataatctccctaattaaaggtcagttgatttgcaaccttaattccatttacgaccttaattctcccttgctttgtaacctaacattttcacaggttccagggattatgatgtgagcatctttcaggggttgggagcagttattattttgcctaccacagtacatcagatttatatctaaatttgtaagattaaattcaagtcaatattcaaccaagcaaattaaagttctctaatactattactattattattgttatagtgtacaataaaaatgtaaacagttttaaacattttcagttagataatcacatcttctttcactagagacatgccaacttaaccagcgtctgacctctttccattcttacttgggcaaatttgacaccaatcaattgctttaataccttgttctcaactcagttcacaactcagtgcattgtaggttatacactgataaaaatattaaactcccataagctaatgtaacgtatattgcttattatatttattatatattatgcaaacctgttttttaccctgagcttacatctcagactgtaataaaaaattataagaaaagactatttcaccaacatggacttcacacaacgttttcaggaagtatactggaagagcagattattagcatttgtatagattttggagataccacaccccatgttagaaatgataaaaaggaaacttggcccagagatcttcatctgacttacctgaggtcacacagctaacctgagacagagctgtctcctgacaataagtaagtgttgtcatgattatgatgctgttcgtctgacacataaaatagggtcaactatgactcatcactagagcacgttgtaaattaatatctttactaagttacactccaagggactatagaagtagaattttatcattctgttccatgacaatatatagccctaagccaaggatcaacgcctactaagagcctgtgtaaattatacaaaacttataaaatgtcatataagaagaagaaacagtatgcaagaaggagaaactaactggacaacagaatcaaagaatgatgagcctatgctaataatgcagataacttctataagacaaagaaaaacttgacaatatttcactttttcatgataaatcattatttcttattggtggaataaaatgacaagagtataagacatttttatatggattttcttagaggaagaaaaatggtttagaatttgtacaatttgacaaatatcattatgtcaagagtattttgaaattctgtcatttttctccaattttttttttttttactttttagagactggatcttgctttgttgtccaggctggaatacagtatggccatcatagcttattgtctgtctccaaatatttaaatctctactttaaaatatatcagctaaacacacctatatccctaatctgatacatgaaaaatataattctcatgttaaaagtagtttctttttaatattaactatatcacagtttctttcagataataggactgaattctatttttaaaagttatggggagagaagcctcttaagttatcaataaaacatgattttcttggtatcataaaggagaattaaaatcaacttacttgatgtaatagggcactttattatgtgaaatggatctttgccacggcagctggactgacgctgaggaaacaaagggagattattggaaacgttggaaaccaaaaagccttacaccttaatgcaaaacaactgaacattttatagcaaattcaatgaactgctctggtttctgagctggattcctataattatgagatccactgggccaaacaaaaaatggctttaaggattcatttgaagtaaaacaagaaacaatacaggttcaaggtctaatgccaactaatctaacctgttgataaaaatacttttaaactttcaaatggtgttgcttataaatactacagtttaaaccttagtgccatctggaaactgtactccatatatatttttgataaagctaaaaccaaaattaattttacctggtatatccagattaaaaattagatttttcaagaccgaattttccagatgactaataacattgtttactttgcatcgtagtcacaggagtagctattgagtacagatggcatttaagtaaattcaattctataacatttaaaaagaaggaatttaaaaataggcaaaaagttgtgaagaaccaaggcaatcgtctaggcagaaaaatcccaatttcttactttcatctgaaacatacagagagcccagtctcctacttttgcactagaccttactatgactgagattttatggggtttttaaattgaggtactttttttttttttttttttacaattctagttacttcttacttataaaaaatatattattcctacattaaccaattattttaagacttatttaagaagaatagtacatgtgaatttagtgccataaaagaattttgctaaatgaacaaatataaaaattcaaataatacttggaattttcatactttgcaaatatcatcagatcctcacgtagccagttgtcaccaatactttttttctcaatttcatgtcacattaatatcttacaactattcagcattctaaactttgccaagcattttcaaatatatgttttcggtaaggaagccagcaagatacacgttaaagttccatttgatagatgaggaactaaatgtgtagagataaaataacttgcccaaagagtgacagccagtaaataaacggtcgagctcagatgtgatctcaatttctgaacactagctgagcaattcttctactcaacaattcctcctctctttataaaaggcaagcactctgttctcaatctatgcccaccaaagtataaacagggatgaaaatgaggaagtaggtatgttacatttctcattagagccaacctcatttcagtgttggcaccaggctaataggtcagtttttattttgtgcctaactaaacaggcttcttttataaccatggctgaagtccaagaaatataataaagccaaagattccaagcagcaaaggataacaattattaaatgtattaattgggactttgtttacacttccccactcattttaataattgttttgatttgaataacttctacctccttggattctcagtgttagataatacaaggccatgtatttgacttttacaaaaatgtgtataaatttcacaatatttcacttccaaaagaatatgtgcttgatttccactatgagagtgattgctaggtgaaagtatagcatttcatcaatattaaagataactgatagttagaactgtaaagacagtctcaattattttgtaaattcctctttcatttggtcttggtacatagctttacattttgaaaaactgagctttagaaatctggaatacttaataatctaataagtatacagcaaacctatttacttcatcaacattgatggtatctggactttaaaaatgtgtcctggcatctaggtacacagtatattccaggaaggcgtataccaaagattaactacctaaggtctaaggtttgtgaaacagaaaaactgtatggagttgaggtaggggtgggggcagtgaggagggtgagaggtagagaggtgtagggcaggaaggggcagaaaatgactgattaagattcttgaaattgtaaaagaaaagcccaacctttaactgaggtaaggcagtttatcaagagtgacaaaaacattaagaggaaatataaatgtaatcaatttagttagaagatatagtactttttagctgtttctatggttatagttgcaaaaaaactgtcataattgagaaataagctttgccctaagttttaaagtttacttaaattgaattaaatgaaacaaattgctttcttacatatatttgctaaaggaaatgaaaggaaaggaattaatatttattgaaagcatttgtgtcaagaactgtgctaggtgctttgtgtaattcgatatgccttgtcattgagttctcaaaacaatcagaggaaataggtaatacggtattttaagacaaagaaatcaaccttcagaaattcacaggtctggtaagcgacagaatgaatgtttaaactcaatctggttgactataaatccgacattctttagtatcttcactagtgaatgataaagtagaagctcaaattgtttattgaagatctcaagaatagtccataaatttatcaattccagttgaaaaatattacataaaattctgcataggtggtttggctacatacgcaatactcgaatagcagaaaaactaaatataatcgcagcgagcctaataaatcaaaatcttcccacttaaagatttatggggagtgattttttttactttgaaagttgaaggtgtgttttaaataagcacattttaagcagaaaaattaatttaaaaccttaaaagataaaactgatttctttattatgaaaaagttcataatctttgcctatgacaaagcaatgatgatatgatactatgttagttatcagacattccaatgagaaaccatagctaaagatgagttcatttctgttccaccttgaagacttctcagttgtcattacgttattacaaataataaccattaagcaatattttctttgatgttagtacctccttacaaggatctatctaaataaacatatttatagcaaggaatacggcttcttcaattaaagtgaaagaaaatgctaattcattcaattaatgcgatcagtccagtttattagtacttactagagagaaaatgctgagaggatggtccaaaatctctgtgggcttcctgaagctgtttaaggcgatcatccacagaaacctgcacacatacacatgcaagtcagaggaaataatttgattccgaaacaataactttaataatatttttgctttaaagactataataaatgatgctattgcccaggatatgattgtttatatagaccccttggaccccttctctgtctctggtatcagagtaatggtaaaaaaaaaaaaaaaaaaaaagactccttctgacctcaaataatagtaaacagtgccaggtactcttctaagcaatttatagaaattaacgctttagtcttcacaataactgtaaaggttatttttatcatcatcttacagattaagaaactaaaacacaaagaggtacccaaggatataaagctagtgagtggcaacactcctgttcgtattctggtcatacagtgccagaatctgtgccctaactgttactctgcattgcctctaaggcagtacattgtttgtaaagcctctaaagtcaaaatgtggtcatgggatcagtgaccactcatctctcttttgtaaggaagatggtaaaaagtgttatggggagcaaatgaaaaagaagcctaggaaactagatagttagatagataatagattatatatatatatggggagtgagagagagaaatagacagtacatagatagtggatagttagaaggatagagtgagtgaggtggtagaagataaacagagaatgaaaagacatgtgagtatgcaacatcttattttcctccaaatttgtatctgatcatctctacttcgggttgagatatatatttcagtttgtacaggcatattaatgtactcttcgtattttttttaatatacatttttggttttggttttgttttgtttgtaaagacagagtctcactctgttgcccaggctggagttcagtggcacgattatggcttactgcagcctcgacctcctgggctcatgcaatcctcccaccttagcctcccaggtagctgggactacacgcatgtgcaatcatgccgggttaatttttttttttttttttggtagagacaaggtctcactatgctgcccaggttggacactctacatcttttatccacatctttgtttttgttttatttttaaagacagggtctcactctgttgcccaggctggagtgcggtggcacaaacatagctcactgtaaccttgaactcctagcctcaagtgatcctcccacctcagtctctcaagtagctaagactacagacgcacaccacaccacatatgtaattttttaatttttattttgtagagacaggctcttcctatgttgcccaggctggtctcaaacttctgacctcaagcaaccctctcacctcagcctcacaaaatgttgggattacaggcaagagcccccatgcctagccttttaaaaatacacattctatagttagttctctgcattatgaaaatgtaaagggttactaaactgagaaactaaatgcaaatcaataacaactgcacacagcctactgacatttccatttcctttttctagccttggtcatgtaatgctagttactgttccacttagagggacaatctcatttgcagctgtccttaaatgaaactgtgtatgtctgattccctggacagcactagttcctcctggctagctatttaaattgcattagtatgcactttgttcattaaggcctaaaagccttcaaatgccacactttatgagtaaagaaaatattactcctgcaattcaacagtgttgcccaccagcatagatttttctcttcttttccaaccagcaactaacatctgagctctagaggttaccaggatcatagataaggatgacagaatacatatcttctttcaagtataacatattccccgacttctaatcttcggaaatggtgataacagaaatagaatgggaagtaaatcaagatggaccataagaatcatcacatgaagataatgaattagagaaacagagcagaagaaaaaaaaagaataaagaacaaatatttctatgttccatccactagaaaaacacataaatttaacagattttgctttactaatcctaggttattaacactctttgcaaagactaagattgtaaaatattgtacactaatttcttacttcttcaatttcattaagaaaatatgaaccattgagtgctttgatatttgaattaattcagcaaacctattatagataaaatatatctctcaaatgtttttatgtgctacatcaaaattgcatatttaaataaggtctagagtcattaaaccaactgcattagctaaaatctaagaactaaaggtaaacaccactggtataaatgtgctatctggaaaaaataaggaagatatttaaatagcaaccagttagaagaaaaacaatagagactttcctgatttttcaaaatgaaaaaaaaaatacatgatgaaagtaagaaaaatgactcctttattagccattatgtgaaaaatgtttctgtgacctaccacaggtttcaattactgtgatttatttaaccttttgcaattttctacaaatatcatatgaatagtacatcaaaaaattaaattaaactctataaataaatgaggcctttaggttcaagatactgaaagacaaatacctgatgtcatcacatgctaaattcattatcaaataccatcagcaaagaaagagaaaacggtgagtggtaatatagtgaggtagggtttaaagaccacccaaggtgtaagcctgcattatgaaggggaataagctgatacctgtaaaagtttccatcgcatattaaggtcatctagctggcgagacatctttagagagggatgcaggtcaagtggagacagctgactggataaatcattcaccgttttaactttaaagttgattggtgcaatttcttctctaaatgcctagaagaaaagaacaaaaaatatattattggaaacgaatataacaaaagctaatacagttgatccttaaataacttaggtctgaactgcatgggttcacatatgcacagatttttctcaaccaaacttcctgggtccatttatgcacagatttttttcaaccaaacatatggaaaatacagtatttgcaggatgcgaaacccatatatatatggagagctgacttttcctacatgcaggttccatggggaaatgtgggacttgagtatacatgagttttggtacatgcggggtcctggaattgtacttccaaataaatggcaaggccagctcagaggaaatcaactacagttgcccactcaacaacagctgacttaattcaggtcttcagtaacttggatgaagaaccaaaaagtcattgtttattacccaaaaatataaataaatgtgtgaagagaaaaattataattcaaacttttaaaatgattatgtatttcctttcatgctttctattatatgcagtttactctggaaaatgtatgccattattttccactttactgatatctaatgttgattctatctttagtttgtattcgtgttttctttttattctgttttaacatagctaccttaatattttttcaccaaatgcaacaacttgattttaacatgtttccacttaaaattaaattagaaagtggccagtagaaacaacattcctaaccatgaaaccaatgcctattacagactcaagaggtaagatctatccctgtcaaaatcatttataatcactgtctgtggttagggcttgggcaggaagagtggagtctacagaaaaaaggtaaatgagtcttagaattgacaaatgccacctctgagcaaggtctagaatcattaaaacaacttactaagagcacttagaaattgtaattatgagcatccacattcttgacgttcccagtaaagaatggaagctgcttgggaatagaccctcactattcagcacagaacttgcaatccaagagagacagaattaatttctattgacaaaggcccacaaaaatgatatttgagcaatattaagctaacacagaatggataatggaactgggatattaaaagaaaacagtttaaatttaaattggccacaaaattatagttaataatgtaccaaactaaatttagaagtagtaggtgttgtaaacatcccattagctttgccctcaggtttcctcatttctacattgtccactctttaagtggggaggctctttaagtctctttaagagactagagtcagggtgagaactatgaatgttggaagtttgaagtcaacatgtgtaaagtaagaaatattaccgaaccctgcagctaccaacatttcaaagacagggtagaggaagggatgcatacaaattcatgggaattgcttcagtatggaaggagaagaagagttgagatagttttttttccattgctgcagattcggcattttaatggatgacagaatgtgcacacacagaaaaacacacaaatacaattaaataagaagagcagttgtatggtaatagaggcattataagtgtaaaaaattcacaattaatatagaagcacagggaaggaggaggggtgggttagggtgggcaaagggatttttcagtctgaactttgaaaaggtctgggtctctcagattcagtttgagaacaattacagaattcaaatccttcaaggtttctttagtcaggattttagctatatgcattaatattctctccatgggtaggtaccttggaggactcaagaactgtaattagcttttaaaatcaacatctttttatttttatctattaaagattaaaaatgaaatgccagaaaatgttttgagatgcatataatttcaaataatagcctattttatttcaaaagatagtaaactttaaacaaatagaatataacttcaagacaggctttaaaaatcttttggaacaaaaaagaaattcaaatttttcctctccaaaaataatgtttccctatataagccacaggttaaaacatttaaaaagctttgacaaacaaggtctttggtttttgtttttctttttatggtcaggtgttatatggcaatgaggagtctttctatcaagaaagtttatcttttgtttttgaagagcttccaaattaaggggctcgagataaagcaagttttaaaatggtttcagaactgctgtgtgttctagcataaagaacctatttatcatgttatgactgcactttcctataacagaataaaagactatgtggccttccttgccataaaaacagaacatctgctagtatcaaaggtgctaactggaagtctgttggcaggtgtgactcctaagcccttctcctgccagaaggtgtgtattctgtaaataagaacgattaatgataattttaggcagttaacattatttgattacccccaaggatttcgttttccagttgttttgacatatttaataatatttagcaaaattcagtacttatttttatctgactacactgtcaatgagatttggggtatactttaaaccatctcttatatctcttattgtctaaattttattaacttttttttcaggagatgttctagaatatgggaaccaaaggggaggtaaccataagtctaacatccatagctttgggcaattccttactacaaacagaatttatagctaaactaattcttcattaatatacaataagatacaatttatagatgagagttcccagtaaaagagtgtgcttttgattaaatctctatctccatccaccaatttacaagagataccgagtagagaggaacctggagactataccatatggacacaattctgcaaaatccaggctctgggaatcaatacaaaacaaacaattcagtgtctttaacaaataaactgaaaaggaaaaaggaagagaggggaaatctggggattaaaaatattttttaaaaataggtaaacctaatctacattgtctagagatgcacagttggataaaaaataaaaataaatgtaaattatcataaaagttgcattagttgttatttgggggcagggggttccaatgaaccccaatgagggtcatatggaaagcacctgtcctgactcctgatgggtggggttgcagcggcgttggctttgtaacaatcccttataacaatttatatacgtggctctctttatttgtgttatatttaacaagaaaacatttcttaaaaatccttcaaagacaatgatgctgaccatgattttttcaatgtgatcctgcagcgagtcaatgagtaagtctcccacgggcttccagccattccgcacggactctgcctccttcatgtcagcgtccaggtcatccatagctccctgcaggtctctgagtttctccaatgccttgtccacttgcttttgccaattgctagttacagcatttagactttcccatttttctttgacttcagaagactgtttgcgcatggctttggcaatcttttgggctctctcctcaggagttaattctgtgattaaaaaaaagaaaaagaataatttggatgtctgattatatattcttaatagccaagtgtgagtgttaccatcgttactgagaaatacggagaaaaagtaagaaaaaattactccagggtaaaaattgtccagggtaagaaagaatttctccatacttcatccatgaattctctgctacatttaatcacacactcaaaaggataataaaacagttactgagattaataaattgacccggtttttgaactttaatatatttctaaagccactgaaatgtaagaagataacacaagaaataaaccaatttttctttatcataaattcagttacacaaaatccaaagacactttttcatttcagtattctcaagagaaatggtaagtataattaatgaagaatgactataaattataagcaaaaactctcagaaaataagattaatgtattgtgttcctaaaaataaatactgaagacaaataacataccttagatagtgatcatctctctaaggctgtttagcagtttagttttaataaagggcatcatctgcagcccacagacattttagcaggaagatagcaagatttcaaggaccatcctaagtttgtaatagagcaagggggcttccacaatgcctgaaataaacttagagtttcagataaaaatagcaagcataacacatggacaggccacaggatgtgggctggaacagtccagaggagaagcaaaggatacagacagaaatcaaagtcaagttcaaagccaagggtcagaaatataagagatggggagctggtaaagcaagggcagaggaatgcagtcaacactgaggagaaattctcaagacagcttagaaaggtctccagcatggctccacactcctggggcctcactatcttctacaccttaaaatacctcctttcctatctagctggtttgatggtggtatccaactgtccactgcaaataaagaggcagtgcaattgacataaactgtacattaatttgagacagaaaacacattcttctttgtgataacatctcatctttcagtacacatcacattagcaatttccacttcacctcaaaatgttccaaatcacttggaaaatgatcatcataagatgaacttcaccataaaatgcacagaagcaagctctcctaaactgtaactttcatcctcagtgtaaattggtctgcctgctttatttaaatattatataaaagccaagtcaaaggtgacagaacacatatgtttgtctctctaaatttcaaaaaaattctagacattgatatttagcaaccgcagaactacaagttgtgctgcttaagtggtggaagtctacaggaaacttcagaaatctcttggcagctgaactgaaggaagaagagaaaacatcacaactggtagataggctgaatataccagtacaagataaataaagaacataagtgaattagaggccaggtgtggcagctcatgcctgtaatcccagcactttgggaggctgaggtgggtggatcacctgaggtcaggagttggagaccagcctggccaacatggcgaaaccccatctctactaaaaatataaaaactagccaggtgtgctggtgggtgcctgtaatcccagctactcaggagactgggccaggagaattgcttgaacccaggagatggaggttgcagtgagccgacacagtgccattgcctgggtgccagagttgagactccatctcaaaaaaataaaaataaaaataaaaaaataagtgaattagagaaacaggttcaagtaactgtctaggagcccagagaaaagccctaaaacatgcaacatgtcaggattgcaaaggcttcttgagaaagcagctctctgaaggccagtgtatcattagaaagacaaactttatttaaatccttatacctttaagatatctaggctgggtgcggtagctcacgcctgtaattcctgcactttgggaggccaaggcaggtggattacctgaggtcaggagtttgagaccagcctggccaacatgatgaaaccccgtctctattaaaaatacgaaaaaattagctgggtatggtagcgcatgcctgtagtcccagctgctcagcaggctaaggcagaagaatcgcttgaccccgggaggcagaggttgcagtgagccgataatgtgccactgtactccaggctgggcaacaagagcaaaattccatctcaggaaaaaaaaaagatatctaaaaaatgatgaatatataatacttatattgtatatattttatataaatataaaatgttatgtctaagataaaaaaatcattcttagtctcatgagaggtggtaacttttatgattaaacacctgtgtttgttaataagtcacttgggctttttcaaaaatatatcttaagcattgactactgtaaaaaaagaaatacactactcatttcagaacggacaacttaattatggtaattttcctcagataaagtaaaaactcattctgtcagacattaaataacttggcacagggaggcccatgggttctttgtcttgtgacaaaacatcatctgctgcctctgacgtttttatctttccttaatgtaaaaatttattgattgagcagtccttgtgcagtatttattacataatccccactcaagaagctactcagaagaaaagaaaagctctgtgttcaattcaccatctgtctgccagaaaggaaacatatcaacgaatcacttttgagtcaaaataagagtttcccagtgcagcaacaatctcagctgaatgcatactttaagccaagcacagagcaaagtaaaaaacaaaacaaaaactttctagaagtctgtgaaatacataagaagaagcgacatgtgaaatatgaaggtatgactatttggggtaaaataaataataaataaattcaaacatctaaaaggcagaaaaaaatgaaaaaaagggaaattattgcattcttaaaaaaaaaagtactctcatttgaaaatcaaaggacaaatgttacttgagattttctgaataggtatttgtggtaaatgctaaggaccacctacaagtagaagcagagaatctgcttcaccagtgaagaaccccggtgtcatgttagaaacgaccctcacagtgagggactgagtgagtttttaaggctgataatccaggaaccctcccccaaaaggtagtgatttccctggtcagcgtaaggtctggcatggatagatagatgccaaagctccccaggtggttctaacaggttgtcaggatggaatgtggctagcctattggcatataaattgatttctctggaccatgtagctgaagcttacgggacatttccactccactgggttcttgtgtcaacacagagcacagtcactaaatactggaggccagagagcaaatgaagctcagtgataagagggtaatctaatttgcattgggaaaggcagtaatagaggctaatgctagagacagaggaaacagcaggagaaaaccaaataaatttgctagcaattctgagatcagaagacttttttttcctatgtcactttcctattctctaaagtgtgtgtgtgtgtgtgtgtgtatgtgtgtgtgtgtgtgtgtgtgtgtatgccctgtcactctccattctcctcccttcgggtcttcccattgaactggccaaaatttgagggtagaattatattacgtacatatacactcaactactcagaagaaaatatatatatttatgtataatatacataagtaaaattatgtatatattatacataagtaaaattatgtatatattatacataagtaaaattatgtatatattatacataatttttatatatctatatatttaaaaattttatacacacacacacacacacacacacacacacacatatatatatatatatgtatacaccattttttttttagtcagggtcttgctctgttgccccagctgaagtgcagtagcataagcctggctcacagcatcaaactcctgggctcaagtgatcctcccacctcagctttctgagtagctgggatcacagttatgtgccacagtggccagctaattttttttttttttttttagggatgaggtctcactatgttacccaggctggtctcaaacttctggcctcatgtgatcctcccacctcagtctcccaaagggctaagattacaggcataagccaccgcacctagcctcttacttatacttttatatttatttatattatatatttatgtatcatgtattatgaatattattttatattcatatttcataatttttaaacaccaatttatttattgcattacaaagctatttaagggaccacagataactatcttttagaaagaagaaacaggaagaagacaaaggaagagaggaaaaaggaaagatcaatcctgatgttttctgtcatccaattacctttacttcttcaaatatgcaaattagtggcacagcatttatgccacgctctcctttataccatgaggaagaagactataatacacttccctagaatgcaggtgaaaaaccaaagctggaccaggaacagagactaggatttggaatcagtcctgctcccattttgcccattgcccctaggccagttacttgacctgcccagcccaattttatcaagtgcaaaccctattttctcatgctagaaaaatattttatttcaagagtctattttacctcaattcaattatgtaagaaggttgagcctctgtatatctcaaagaaatcttgatagtagaggaaaaaaaactcttcctttgagtgcttatgcaaagctattttttaaattttaaaaatgaaactatgtttctcccatgaaataatgatagatatttattagaattcgcccagtgttattgtttaataaacatttcccatatgtatggtgtttttttctcaattatgatatcaacatttgtaatctccattgtggcttttctacacttacgttttaaagcccaatgtcaagaatgttttctttccttccatattgattttatagtagccagtctagagattggtatgtcctcagtatataattacttaattgagttggacggaattgaatttttagtgctcctctttattgagaacattcaactttacacttttaagtggacatattttcacttcatttttcttcctccttctcacatctgtgtaaagcacttacaaaaaaactattgtgaaatagaaggatcaaccttacaaagtcatttcaggtatggtaattccaaataccttatttatactatttgcttttttgcatgtatctataatcttattgttttattctaccaaaagacgaaaaggaaatattaaaacaatcaagtaaagaaaaaaattcacaactggcatttttactgttggacaatttggtagaagaaaagattaggagattgcatgccagttccaatactaactagttacataatcctagatatattccttatctctttcaacctcagttaatacatagaaagctactggcacatgtgtggcacacagtaggttcttgaggaaggttactctttcattcctttttactattttataactagctctgggaggcttagatatctgtagagattttcacataagcaaaccaggttgattagccaataagaactcaaaggaaaagacttgacttgctctctctcaatatctctctctctttacccccctcctatttctctctctctttcctcatgaccaaaagatgtttctgattaaaatattgggaaatacattatttcctaattttctgataaagtgattaagatccatttaataactctgaaatgttcaatcagtgtttgagagggccctgaccatttcctactctgtacaataactgatgacaaccactcattatgagccagattacaagtacatcatcaagtgccacggctgattagtgcttctaattatgtccatttaataaattataaggatgacaataacaagaggctactcagagcagattcacctgttaatatgtagcctaaatctttcaatacagatatgataaagatggcatagattcatccatgctgccagtggacttctcaaattctttttttttctttttttaagaaaagagaacctagatatatttagggaacatcaagacctcaaaagtaaacagatttagggactaccttccacaaatagtaaatgcaagttattaagagaggggacacaaatgaaggggaactcagaatacaaaacacgctttggagggagctacatggcaccactgacctgaagtcaatagaggcagaactggagtctaaatacattcaaggtttactcttcttgtgaagtggccaaagtaaataagcccagagttgagtggaggaagaagcaggggccaaccactagacagacgcaactccaaggaaagaagcaggaagagcaaagagaccctggaacagacaaccagggcctcgctaagcaacctgagatctttccattttcttcattcaggaataatccctgaatttcctccaagtagtggcagttttgcgatttattcaagtgaattcctttgggctggacatcaacagatgggtcactgggggcaggcaggtggcaataaaaggaaagaggaaaagctgagaatgtttcaggaggaaaaaaacatctgttttgcctactactgtatcccgagtatctagaacaccccccttgtaaatggtaggcactcaaaacgtacttgttaaatgcataaatcaatctctgtacaatatctttaactagaaaaagaaaataaagaagaaaattctcccctttctctttcaagaatcaaaggacaggagttttagattcaaagtcttttatttcttgccacatgactgcccatctctccccaggctgcttcccagctaaacacagcccctagtgattgatcgagctacagagaagtctggagctttctacccatgctctgccattcttataagttaaatatggcttatgtttatgtactgccaaaataagtgatgagtttaattgaagaggagaattcatgcctttgctaggattatacttcttaaaaaatggcaaaacctctaattcttggaagattccagttttctactaagaacaacaacaatcacaaaacataagtacattataccacgctcaaagagtcttgtatcctccggtcctttatgtttaaatcagaaagtaatgtctcagatgctgattataataaaatacacacgtgtaaacgattgccatctttttatgaggcaaatgtgatttatgaatggctgtaacactgattagagaacataacagatggtaaacaattaattgaaaatgctatgtctatcaaacaaatctttatcatataattcttcatgaagactattgtttatttaaatgagattttattactacagtaggagttagcatgaaaaacattttccaaatttttacccaatcgatgggcttactcagctggctcgttgtattttagaaaagttgaagactagatgcattatattcatacagatattatagaactttaatttgtgaaaaatcacattactgctctgtagttaagaacaccggaaaagaaagtaacattatatttttctgcgctttttcatgcattacaactttactaatctaatttggacttgagaagctaatgaaattattgtcgtggtctataggcctgaaagcaattacttatacttcaaatttttatatgaaaattaaaaagacaaagtctaatattgcctagacaccttctccctcggtgttaggaaatcagtgaactgtttatgattccattatgcagcgtggtatttcagtgaagaaagagcaacaataaagaaaaaagcaaagagttataaacatattcaattactgtgtgaattattttaaaatcgaagaaaatgaaaataaaatgttgtttctattgaatagctacaaatactaattattacggaagtagtttaagatagtacactatggcagttaagagcatcaagttttgtgacataagccttagtttgtattttggctctgtcacatagaagacagtatgcctctaagcctctcagactctcagtttcctcatctgtagaatgggtggtaagtattcacccttcaaggaattattatgagaatgcaattaaacaaggtaggtaagtttcttggcacagtgtgtggcacatggtcagcacctgtgaaattctggcttgttgggaatgtctgcatttactaccatttttcactttccccttcctttatgggattggattcttcctccatttagcatgatattatgaagaaggtctgccaatcctagcagtccctgagtcccatgttactcgggccaagtcaaccagagccctctcctggaatattctggatctaaagaagggtgagcccttcctggtatgaggttgtgagctatacagtcataggaaagctaagaaaatgaaaacctgtacagagaagcagagaagaagacatggagaaaagccttctgggtggtattccagtccctgtggtcagctacgtctctaccgtggctcggttatggaggccaatgccttccccttcatgcctacacttagggaagctgtgtgcctgtcatttacaatgaatgaggctccaattaataaagttgttagtgaggaaaacaaaagccctgggagaaaacacccattagttttactagcccagttacttctattaactaatgtgtaatttgtcctcattttattacatacaagaaaataatgttgtaaccttaagttatatggagaatataaaagtaacttctactaaactatataataatttcaaatcttcactcatttaataactatgaaattgtatttgcataagtttgctaatactggcataaagtggactgacatagtggactgaatatgtcacttataaattcttcgttgtatcacaaaatatatgagattttacagggaagaaaaatagtcttaatacttggctttctaaaatatcaggaaatatttaaaaattaaacagtataccctgagttaaatattacataccatattatgtactaaatatacatagccatctgtcaaaggaccaaagaggaaaacattaacccatacatactttttcatctgaaaaattattattaactattcatcacatatacattcatacacaactatataaagttgtatatgcacatacacacatacacaactatacccactatactcaactatacatgcacaaatagactaaattaagtaatagctgggtttttctatgattattaataaaatatttaaattaagcaaaattgactgctccaggctgaaacagaaatgatattcaggcagcttaaataaaatagtagttgtagtaacagtaattctttaactggaataatttttaaagatgattcctgaggaaactggtggataaataatgcaatctcttttttaatctaaaaatatcacaagaagaggacaggtgttttctccatacatatgtatacaatgaattgtgtaattttctaaacacatttagaggtgagatagcctataaaattgttagcagttttatttagtgattgataccttagctttaaatcataaagtatgtttggtggggggtgcttgtgcatgtgcgtgcctgcctgcctgcatctgtatgtggtatggagagaggaagaccgacagaaggctccaactcccctgtgcagatctgacttttaaactgaactgaaggtaatgaacaggagagaaggcacaaatattccctaattccctctggaggtttgggggtaggggtgggtgaaggctgttgtcttgcacagcttcactgtgcagcagtgtggttcacacaggaattctgatctggtactgagaacagccaggggaggctggcagcacaagggagagaccagaaaacatggatgcaagtttaagaggctctagacattgagatcaaggaggagctaggaagttaggggccagatggccgtcagtgaacacagatagaggagataaaatcgaagggatgagtcaaaagccagccaaaatccagaggttaaggaagtcattgtcatagacgcatagggctctgttcttgcatctacctttcgttagctggatgactttggtcagcaccataatatcttcttggcctttgtgtttttatttttaaaaaaaatcatactgtatgatcggctcaactcattgggatagacaggagaatgaatatgaaagttgcttggaaagtacaaagaacaatgcaaaggatgagagattgttgtactgtgatactttctaacacatacaaactagggattaaaataaaaaaaaaaaacagttcaattgcattaaaaggaaaaagtatacattgacatgatacaaattaaatgaaattaagtatttccatattgctcaaacaaaagtcagggactactgacaaagttgtgaacttggtaaaatttctacaaggattcagataattttagttcagctaaaaatcatatttacttaatagccatttataagcagaaatctgagtagttgagttttccaaagagctacattttacccatttagccctatttttttatggttaccattttggaagaaaatttactaaaatataatataaattcctatgccttctcttaactgatttatattctgtcttcagaaatacacacaccataattcacagcttcagttttcttttactgttgaaagtcccaaagactacctcgttttgttttattttaggattcttgcatatctttttatcatttctttctcctcattgctgtcagacagctggagtcatttcttaccattaatctttgtccctgtcctgtcacttcattttgctacttacccatcactcaccggacatcaagttcatacagtcgcaccagtgtctacagcagaagttaatacctctgagaagtacttcagtggctttcccatgatctaagaaaaggatctgcactatgttttccatacaatctctatcctggctgctcagatcatttttttacactctttcagactctccatcaatgagggtaatcactaaaaaaagagggaagggccaagcttcagacacagacattggaaaacacagtgagagagaccacagggtgccagggaatcatggcagagagctcgggaagggaaagcgtccaggaagacacaaagccccagcagagccggcaggatgaccagcagctgcgtgggcaaatgaggcaagcgttggaaatcaggtcagaggacctacaggcagaaaactgggatgggcaatggggcaaaggcaaggaagaccactacctgcagaatgtagtgaggagcctggctcccagcaaacctcaagagtggagtgaagagaggcacaaggtggggccggatggaaaagctgaggacaaattgctgtgcagccttctgtgccaggtggaggagctcagatcccatggcatgcactacgggcagtttttatctccaggaaacctcatgccaggtttgtgctttaggtttatcattttaggatttatgttaatggagaaatgccaattaagaatatattgaaataggcctagcataagattggtatggaggaaactaatgtggaatggtcaattaatagtgatttttaaatacttaaaaatacatacaacagtataagataattagtaatggaaaaaatttaaaggaactggaagaaaaaaaggcattggagataaaaatcatggaggaaagtgttttctagaatggttacctaaaagaaaagaggtgactccatcttggtatgtccttatagcatggtacacatcacatactcacaaaatgcttattaaatagaaccgaaaaaaatcacttgatttcttcctgatctaacctctccaacattgagtacttcggcatcaaacaggataactaatgttcaaatgcttgctacttctaatagcagatgtacataagtcatggtaaacaacaaaagtataaaagctattatggatagttttcttcgatttatttttaacaagtaaaaccagccattgttatagaaaatagtatcaggaaaggaggcagtatgaaaattgctaatcataaacaaacaacaacaaaaaaaaccataaagttaaattgacatgacttctttttttcttgtccccccaaatgtagtattaaaaacatggagcttaaaacatcctgaatgtcacagtaaaataagaactcaaaaaccagtattttttttttctgtgtatctttctagacattttattagggatttgaaacatgtgtgcccaaatgacttcctcaccaacactatgaatgacgcatgactagaatgttcatgaaacttttttttaaattatacaatatcgttttaacccttaaatgactgaccactgagaagagtccagaataatgtggcgttttagtgatgtaacactttgtactgctttaaagtagctttttataaacttcgcaaagtcctagggaagaaaggagacaagaaaagctgactgaaggtagattttaaattggataagatgagacaagtgaacttcttatttttttccccaagcttaaaaaaacaaaactgtactagcaccttctttcttgttgtatgaagttacaatgttctgcctgactttccaggtcctctgtaggacctttccaggtcctctgaaccattcagcacatacaaccatctcatccccatctgccgtccaggcacaagactctggcaaccaggccaggctgtctactgactccccaaaatacagctgctctttccttatggctgagctgttctgctaaggattctgtccccagcatggccattcctctttcccgaacttaatcacttcctacctgtccatacccctaagactagctcaggaatcaacctctctccactctgaccctcagagtccttctctcctggaatgcccgcatcacttagaatcctcaggacacaactgagtgcatgactacggacacttttacattgcttgctttctcacgctctgtgctagttttgatctcccactaaattgaaacctcaggaacatgcgttatacttctttatccatcttggacagtgctcagctcatgcgtattctttcaaacactatgtaataagcacttactatgtgccagatagtattctaaatattacaaaatacagcagtgaaaaaaaaataaccctctgtcttcaaggagcttacatctacagggagtggaacgaaagggacaataataagagaccaggtcagaaatgtaacatggcaccccctggcatacagtctgtgagccattataagaatctgacttctctgagtcacatgacatgacttatatattcaaatggtccttacagctattgtgttggaaatctctaataagggagcaaaggcagagcaggcagatgagttgaaggaacctgcaatcatccaaggggtagtgggggcttagaccaggaaagcatagtagacgtggtgataaaggatcatattctaggtaccttttgaatgtagtgatgacaggacttgctgacagaatggatttgggtgacaaaaggacaaaggagccaagagcggcccagtggattttagcccgagcaacccagaagacggaggagcatgaggtaagatgcaaagactgatggaagaatggactcagggtgacgggagggggcaggggcttcttgacagatataggaaaggaatttcgtaaatgttgagtgctcattctagaaaagttggggtttatttccatttcatcttaaaaatcaataatccaattactctactgctgataatatcagtttctcccatctacagttattctttatagactcaagattgtgaggaaaagcaagtactgatgagttcaactctttcaaagaattctctacagtttcggcttgtttccttttttgaaaatttttgtgggtacacagtaagtgtatacatatttacggggtacatgagacatctgggctcattttccttgttgttaaatatggtgatggcggccaggggaggggtgagagaggaatcattgttaagcatctagctcataaaaatgttcttgtaataggttgtatatgaagtcagaataataaataaatgaatttctttatacctcttatttactcaggtagtcatgtactcttcatcaaacttttattgagtacctgatatatacaggcattgcataggttataaaatgctcaaaactggattcctcaacttagggcaagtaagaaaattttaacatctgaaaatcaatacaaacaatagctgcatatgttagatatccaacaggactgggctgagacctgagcagttcatttttcctcgatggacctcagttttctcatctgttaagtgaatagccttggactagttcatctctaaggctcttaaccattctaatattgtatatgaaggacataagcaagccttaaaatgttcttttgaaagaacttcaaaagatggaagaagggaaggtagcacatccatgacaagacagttccaaaatcattcaaggaagtagatagtatagattggttatggaactataaaaatggtagtaaaaaatttgttgaaaaatcaggagggcttcaattacaaagttttttttttttttttttttgagatggagtttcactctgtcaccaggctgggttgctatctcagctaactgcaatctctgcctcccgggttcaagcgattcccctgcctcagcctcctgagtagctgggactgcaggcatgcaccaccacacctggctaattttttgtattttagtagagacggggtttcaccgtgttagccaggatggtctccatctcctgacctcatgatccgcctgcctcggcctcccaaagtcctgggattacaagtgtaagccaccgcgtccggccaaaagcagtatgttttccaaatggcagtaatgtacaaggattgtgttccatttgatcaaatgtgctatattcaaaatagccctaagctcagcaaatgatatcttcagagtgcaacatatgtgcacagaaatcacatttgtgtgctttaatcagtagtctcaattatatgcctaattgctgcatgtttgcattcaaggtgatgatccaaagatttttaaaataaatattatgctaggctgggcacggtggctcatggctgtattctcagcacttttggagaccaaaatgggaagatggcttgagcccaggagttcatgaccaacctaggcaacacaatgagattccatctctacaaaaacttttaaaaaagatagtctgtggtagtctcagctactcagtaggctgaggtgggaggattgatcacttgatcctgggacgttgatgtgcagtgggccgtgatttcaccactacactccagcctggacaacagagcaaaaccctgtctcaaaataacataacataacataacataacataacataacataacataacataacataacataacataacataacatgacataaaatgaaacaataaatgtcatgctggaggccaagattttttttcagtatgcaatggaaagtcaagaaagatgtataatcaggggagaaacacgaatatgattacatgataagatttacttatcagtagtagactaaagtggaagagagagaatatatgggcaaatactacgtgttgcacacagatgacagaacaatgcaatgggaccaatgctaccaaaagtagcaacagattctgcctaaaactattctaagtctacacacaaaaggctgagaatgtggaattaatggcagtatgtgtgtgcacatgagtatgtacgtgtgtgtgtatacattttttatatatatatatgtgtatatatatatatgtgtgtatatatatatatatgtgtgtatatatatatatatatatgtatatatatatatatatatatataaaacagagtactcaaaaggaataattcttcaaagatagaaataacaaatataaggctgagtgtagtggcttacgtctgtaatcccagcactttgggaggctgaggcaggcagatcacctgacgccaagagttcaagaccagccttgccaacatggcaaaacctcgtctctactaaaaatatgaaaactagctgggcgtggtggtggacacctgtagtcccagctatatgggaagctgaggtatgagaattgcttgaacctgggaggcagagattgcagtgagccgagatcgcaccactacactccagcctaggtggtagagtgagactctgtctcaaaaaaaaagaaaaagaaaagaaataataattatgagtgatttgtagaccactggatttggtgaaaagtggaagactcaacaatgacttagctttgtaggaggctaactggaaagacagtgttaccaccagcagaaaacaaaaagaaatgctagacaagttaagtgtgctgtgtgtgtgtgtacatgtgtgtatatacacacacacatatatacaactagtttcagagagtcaaaaagattatggtcttgatgggaaatttattcggactgaagaaggttccttgagtaagattcagtaggaaaacggctacctgtccatatgtctgatccagttccagttatagtcaaagaaagcattttctaactatgcttcccttacaagtaataaatgttcatgatttacactgctggacacagcatgaggcaatctttcaggtttgctgttactatgtgaagtgaatgatgaaaaacgattttgaatggcatgtttatttttaaaaatgcatcagaatgattttattgtcagcagtgaaaaatcacaatacagatatatattggacccagaattcattacacattttctcttaagtttactatgtgatatattgctatttgttagtagggtagttactatttcaattttaagctaaagtatataaatgttacaggttatttttaaattaaacaaatgttgtctgcttgtaaaagaaaagtatttggtctctcatttttaaaagtaaccttacatatagatatttaaatattttatatatttactattatattttaataaatgtcttctacttgcaattatttatcacataacatgtttaaatataagaaatatatattttttgctagtaaatttgctagtaaggtagttattatttaaattttaagccaaagtaaataaacacacagggtattatttttaaattaaagaaatgttgtctgcttgtaaaagaaaggactttggtgtgtcattatcaaaagtaatcttacttatagaccttgaaatattttgtatatttattatattttaataactttctactacttgcaattatttatcatgtaacttgtttaaatataatataaatttttatttcttatagaaattacttttatagttacagtacactttttagacaatctattttttctgcagttaatttcctttaaaattgatattgaggtatacaaaaattttattttcttaatttaagaatctagatatctgtgaattaatgacatatttgaataaagtaacacttagaagaaaagatttaaatattagatcctaaaatgctgtaaggaaatttcctacttgattttgggttttttgttctcctagcatgtgtttttatgatgtagtggagaaaccagtctcacctgtttttgattgtaggtttcttcttggctcttcaggggcctcaattggctgatcagccaagaaaactcgggcctggtcgacagcattcaggacagaatattctttctcctttaactcccgtctcagggcctttcaaaagagaagcaaaagttgagtttgtaacctcacgtgttcaccaaattatgggacatcttcaactataccacttctgaccacacttagcaagaaaatgactaatagcaagcatttcagctaagttagaagccaaaatgtaaattttatagatatgaatgaagaaaaatacaaaggaaaaaagataatttctgtaaacgttaagtatacaaaaaaagaaacagctttaaaatattcacttaagggaaattgttacagtgtatttgaatttacacaaaatgtacttttaggattttcactgatgtcagattgataaaatataatagcctttgctaagatacttttttcttgtaagactgactgacaaaaaaattacatccaatgatacagagaaaggtaatttcacaagtagcaataagatcctcagaagggttttacattatttagaatacattaagaaaaaaaaatgaagcgatagaaacaaagtacatacatgaaatcaaaaataaaccaatgagggcacatataaaacagtctccaattatcttaaaatatgttccatctctcatgctgaggcaattactatttttcttttgtgaggtttttcatgcaaatctatgattctcagaatagtttctctttagcacctttgttccttgaagtggagctaaactttcacccctgcacctataaaaacaaccaaactccttcagtgactgctgcaagataagagtaatgaagattttcccaggtgcaattttaacgctgttgccaaatggaatttgttaatgttgttatcctcttaaaattaaacacataaccacctactggctctagtattttgccttcggtgtagttccctggcaacctattatgaaaagtcagacttttattttctaaaatactgaactttcattatatgttagaatgaataaaatctttccttttgaagacaactaaatttttagtagtatttgacatcactatgttgagatgctacagtatttgcaggctagatccttttcttccatagtcaataaaaggtaagaatgaaaaaatctagaaataccagaataattatcttatataaaaatatggatctaagcaacatacacacaaaaaaaccctggtaatgaagctgacagagactaatgggctacattttctatatccagaaaatctcatgatagcctttaggaaatctaaagattcaaggaggatttagcagtaaatcaagagtagagtgcttgattgaataaggccatgaagcatgcacacgccacccgttaccctcctcaagtactactctagaaaccactattactgataattttcctactcgtgtatagaggagataagtcataacatggtaagcatactggaaagtgtgcttggactaaccaaagtgtagcttaaccctcacaggtggggagggatgagaagagctgacaagaactagtgagagacggagtgacaaaaatgctatttttttgtgtgtaagcattgtaaatattattttgatttttaaactatacaattattactttgataaaaaatttaaatgaacgagcaaagtgaaccaaaaaatccacaattaagatatagtgatgtaacacaggatataggataaaataaaactttctctaaaatgcaaaggtacatttatatgtccttcctagatccataaaaccaaagactgacagcgaagcaagcacaaatcaactaaattcacacagcaattatcactgatgagcattaaatgactatgttggtgggtgggggcggggataacaaaccttccatcatctcctatttaacaaacgcagcttgtgaagaaatcgcaggatgtgtgacattcaggaaattaaaaaaaaaaaaagattatatacatctggcacttaaagttttaatatatggaaataaaaagagatacaagaaaaatggaaaaaaaaagatttttaatccaaaaaaatacacatttacaagtcttgagccagttctttaacttagattattatgttgttagagcaagaagctctagaggaataaaaatattcctagcatttacttccataatcacctaaaaatatataataacgacatgaaaaatcatgttacttaaaaaatagtgaaaaccagcaggtaatatagcaaaattattttttttaattttagtggtcaagatatttccaaaatccaaatcaaatcagtaaatatgggagcagtaaacattccttttttttttttttttttgagatggagtcttactctgtcacccaggctggagtgaagtggcataatcttggctcacttgcaacctctgcctctcaggttcaagtgattctcctgcctcagcctcccaagtagctgggattacaggtgcctgccactgcacccagctaatttttctacttttaatagagatgggattttaccatgttggccatggttggccaggctggtctcaaactccagacctcaggtgatccacctgccttggcctcccaagtgctgggattacagctgtgagccaccacacccagcaaggagtagtttgttgggtttttttgtttgtttgttttgttttttgagacagagtctcgctgtgttgcccaggctggagtgcagtggtgcgatctcagctcaccgtaaccttcacctctacctcctgggttcacgccattctcccgcctcagcctcctgagtagctgggactacagggccccatcaccacgtctggctaatttttttgtatttttagtagagatggcatttcactgtgttagccaggatggtctcgatctcctgaccttgtgatccgcccgccttggcctcccaaagtgctgggattataggcatgggccaccacgcctggctcaggagtggtaaagattcttaaaatgctgtgcaaggcctgtgctagatttcttcctggggaaggggaagttccaggaatgtacagatttaatgcaagccactgaagagaagatgaagatcttagaacaggtcttcactctggtttatcaaataggaggaagaattcacacaatggcatttagaatttagcacaaaagatcaaccagaaaacaccaataggcaataatgtggaaagattaaaaactgagagaagacgggacataaaggcaaatgactcagagaaggaagagcagaggcagaactggccctctggaaatataaaactattacggggcatatattttacaggcaaatccagatcttttgttggagaaagaagacaatatgatctgtgcaacttaggtgtacagtaatttctgattaggaattctagactattaatagtccacaaaatgtgcattgtgcaggggtgtggggagggaagagggcaaaggagagatttgtcttggaacttctttttagatttcaaaaattgaaatggaaatatgtacatattggtctatagaaaggatactttggaaaaccaacctatcaacttcctttatggatggaattttatttgtttaacatggagactctcacaatagagtaatctctttggctgtctgtttgctctgcctggaaagctctttccctagatttagccatatcacagattccctcatcctttttaaggctgtctagaaggtgaggcccacccacctaccttattgaatgtagcattccacctttctcatcccctacatttcccattctcattattctgcttaactatctttgtatttcctagacctggcaccttctactatgcaaaagaggtgacatttctatatttcttgtttagtccctctcttagataaaatataagctccactagaccagggactttttctgtttttgttcagcatggtaaacaaagcacccagactaatgccatgtctgggacctagtagagccttgggggatctgtaatgcttcctgggggaggtggtgcgtaaattgagtcttgcagagagggaaaggtactcccagcaaaggaaactaaacactagcagagaatgcaggagtgtcacagtgtgcgccctcagggaactataaaaacttcagtactcagagagcggtagcagctgaagctgaaggtgtgggcggaggtcaggccacaaagaccactgcactgcttcctatgcactgagactcactcaacccaatcatgggctatgggaagccactgacaagttggggggtattgtcagatttttatttttgttttttataatgtatcattgtcaggtctcctggattcattaaaagcaagtctgagtcttagattgtattttgcttcctaaccacattaaactccgtgcttcagaaaacaaaaaaaaaagaaaaagaaatcctctctgcgcagggtgctggctggagaatgtctcgcgaactcctttgatatgccaatgtagggaagtacaggaggcaagcctgggcaggtgggaaccatgccaagtaagtacaaatacagggctctggccctcatgccaatgcaccacccaaatatcctacaaagcagcatacatatgataatttccattcatatcctgttttgtaaatttaattttgttattcaatttgtcctatttcaattatatttaattgtatgtcagaaatagatttaactttcaacagttttatacatataatcatttcacactttaactctctcaattagacataaaagaaaacctgcatttcccaaccacctggtgaacattaatgataagatcattagactccaatgagctgttttgtacacagagctacaaagtggcattcagctttaagttctaatatcacgtgactgatatatgggccaccttaaatgcatataacataatataattggaatttttctgttttaatgagtttatattttcattcaaaacagttctgttccagataataacaacttttggtgaggatgtgaagaaacaggaaccttgatgcttgttggtggaatggtaaaattgcaacctgtattagtccattctcacgctgctagtaaaaacatacctgagactgggtaatttacaaaggaaagagattcaatggactcatagttccccatggctggggaggcctcacaatcattgcagaagacgaaggaagagcaaagggacgtcttacatggcgggaggcaagacagcatgtgctggggaactctcctttataaaaccatcagatcttgtgagacttattccctatcacaaaaacagcatgggaaaaacctgcccccatgatttaattacctcccactgggtccctcccatgacatgcggggattattacaattcagtgagatttgggtggggacacagagccaaaccatatcacagccactctggaaatcagtttggcatgtcctcaaaatgctaaacacagagttgtcaacatgacccagcaattctacacataggtatataccgaagaaaaagaaaaacatgtccacataaacactcatacatgaatgtttatagtagccttattcataatagccaaaagatggacacaacccaaatatccatcaactgctgaatggataaacaaaatgtgatatatccataatacaatgacatcttattcagtaataaaaatgaatgaaatactgatatgtgctataacatggaagaattttaaaatcatgctcattgaaagaagctagacatgaaagggcatagtgtaagattccattaccatgcaatgtcccaaacaggcaagtctagagaggcagaaagtagattactcgttgcttaaggctggggaactggggagggaggggagggataggagtgactgcttatgggtatggatgttctttttggaatataaaaaagttatgggccaggcgcagtggctcatgcctgtaatcccagcactttgggaggctgaggcgggaggatcacaaggtcaggagttcaagaccagcctggccaatatggtgaaaccccatctctactaaaaatataaaaattagccaggcgtggtggcgggtgcctgtagtcccagctacttgggaggctgaggcaggagaatcacttgaactcgggaggcagaggttgcagtgggctgagattgcgccactgcactccaggctgggtgacagagcgagactccatctcaaaaaaaaaaaaaaaaaaaaaaaagttatgaatctagatagcaataatggtgcacaactctgtgaaaatactaaaagcccctgaattgcacactttaaatgggtaaatattatgatacaggaatactatctcaacaaggttattattaaaataaaacaataattctgttttttacacaaaacaattctctaggtaatttgtttcttttttttctttcttttttttttttttttttttgagatggagtctcactctgtcgcccaagctggagtgcagtggcatgatcttggctcactgcaacctctgcctcccgggctcaagcaattctgccgccttagcctcccaagtagctgggattacaggcatgcaccaccatgcctggccaattttttttttacatacgtttttgtagaaacagggtttcaccatgttgcccagggtggttttgaactcctgagcttgggcaatccacccaccttggcctcccaaagtgctgggattacagatgtaagccactgcacccagcctaatttgtttcttttctagtctttatccccaatgcatatgcaaagtaagagctcattctgtgtgttcagtatgtgcaataacaagatggctgctcccacctcagtgtttctagagcacttcctattcctctaacagagcttgtactgtgttaatgtgcatatattttgaccatgcatctgtcccctccattaaattgtgagttcttgcatggtaaggttcaggtcttaatcatctgaaatcctctactgtacctgcctagacatatatagaaagcactcaataaatgcttgagcataataaattatgggagaaatgctctcagaattaaatactatgtatttaatgttacaaaacatgtcagagcaagatataacaaagtcacccaatctgttcatcttaaactgaaataatggatttcagttagttctgtatttttaaattatctactttgcaaattgctggtagtaattttttgatgtaaaactaagtctgtgctattaataagtatttcagtctgcagttggtttttattttagtaatagcaaatatccttttctctttttagataaataaggaactgatctgactgtcatggatggtatggattcactctgtcttcctcattttgtgacattctcacccatgaggtaaccccttagggcatggtttccaaattactgtcagtcattagaattgaagggtgtttccattatcatgactgtgtatcaaacctatataaaacttatagcttaaaacaatgacaattatttttcatgattgtgtgggttggcaatttgacctgttctttggctggtaccacctgggattactagtgaggttatagtcatcctgcagcttggatggggagggcgggacaaaacagcctcactcacatgtctggaaatcatcactgcctattgtctggggtacctcagtttctccctatgtcgtctctaattgctctccaatatggtacctgctagtcacatatgtttatttagtatctgaaatatgactagtacagctgaggaactaaattttaaattttatctaattgtgatttaaatacaaatggttacatatgtctaagggttcctatgttacacagcaaagctctagagtttgcacatcacggtgtcacagtctattgtttgaagcatgtcatgaagccagaacagattcaagagaatggaaaaatgtactttatcttttgatgaaaagagcaaaaatttccctctgcataggagtgtggacacagggaggcatgattcattactataaaaatctaccacacaggatgagtgggagaggatggtgggttgaagatgagggttggtaatattttgtgtaagtggtcagggaaggcatctgaaagacagcgatatttaaaaaaaaaaaccggagggaagtgagggagcaaggcatgagaatatctggcaaaagagcaatctaggcagagaaaatggaaagtgcaaaggctctgaggcaagtgcatgcctagcttagagattggtgctctcagagctgagtgagtgaagaatgagggtgattgcttctgttaaaatgttttctatcaaggaagttagggaaagagtccttgtggttgatgggagagacacctagcaaccacatacttctctatgcagcagatatctggctacttgctggctcaaggcttggccattgagctaaaagtgctcttacatgacaacctgtcacaaagcttatgtattttgcattctacaggttgagcatccctaatctgaaaatcccaaatctgaaatgctccaaaatctgaaacttgagtgctgaaatgattccacacctgatactcttgctttctgatggttcaaatgtatacaaactttagtgcatgaaattatttaagtattgtataaaattaccttcaggctatgtgtctaaggtatatctgaaacaaatgaatttcatgtttacacttggttctcattcacaagatatctcattatggatacacaaatattccaaaatcccaaaaactgaattttgaaacacttctgatcccaagaattttacacaaaggatgctcagcctgtagtagatatgtgaaaagaccttcaattcccctcccagacaaattgtataaagtgaagttttggcctccaagcaatagaccagcatcagttagaataagtaggaagatacaaaataatttcaaaaaggaaaactgaggctggctgtggtggctcataactgtaatcccagcactttgggaggccaaggcaggaggattgcttgaggccagaaatttgacaccagcctgggcaacatagctagaccccgtctcaataacaacaacaaaaattagccaggcattgtggcatgcacctatagtctcagctgctcaggaggctgaggcaggactgcttggctccaggagtttgaggctacagtgagctatgatggtgccactgcattccagcctaggcgacggagcaagacactgtctcaaaacaacaacaacagcaacaaagggaatactgaaatcatgttttagaagtcgcatgctctgaggtgtttagtagaaggagatataatcccaaatacctcaagagtcaaaaataacaactggagagcacaatgattatcttgtgtccaaaagaaaacattcaaattttctcccatccttaggtggcattaaagtatataatagatttttcaacaaagatttccaccaaaataaaaattttaaagtacaaatatatacaatatataaaaatacgttaggcataagagaaggcaaaaatcagctataaactcaatctttgagaaacttatagtataaaggggaagagagaacaatactagcccagaacgtggttaagtgccacaaatctctgaaagaggtacacacggggtaccaaggagcctcattatgaataaatacacagaggagggagggaggtcaaccttctcaaacacacatgagctgtgtgttgaaaaaaaattgtaactagcttagaggtaataaggtggaaagcaactcaagaaaacagatagaataaacacattgaaggtaatgtagtctctcatggcttgtccgattgtgtaccttccacatacttacttaaactaaatgaagccgtgaaatggcagattaatgaagacctgattgtaaatatcagaatgtagctactaaaaatcacagtttccattctcaacagaatgtctaagagcctgaattcactttattgaagacacccttcctcctgtcccacctctccgactccttcgaactcagggtgctctttggatgctactggtgtgcctctgagcaccaggcagccgaataaactgctgcttattcaactttaaatgtctatacagagattcccaattatcctcctttaatggtcttggaacatttctcccacctgctacaacttagtgagaaagacaagagattaaaagataagacggtataaagaagtgattggcgtggcttagggcagaaatacttggaagtcaatcagctgatcttcattttcttcatgagcatggcatcagctcaccataatggctgggttgctgacatcactgaccgagatgggatcctgcaaatcttttaataagaaaacagggtctaagagaattggagggaagaggggaatccctgctaaacccttctctcctaaactagcagttggtcatatggactgagctaagaacagagaaaagcaaacatgtgggtgtgaaataaatcctggggtcaccccccttctttaaatagcaactctttcctaacctttcttcaatctaaagccattatccaaattgtccgtgtatcaagcaccaaactttgctaacatgcacttttcttaaaattttctaaattacaaaattaaaatgatagataaatcagatcctgtcttctgtttaaaaccctcctcccatggcttcctgttgcacttagaataaattctaaacttcctaccaaggtctggaccctccctgctgtctgatgtcatctcctaatacaccctcatttctagcttcaaagtccttatttctgttccgagaacatgccaagctatttcctcctcatggtctttgcaattcagaaggcttttgcttcaaattttctttctttctttctgtttttgagatggagtttcgttcttgttgcccagcgttgagtgcaatggcgccatttcggctcaccacaacctccgcctcctgggttcaagcgattctcctgccttagcctcctgagtagctgggattacaggcaggtgtcaccacgcccagataattttttatatttttagtagagatggggtttctccatggtcaggctggtctcgaattcctgacctcaggtgatccgccttcctcggcctcccaaagtgctatgatcacaggcatgagccactgagcctggccttgcttcaaattttcaatagctctgctctttctcattagattctagcactcagtatatcttttggattaatgaatgagaaaatgaataaactggcataaaagaaaatgtggaacctcaggaggccattgttagaaggggatcaaggaaggaaaacacctgagaaatgggagcatttcatacaaagtaggtctgtggaagaaagcagcatggagcaactctgcagtagaaggaagtagtcttccccttccagcccccatagaagacattattatctcaagacaacatctgtgttgttttgctttcttaacaatctcattgaccctcactggtgaaagtcaaagaaatccacagggctcaccccttttgacccttcagggatccggctccagtgccacctgcaccaccagcatgagctgcagccttccctcacggggatccagcattcaccacactccctcaccatggcctctttgcaaacctgactctggtgccagactgagccctcatggaaggctgaaatttgtgccagagcaggtatagcggaaagccaataaatttttgtatgaatgaaggaggagatgttaaaaatactgttctgtggtaaagtaaaaccagacaaagatttgcagccaaagccttaggtacagtccagtccataccacacaggcacacccttactcatcctgtgctcatgggcccttacttgggtttgtcccttaaattctctgcgtgttaatcatctctctcattttactaacttcactggtgagacagtgaatgaaaagatattttgaaactattcagtgctgtagaataaaaaattactttttttaagagacagggtctcactctgttgcccaagctggtacaccatcaaagctcactgcagccttgaacttccgggctcaagtgatctttctgcctcagcctcttaagtagctaaactacagttgcatgccaccataccaggctaattaatttttttttaaatagggacagagtcttgctatgttgaccaggccagtcttgaactcctggcctcaagtgatcctcctgacttttcctcccaaagtactgggattacaggtgtgagcaccactcccagcccattactattaaaatcatgctaatctaaaattctaccatgtttctcagctcttgtctcagactgaatttctttccaaagcctctattcactcttacttgtagaggaaggttctagccattttacctagagctttggttgaccaatgccagaacaaagccctccgtttgcaggaacatctgaaagtagatgacttaactcttctaagggataaattatttaattatgaaaaaaatgggccaggtgcagtggctcaggctgggcacagtggctcatgcctgtagtaccagcactttgggaggctgaggcgggtggatcatgaggtcaggagttcgagaccagcctgatcaacatggtgaaatccccgtctctactaaaaatacaaaaattagctgggtgtggtggcaggcacctgtaatcccagctacttgggaggctgaggcaggagagtcatttggacccgggaggcggaggttgcagtgagccgagatcgagccattgcagtccagcctgggcaactgggcgagactctgtctcaaaaaaaaaaaaaaaaaaagaaaaaagaaaagaaaaagaaaaagaaaaaaatggaattatgtgattctccaagataaagccaaaatatttcataagcagaaaactgtgttgcaagactcatatcagtttagattcttagaaagcaaagaaataaatgcagcggtttttttgtgaaccggtttcttccagaataaaagggcaaaacaattctctaaggaggtataaatggtcagctagatgacatcacacacactaatttcagacaaatataaatttcttcaactaatgtgtttaacaagccatggagagcttttctcctatccttctaggcatgactaacccaaacatcaaaccagttctcctcttcctctttgtggagagaaccttgactcaggtgtctgatattccaaaactgttttctaaatttctatacatctatgaagtactagtattttactgctaacaatacaaggatcactaataatagaacaaaaatgagaaatcacaggccagggtatggtaaagcttcactttcacacattgctggaggcaaaaaattggtttgatcatttgggaaagtaggctggcaatatatcaaaagtcattactatggtcatattgtgtgaaacaggaatttcacttttgggaatatatcctaagaaaatgatccagaaaagctacgaacacaaaagtgttcattataacattatttatgatttttaaaaaattgaaagaaacttaaatctccaacacctggaatatatttaggttctatgatatggccacaatagaggccattatgcaaccttgaaaagttattgtgataatgaccacatagcaatgtgaagaaataggcatgacatgtatctaagtgaaaaagatgacataaaaactctgcacccaagtaaaactatgcaaaaggtaaatatgcaaaaaggaaataatgcaaaatgaaaagggttgttatggtgataaaattatggccatgtttttattctttatttcataaactctgtaatatgttattattttcataattaaaaattatacttttaagaaaggaatgcccactagaattgagctcatttagcattgaataaattactgctttcaaagaacagcattatgaagaattacaaatgtgtttagaagcccattttttgtatttgtaacaattataaaactttccctttatattttgcttcaatgacttggggctatatttatttataaaatataatgcatgacaacatagtcactgaatgagagactccacatgtttaagcttctccctgcatttgttaagaatctcaactcaactagcattcaaaggtatcaaattcctacaacagagagaagcacaaacactggaagaatctagcaatatccagcacatacagctaaaaaaaaaaaaaagctatattttaaaagctatctcaacaattaaaggtatgccaattcattttcccttaaataaaaatctttcccattcttgagttgaaaatttaggcagtattaagatagagaaaagataacctctgaactgactacaatatcaaggcataaagtgccattgtgttatttaatttgcttacatttcaaatatgtcatgtaactgaaatgatttctagctctcgagacaagattattgcttacacttctatttcagttattacctttattaaacatttggctatttaaagtaggaatattttcaaaatgtaatattctttagaacgcaaatgaataaaaaagaattactgagaaataaagagacaaaaggaacattcacaccaaaggacatgttcccttgggtatagctctttcagtcaacattcaacttttatcgagcatccagagtaccaagcaaaaaaaaaaaaaagacatagaaaataagtcattgtgttagattctgataaatgctatagaaaaagaaagaagtagaaaagggtggggggggaagagagagagaatgagagagagagaaggagtgctcagagggagctgcagttcaagtagagaagttgagtaaagaaggggcattttgggcagagcagacaggctggcactgtgactgaaagctcagcaagggaccagtgtggccgaaaccagtgtgtcagagaaaaaacagcaagagaggaaatgagcaaggtgtgagtagggggtaggtcagatcaggcagggccttgcagaccattccgagagctgtggcttttcctctgaataagttaggaagcccctacagagtttgatttattttaataggaacactctggttgctggactgatacttccagagacagaggagtgtcacaggtggtagattcagattctatattttgaacagagaaccaacaggatttcctaacagactgaaaatgagagaaaggcaggactaaaggtgattattatttgttacctaagcaactgaaataatattcctaccaactgaaatgcagaacgctgggtagaacatgttataggggccaattcaggaagccagtttggtcatattaactgtgaggtgtttattacacactcaagtagagatgacatgtaaacggatatatctttgggagtgcttggcatatagatggcatttttaaacccaagaaggagtgaatacagagaaggtgacatggcctgacaagtgacacatcccaattttagaagacaggggagagaaggaagaaccaggaagggaaactgagaaagagctaccagtgacgtaagaaaaacatcaggagagtgcggtgttctagaagtcaagtagagtccgaggaacagttaataagtcagcaggaaaggtgaggtcttggaatgaacccctagtcaaagctcagccaacactaacaaacagagacatcacaaattacaacaaggggcatgtaactcagagtggggctcaggatggcttccttacctaaggagatggaaagatgcttgaagcaagttttaagaggcattcaatattgtgttacatgtgtcagaatatatatgttaatgttcttcgcaatgcaagcaggtctggctatgtgattgcagacctcagtgtaacagggccccttgtccaaatattactaagaatctcaagatggcagcagaagaacattaagccaagtgcagaaaccttgtaagagcagagccctgtgtgactgcatgggacacctgagaagctggccctaaatgcagggtagctgaattataacaaatagaggtattgctggtacagcaggcttctttagcttttggtttcaaaaaagcagttaactgcttactggagaatataagcagaaaaaaataaatgatgcaaacatgagacaaatctgctagaatgtaatttactcttttcccaacttgctttcaaagctaaatcagcatatatggatctgaagtcattacagaatgacagcaaaaaagggcagagcactcattaaatttgatagcactaataaaactacatgaaaaaggagacagaaaacaggcttactttccgttggtatgcagacaaaatttaaaaaaaaatctcctacatagtgccttgaaagttttggttaacatccctcaatgagcagttaatatacaaaattcattttggttccaccccagtgacataaaaaataatgcctgaatcagaataccaaatatcaatgttaaaaatgagacagaaattcttttgcttttcatagtaataaaatagtatccttccctgtacttttttttttttttttttgagacagagtttcactcttgtttcccaggctggagtgcaatggcgcgatctcggctcaccgcaacctcctcctcccgggttcaagcgattctcctgcctcagcctcccgagtagctgggattacaggcatgtgccgctatgcctgacaaattttgtatttttagtagagacggggtttctccatgttggtcaggctggtctagaattcctgacctcaggtgatccacccacctcagcctcccaaagtgctgggattacaggcatgagccactgcaccctgctttttatttatttatttttttttttgagacagagtttcgctcttgttgcccaggctggagtacaatgctgtgatcttggctcactgcaacctccacctcccaggttcaagcgattctcctgcctcagcctcccaagtagctgggattacaggtatacaccaccacacccagctgatttttttgattttttttttttagtagagatggggtttcaccatgttggtcaggctggtcttgaactcctgacctcaggtgatccactcacatcagcctcccaaagtgctaagattacaggcatgagccactgcacccggccccctgtactctttaaaatacatgcacacataaatgtattccttcatccagctaatatatgcaatacaggttgagtatctctaatccaaaatctaaaatacaccaaaatccaaacatttctgagtgtcaatattgttactcaaaggaaatgctcttaggagcattttgaatttcagattttctgattagggatggtcacctggtaagtgtaatgcaaatattcgaaaatatgaaaaaatctgaaatctaaatacttttggtcccaaatatttcactaagggatcctcaattagtacctattctaatgtggcactggattaggtgctgaacttgtattttcttctttcagtcttattctaagtatcatcacaaaaggaggtaagcagcaccccttactctactgcatactccaaaacatgccatggctaatttggaggattttctccctaaagcattttggtaacacctttagtgatttcttacttattccaaggcatctttcagctcaaaagcatcttgctctgtggagcctttcccaatcttcccaagcacaaataatcgtgattcatgtctccttggctgtgtgtccatgcctgtattacagcacttttaatatctactgtagtacttgttttcaagcctgcatcactgctagagagtgaagtgagctccatgattgcaaaaatagtcttacaaactcatgcatgcttggcacctagcaaagtatgcagcaaacatcaggtacaatatagaagtttcaacctgagtgaatatatgaactgctagataaaataaattatctctgggctaaatatgtgcagaggcagtaaaatgattgttttgcaaaagggttcattggttttacaggcctctgtttcttgcctacatttgtgatccactcttaattttaccaccagagagtgacacctattaggctgtctcacctctccctctaaacatggacattctatggccctttggggtaaagttgcaatattacatattatgattaggagacaagtccaggtgcagacaaccaaatggggtgttgcaggtaggtgcaggctcactgacagaactgctgcttcaggcctgcacacaagtaacagcttgactaatgggccttaaagagctgagcgtttaataaggagtaagtcaacacagactggcaaaggttggagaggaacttggaaaataattttttttaatttcagaaaaagacaagtttcccactgtaggcaaccttctaacacaacaagacctcaaaattacagaatttcaggcagagtctccgattactttagtagggaaaaaaaattctaccacacctacgtgtgcacagacacacacacacacacagcctaaatttaacagtagggtgttgttgttttaaagacaatgttagaatttgttattttaatgagcaagtttgctaatgtttcttggcaattcagcttaaggccagatatgttctgagtcttatataataaagcttgaatataggaaataaactgggttaagcaaaggccagagtagccctgagggaaagaacacacaaacaagaaattatacctgaatcatgcactttcaattattctagatttgcttttctaacatcaaatatgcattctattggagaaagggtattagagctctgataattgctcctacataacttaatatttacattgttatgaaaatgaagtgcaaattgtacagtaaaatctgcatctgcaattttatccactcaagagcatttggttagagtaaatccataacattacaaacactatatacattgtaggtgcattataggtaattgttgactgaatgataagctcacattcttgaaagggaagttgcatataagtgacctcagcttcttcaaaacttcaaaaatgattctaaaaattcgattgaagtcattagatgggaagattcaactttacccatttattttattatttattagtaagctgcttttttttttttgtttgtttgtttgttttgagacgggagtctcaatctgttgccaggctggagtgcagaggtgtgatcttggttcactgcaacctccgccccctgggttcaagcgattctactgcctcagtctccaacaagtagctgagatgataggcacccgccaccacacctaatttttatatttttagcagagatgaggtttcaccatgttggccagcctaatctagaactcctggcctcaagtgatccacccgcctcggcttcccaaagtgctgggattacaggtatgagccacagtgcctagcctatccatttattttaaaacagtccttaaaacactacatattttttaagtagcaatttatgttaacatttgagggaattaaacatgtacttacacgaaaaaaataatgagtgtgctgtttaccaaactgatacttgcaaagactataaggtgacccttgtctaatttgacgggttaatctagatagtaattgaaagctagttctgttgggttatactaggtggtaaataacaggtattaatacagttttatttagttaaaactgctcatgtagcctatatagttttaaacaaaataaaaatgatcaaaactatcagaaaagactcccaacaattatgggaaaagatatcagccaccttttactgagtgtttactatgtgctaggccccaggtctcaaatgtttatgtattgttgaagcactgaacaaagtatttattattgatgttgctgaaaatatatcaatgttctgagacactgattaaaacacccaagaaagtacgcacatttaattaaggatcaacaatacactgaagtttcataatagcagtgcctggggcatttacactacggaaggaaaggatgccaatctgtgaatcactcatttctgtgtgtaagagaagggttttgagctgagtctttgctatggggcttcctgcctgctcatcactagggtctgctacatttttccagcagcatcaacatcactagctagtttgcttttctgctttgtttctggcctgtagaatgattgtcatgttttggagcccacaatgccatgtttggttttctgttttttatatttgatctataaccgctaggtgtttgaacataggagatgctttaaagcattgctttatatccctattctaaggcgaaatctcagagccatcacctaaacatttaaatgtaaagtattccctctggatacagccaacaaaccacaagcacagggcttttagtaataggaattattaaaatatatcactgaggtgcagaggctataccttattgctcttcgtacagaagcatcaactttaacattaagacatttggtgaatagtgtggataggtgggtggatggatggggaatgaaatgattggcaccactattatcaaagagtaactttgaaaaggagtcattaaatcatttatgtacatataaaggactagaatatataaagatagttcggaatcagaagactcagaatatatgagtttctataaatcaacccctaaataaaggttgtatatagtggtattcaaaacttgcatttatgagatcataccttttggaataattaaattagtgttaagttctttgtctcttcacaaaattccatctgatattctttagacatcttaaattagcagtgagagtttacgtcaaattaatcagtattgtgttgcttgaaataaagtaattcaaactattaccttaagattagagaatgaattagaaatcaagtacaaggtccctttctttctatgggaacttttagggaataaaaaaccttggctaatattagtatcaagccatctgagggttgatcttgattgattctaattatgtacttttgagctgtaagacaagagttctttgtagctaaaaagatttttaaactttattacaaaaaggaaaagacctaaaaagtaggagatcagaaaaaatactaacagaatttataataatagacaagactaaatgaaaagagaagcaactttatttcagtaagctaaaacatatctgaaaaaattggttttaaaagttattttatgttctgtttaaagctacatcataatgttataattgaaaagagttctgtattcccttaaagaagagattggaaataaatgggtacatgaactaaaagcttgcccgaattgcaacgaagtactatggtttgaatgtcccctccaaaactcaagatgaaatttaagtgacactgtgctgatattaagaggagcagcctttaagcggtgattaggtcatgagggtttgaccttcatgaatggactaatgtcattatcacagtgggagtgggttagttatagcaggagtgggctcaaaggataagttcagcttccatctcctctctgtcatgaacgctctcttgcctttgtgctttccaccattggatgacacagcaggaagaccctcatcagatacaggcccttgatttgaacttccccgcctctggaactgtgagcccagcctccaaaagtgtgagccaaataaatctctcttccttataaatgactcagtccctgacattctgttacagcagcaaaagacagactaaaacaccaagggagaaaagttggggttacagaagtggatgactgggcaaagacaacctgagatttgggataacaatgcgcagttcacagctcagccataaccttttgggaaatgatttctcaaaacacagagaacaggaactctaagtttaaggataagcagaggatctcccttgaatgtaaatttcatgtaaacagggactgtgtttttttctataccaggacctctctggtgtcttagatcctagaagaactcagaggggatgaaggcgtgaggagtcagaggcccgaggagtcagagcctctagagaagaaaggaaaatatgagaggccaaaggcaaagcctctaaacactttatctaaaaaatggcactcttttttatcgattcagttttgggactggaaaatacagaagacttcttggtttatacatggtcttgtaaaagaatcagtacttacaactctattgcaattccaagtattgaagcaatcgcagaattacctctggactacaaatttacaagattctcttcaagcaattcaaaaataactggctactatccaaaccttccattggtcttatcaaatgatcagacactgataaccaaataagttatctttactgaaaagtgaagtgaagacccatatatgcagctaaaaaaaaaaaaagttaattttcaaaaaaatactgtaaaaagctttaagaaacgagtttttaatgaaaattgaccaagaagttgatatttgtccataggtctccttttataagccatcttgatgtttaacaactcttattatattaaaatctgagtatcctagaacttaaaagaaccttattgaaattttctatacgaatagttttgagattagaagtcacctggggacacacaccacacacacacattcactcttacacaaatgcctagtccagcagttctcaaagtgtggtcaatagactaatagcataacattacctgagaacttgataatgcacatttgcaggccccacccaaaacctgctgaatcagaagctctgaaagtggggcctaccaatctgtggcttaacaagcccatcaggtgattctgatttacactataggttgagcccatatcctccagagactggcttaattggcctgggtaaatataactgagcattgatatcttttatatgtcctaggaaagtgcagccagaattgaaaacaactgatctataccaattctttcaattaatagcctcactgagtccagtgagattaagtgatttttccaagctattaggttttatgctattcctgtgttctcccaaacaacaaaataaagagacatgatttcttccctgatcatacagcaagtatggaacagagatggtctagaagtcaactatctcaatctccattgttacccattaggtttttttctctctaataatgttaaaggctatttaatttatttcatcaactttaacccttacattctcaactgggaacaaaaattggttcttggggtgaaaaaaatcttagatatggattgtgaccttccaaaatcagcctacccaacaaaatcttttgtattaatttctctcattaggaagaaatttatagttaaagctatttaatttaatttgaatttaatttttgtaattgaaaaggagggtaatgataaaaaggttgagaaaaaatgctttaaagggttttacaggcatactacaatccaggattgctgtgctctatgtgctatgtatagtcctattagtagctatttgttgcaagatacttggagccaaataatgtttacagtataggttcctggctactctttatgctgtaatttcactctgtctatcatgggcagtattagaaaatacactgggttttcacacactatcagtattttacctggattgtagtggagaatttagcatattgatgcatgcaatgggaaaaaaaagaattttgttaaaatttgtaaatgttcataaaaatcccagatatacagtgggatgagtatctctgggtaggtaaaaaaaattacggaaaattttccctcacagtcagtagctttgtttgatatttaccaataagtatatgatgacatacttgaaatgtatttgcagaatgtcattggaatattataatgagaatacgtaatcaagtttaggactaaatgaaagatgctgtctcatgtatgctttaaatagagaattgattttttttcaaaataaagttatttttccttaaaaaataaaataaactgccaggcatatagtaagtaaatgaaagtaagagagggaaggagggatgaaaactcaggtttgcttaaactacactgtgcctctcatgttcctctaccgtaaataagaggactggactcttatttcttagggttctttcagtccagtaattgacaattctaaattatacatgaatatacactaaataaagacttttcctgatcaatggaatatgacagcagaggaaaaggacattttcaaggacttaaaaaaaaaaaaagctgccctgaaatatagagcaatctcttacacacccataagagattttgatttcaagaaaagactcaggataagttagagacttaggtttatgttcgaacactggccaaaaactattaaataaactcttaggaagggaattcttggatgcaaggctaaggttaaactatgcttagactattcgataattatgactgatgatgttcagtaagataaataattacgggtaggtaccacacttctttaaatattgctctaaatctacaaatgcataatcattagccctaactgtaataatgtagatttatattagtatgaattaatgttaattatatatattttatataatatttatagtaacgtaattttaaaacattactcttggcaattggtaaagaaggttgcttttgacagaatatacataattaaataaaattatatactgcccttcagcactttacttttcctaaattactttcatttccactatttcatttgattgtcagaacaattctgtgtagaaatggaactacttgctacagtttgaatgtctatgtgtcaccaaaatttacaggttgaaatcctaactcccatagtgatggtattgggaggtgggtctttggaaggtgattagggcatgagtgaggagctgtcatcaatgggatcagtatcatataaaagactaccttccactatgggaggacacagtgagatgacatcatccatgaaccagacagtgggcccttggcagacaccaaatctactagtgcactgatcttgaacttctccgccttcagaactgtaagaaataaatttctattgtttataagccacccagtttatagtattttgttactgcagcccaaaggaactaagatactacttatttccatacactgaagcttgggtaagtcaaatgactttttcagggtcacccaggtcatcagtgacagagccagcctttaaataaaagtattctcattctagctcagtgccttttctactaccagtacctcactcacacctctaacccaaattatcacacctatgaggagccaacaaccctccttacctgcctccagtgcaccctaaaacccatggccacacacaattcacagtagattatctacattacagatcttgtgtctcacattaaaaaatgtgacactggactttcaaacctttactcacaaagcaacagcaaatgtcacaacctataaagaaaatatgaagaattcatgtttttgggtttttttgtttgtttttgagatggagtctcactgtgtcgccaggctggagtgcagtggcgtgatcttggctcactgcaacctctgcctcctgggttccagcaattctcctgcttcagcctcccaaatagctgggactacaggcgcacgtcaccacacccagctaatttttgtatttttagtaggggcggggtttcaccatgttggccaggaaggtcttgatctcttgacctcatgatccgcctgccttagcctcccaaagtgctaggattacaggtgtgagccaccacgcccagccagaaaattcatcttttaagcttttatttcttccctcgagtttttcttttctgtaagggtaatgtcaaacatgatggcaactaacttacttattaatacatgatggctaccctggaaggaatcaaggaatcctccagccctgtgacttcagcaatgacctacaaagaatgcttaccccaaacccagcacacctttctgtactgtgtcatgttctagaggaagcagataactggagggttttttgtataaattctgtgaatcaacttattcagctaatctataccgagtactaatttagcagaaagctagcattatacactaaaatattagttcttgagaataatatgttaatattcatttctttattgtccatttttggaaggcagctaaagaaaaagatagggtgaaaaaggtggcttcatattctttcataaactaagctaggaaactgacataatagagcaaaaaagagggaacagactcaagtaaaaacaaaaacaaaaatgtgaggatatatctccagtgcttagaatggtgctaggacataaaagttattcggtaagtaggttttaaatggatgatgaatatatttggagtcagacagacctaagacccactgctccacttgtgcaatggattgcatcctgccactgtttgagctggtatcctctctcctgcatcactgattcttcccacttcacagaatcattcttaccagcatagaacatgctgaataataaaataatattaatatattatttcataattcactactcagcaatgagttataaaaccactacttgaccctacattctttcttcagctactatctgatttttctgttacctttgttgtaaaagtccttaaaatggttttctgtacttttgttcatattctctcttgaatctactccaatcatgcttccaactccatcatgccactgtaacacctcttgtccaaggtcaacaagatggtctcgagatgattaattttctgtcctcatcttatttaacctctcagcaatatttgatccttgtgatcacgccctccttcataacacactttcctcctttggcatcctggactctgttctctcttggttcttctagccttctggctcttccttctcagtttcctcattttcccaacctctgaagttgtggctcctcagggctcatttcttagaatattttttttcccttggtacaatcacatacaatctctccctataggtgatctcatccaatcccagggctgatatacaggctgacaattttgatctctaatcctgatctttcttctaactcatctctaatcctgatctttcttctaacttcagatttatatatccaacagcttaaacatctataagcttaacatgtcaaacatcgagctcttacatttccttcccagactgctcctccagcagttttcttatctctctaaaaggtacttccattttctatttgctttgtccaaaaatctttgacttctgacatctttggctcttcttctctcattccacacatctaatccatcagcaaattttgttgattctttccaaatgtcttcagaaagcagttactcttcatcatctctcctgctatacccttttccaattcaccaccacttgggttactgaaatagtgctgaactcctctatattctactcttcataatttacctatattattacataatattagatcacagcactatagatacctacatcttccatggcttcctctctcattgagtaaaatccaaagtccttaagaaagaatattcaaggacctaaatgatctgaatccctttctcccacccgccaccccagcttcatctcctatctaccatatttggctaaattttttcaaacatattggtctcccagctattcctcaaatatgccccaaacattgcaggctctgtggcctttgtgctctctgcctcctttccctaaatgttctactttcaagaggggttgctaagtgcttactacatcactccaggtctctgttcaaaaatcacccaatttgtgatactttcctgaccttctccatataaaatagcaccttggcctataatcccacatcctcctgtatcttcttgaccttgctttatttttgttattaccgtaggacatatatatttattgcctatttgtctagtgtccatctctcacaatcaggtaagaacctggttttgttcattattgagtcaccagtgaccagaatatgctggttcatattaggcactcaataaatacttgctgaataaatgaaccaattgtattaccatcattatcagtattatcttcattacctaaaggcttaggtctcaaggactgaagcagagcaactgcctgcagtgctctaagatagagcaaaacacaacctaaatccaggttaccttgctgggagggaggccaaaatacagccaggacagactgagaggctgatacatactttatgtgctaaggccagaagaggaaaatcatttcatacctcaagatgtggatttcggtaaacactattagcatatggccataagcagcttgtattccttacagagcacatctattagaagagctttgtgttattctgtttcatccctaatactgtaacccacaaaaagggactactgtatgaataattaatagaagtaaaagttagaaaaagttaggagagaataggattttcttaaatcggtcattttaaatcttctattattattattatcttgcatatcatacatcaacagtgttttcctttttcttatcttggagctatttctctatcatattcctgcttcgagtagaaagaaaaaaaatacacccaaatggtaattttgataatctagtcacaagggttcaaaaagcaaataaataaatttcagggtcttatcattttgtattaaagcaacttattacataaatgacattttcctttaggagatgtgtgcattcgtgtttgtcatttttaaaatggaaatagaatcatagtgtcaccttaaaatgaccagatttagaatgagaactttcattacatgggaggagtgaaaaatacaataaaataagatgatatgtatatacaagaaaatgggcataaagagatattaaagaaatcaatggaaagtgaacaaggcacaaatttaatcacacaaggatctaaggattaatgtgtcagttgataacatttcagcatatcttttggctgatcagagtaaaagtatacatttgcataggaacagaaatttgagcagtataaaaatgtaatcaaagaaaaggcttggctcagaaaagtaaaacacataaaatgattttaaatagtatggtcttcatctgcattacttttttttttttttactacaagtccttatttttcacttttattaaacacaaacaagatagtttgtaattccttatgactcgatgccttttgaatttaagattaatttgtagtttaaaaattttctcaggtcgggtaaggtggctcatgcctgtaatcccagcactttgggaggccgaggaagacagatcacctgaggtcaggagttcgagaccagcctgaccaacatggtgaaatcccgtctctagtaaaaatacaaaaattagccgggcatggtggcatgcgcctgtagtcccagctacttgggaggctgaggcaggagaatctcttggacccaggaggtgaaggttgcagtgagctgagatcatgccactgcactccagcctgggcaacagagcgagactccatctaaaaaaaaaaatacaaaatacaaaattagctgggggtggttgcaggtgcctgtagtcccagctacttgggaggctgaggcaggagaatcacttgaacctgggaggcagaggttgcagtgagctgtgatcatgccactgcactccaacctgggtgacagagcaagactccatcttaaaaaaaaaaaacaaagttagttgggtgtgatggcaggcacctgtagtcccagctacttgggagactgaggcaggagaatcgcttgaacccaggaagcagaggctgcagtgagccgagatcatgccattgtactccagcctgggcaacaagagtgaaacttggtaaaacaaacaaacaaacaaacaaaaaacaaaaaaaacccaaaacctcaatatattatgattctaaaacctattagaaatttagataaacttcataataagctaaaagcaatattatacttcagatactggtagtgtttgaaaaaaatttagttaaatgtgaagataatacaaatggaaacaatgtatgcactttaaatgtctactggcaactaaaagcagacggtggtgggggggggaatcctgtgataattggttcaactctgatacttatctataattgtatttcaaatatctacctcactagaatttgaattaagcgactcactataggttatccacttaccttacaatggtcatactggagctgtaaggctggaacatctcctccaataggcatttgtttcttaagctcttcatctttcatattcagccatttgatcagttcttctaaggacatcagcaacctgttccacttctcagcgctggcctccaaatgggccctgttgagagataataataataataataaccacatttagaaatgcaaattacattcacaaaattatctaccttcctttagcataataatcttatctgaccaagtaatgtttacttccacaaaagagactgactccttgtaaatacatatatatatgtatttataatatactatatatacatatatatgtatgatatacatatatacaatacatatattacataagtatatatatttatacatatgtatacacacatatatccatttcctgtaagaaacagctattttgaataggctataatattcagaggatttattggtaataactatcaaaatttaaaacacagacctatacaaaacgaaggctttcaagaaggatgtccgtgatagaatgtacaattataaaccaagttttgatagtttatgtatagtatatacgcacatccaaatatatttttttctcattttatctctatacatggagagagagagaggaaaataaccactaagagcacagtaaatacctaattttagctatttttacgccatttaaggatttacaacagactcatagtatttttctttccaaaaaaaaaaaaaaaaaaaaaaaaaaaccactgactaattattattattatttttttttttgagacagagtattgctctgtcacccaggctggagtgcagtggcgcaatctcggctcactgcgacctctgcctcctgggttcaaactattctgctgcctcagcctcctgaatacagctggaattacaggcatgtgccaccatgcccggttaattttcgtatttttagtagagacgggatttcaccatgttgttcagcctggtctgaaactcctgacctcatgatccaccggccagggactcccaaagtgctgggattacaggtgtgagccaccgcgcctggtcttgattaacttttttaggaatggaaattactgatgtgttactttctcttgtaaccaaaaactccttctgttgtaaccaaaaagcagaacaatagcaatgtttacttcaaaaagttggaaaataatcaggcattgcttcgacaggatactatttggcttaaggttgaccaatgtctagtgacaaatgaccagtgtgaatagagaacagttgggcgaaagtcactgcagtactttatactctcatttaaaggtgaggtctttgtttcaataataatttctgcatttaacacagaaatgcaccttcagattcttagattatgaactccataatcacagatatgtttaggaaatacattttgatatggttaaggttccaataagagcaaaggcccttgagaataggagtataaatctatgcacatgttccttttttgctcttgttagggccctggtgaaagcccacttatccagcctcaggcccactggtgggctggatttgaaaatatggatcagtcagaaacaactccagcgactcaaggaatcgaactgggcttgactcaatcctgcatcatcccagagggcagactgtgaatgcgggcttatgccttaacttggggaaatggaattactgtgactgcccatgatctttgaggtttagaggtgtaacaaggcacacgtctgcctttcatcagcatatgctgattaaaaaacgctgtgtgaaataataaaaaaagtttaaatacagaacgaagttcaaagcattttgtaaatctctgagaacagtatgattagaaaatttattttcttgtatttatgatcagttctatttattccacaggtgctacaattgaactcattttacaaaactgtggttaacaaggtcctgattctgcttgagctccagcttttctgtgttcatattgattaactttaggccaaatatgtaattacctttccctgataactaataatttcacttgtcacagagcagaactaaataatttcaattatattaactgaaaattctctgtagttctaagccattttgcagcaaataaatttgactgagctactgcaatttctttccaatatttttaattgcaaaaccagctagaaatcagatgtcctcaatcaagaagcacttgagtgtctccgtgtgcaaaacatttatacgtgttccctgcccttttatttcagatgatttgatcctgcatcttcaacgtctgtagtttaactcaataatcaataactaaatcacacattatattcctttgaaattgagttgcaaacacttattgtattgaaatgcacacaaacatattttccaatgcagtcttctttgactgcacagaaataatgaaactgattactgaaacttacagtatttagaatctgaaaaactatctattaattatgaggatgaagacaatactttttaaaagaaatgctgaagtggctttgaaatcaaaaagaaaacattggtatatgtgtgcttctctgcatctttgatttttcatagtaaaaagcaagttgatctgccagaatctttgtctggcaaatctgttctggttattctcaaatagattataactatgtgtttagtggattactaccatatgctcaaataaatgcatgcttctgtagcagccttcagtgttctagtttcattttaattctttcatcttgaaagatgaaagccttttcttgggcaacaggtcgaatgctttgtaagaagaaactttaaatttgcgttcagcttagtggtactttctcaattatcctataagcattttaaaacttaaatttctctaagactattgataactagtgatcaaccagattttcaaaatcttcacataaaacatttctttatcaaacatatctgtgggcattcatatttttagacaattgacttattctaacatctcagctgcttcagttcactcctttagtactttgatatgtacaaagcaataaacacttttattgactgtattatcaacctaggatgatgtctactacagaatatcttttacgcaagttactccttttaaaattgaatcattttttacaactctataagtatttttaagtgaccagttattcttaaaaaatgtaatgcaaaaacatgttagaaggtaaagacccataaaaatggtacttcatcatttaagcacagtagaaaggaattatggaagtaactacaaaccagtatctgttttaaatcagcaaaagcctccaactttcaaacaaactgtatcttcaagcaagttattattccttctcccagtgtacagatataaaaggaaatagtgtgagtaagtgtgagaaggagcattggttaaaataaaatacagtttttcatttactcagcacaagtaaacatttacggagcacccactctggcagatatcccatcctctgttgtgtaatgactacccagaatcaaatgtccaatttggtattcttactacaaaagtatatatatatattttggtttatggtaaaatctccaaactataaattgggttataatgaaagaaaatacctttattagtccaagaacaacaagtaactttaaaagattgttcctactcccaggaaaggaattaagacatattaggagaaaagagtcaagtcttcagaattcagtctgacggtgctgaaaagaacaccaaagccgtgattccaatacagtagacatcagcagcatgtggctatttaaattttaatttaggataaataaaatgagtaaattttgaaattcagattatcagttgcactggtcacatttcaagtgctcattaggccacatatggctagcagcaattgtattaaccagtgtagatatagataatttctatcattggagaaagttctattagaatgtgctacactagagaaaccagaaaaaaaagagagcagttcctctattagatttggaaaaaaaaaaaatttagtagtttcacaatatggttaggaaaagcaactatctaaggctaaacatagtgtcaatgacactgtaaaatgtggtaacattagatttaaatgatgatgttaaaggttaatcttctctacgggcttttaaaaaggtgccctgaatttttaatagactcataaaagaaagggaagatagaattttatctttgaactctgttttcattagatttgacaattttactggcctttgaaaccatgttaataaagatctatattaaacatcattatgctgataaatggatatttaattaagacaatctcaaattaaataagtttaacatgaaaatttaaacccatgttatccacagcagagaacttattagtgtatttccaattcatatttttccagtgagtaaaaaatataataaaagttcctgacagcctgtcttctagctgacgtttcaaatcattagcattcttctcttgtacagattgaagtgaaatttatcattgtatgtattgttttagatgctaaaggagatgtagcatgttggattttagcatataaaaagtttaggctgagcgcagtggctcacgcctgtaatcccagcactttgggaggctgaggcgggtgaatcacaaggtcaggagttcaagagcagcctggccaacacggtgaaaccccgtctctactaaaaatacaaaaaattagctgggcgtaatggcgggtgcctgtaatcccagctacttgggaggctgaggcaggagaatcgcttgaacccaggaggcggaggttgcaatgagctgagatcatgccactgcactccagccctggcaacacagtgagactctgtctcaaaaaaaaaaaaaaagtttaatcatggctatccaaagagaatgaaaaataacgtttaagatattaacctatggtattgagccacatattattacattgttccaatggccacaccatggtcaaagaagttaatacctgtaaaacacttagggtagatctagcatataaatattagctgttattatgatcttagcagacattttctttttaaaaaattatgataaattagagcaaatgttccctgccatgacattttatgctataaaactttaatatcaactttagcgcaataaaagcataatgtgaaatacagaaccaatgcatattaaatactccaagtagcataaagagtatcaatcagatagcctcactctcaaaaaaaaaaaaaaggccacctgcagagagagaatttggggactaaaaaggatcaaaatcttttaaaataggcatggtgatatcagagcagaactgtaggagactgagacacaaaaaaaccattcaaaagatcaacttatccaggagctgggtttttgaaaaaaaatgaaataaaatagatagactgctagcaagactaataaagaagaaaagagagaagactcaaataaatgcaatcagaaatgacaagagggatatcaccactgaccccacaaaaatacaaccatcagagaatattatgaacacctctatgcacataaactagaaaatctagaagaaatggataaattcctggacacatacattctcccaggactgaaccaagaaaagattgaatccctgaacagcccaataatgagctctgaaattgagtcagtaataaatagcttaccacccaaaaaaaagcccaggaccagatggattcatagctgaattctaccagatgtacaaagaagagttgataccattcctaatgaaactgttccacaaaattgaggaggaagaactcctccctaactcattatttgaggccagcatcatcctgataccaaaacctgccagaaacacaaccaccaccaaaaaaacttcaggctaatatccttgatgaacatcaattcaaaaatcctcaacaaaacactggcaaaccgaatccagcagcacatgaaaaagctaatccaccacaatcaagtaggctttatccctaggatgcaaggttggttcaacatatacaaatcaataaatgtgattcttcacataaacagaacaagacaaaaaccacatgattatctcaatacatgcagaaaaggctttcaacaaaattcaacaccccttaggttaaaaattctcaacgaactagatactgaaggaacatacctctaaatactaagaaccatctacaacaccccacagccaacaacatactgaatgggcaaaagctggaagcattccccttgaaaactggcacaagacaaggatgccctctctcaccactccttcaacacaatattggaagtcctgcccagggcaatcaggaaagagaaagaaataaagggctaccaaatagaaagaggagaagtcaaactatatctgtttgcaggtgacaagattctatatccagaaaactttatagtctcagcccaaaagctccttaagctaataaacaacttcagcagcgtctcaggataaaaaaaatcaatgtgcaaaaatcactagcattcctacacatcaacaacagtcaagccaagagccaaagcaggaacacaatcccattcacaactgccacaaaaaaataaattacttacgagtatagctaatcagggaagggaaagatctctacaaggagaactataaaacactgcccaaaaaaatcagagacaacacaaaccaatagaaaaacattccatgctcgtggataggagggatcaatatcattaaaatgaccatactgcccaaagtaacttataaattcaatgctattcctattaaactaccaataatgttcttcacagaactagagaaaactattttaaaattcatatgaaaccaaaaaagagcacaatagccaaggcaatcctaagcaaaaagaataaagctggaggcatcatgatacctgacttcagactatactacaggtctatagtaaccaaaacagcacggtactggtataaaaatagacacatagaccaatggaacagaacagagaactcagaaataaggctgtatggctacaactatatgatctttgacaaagctgacaaaaataagcaatggggaaatgattccctattcaataaacgttgctgggtaactggctagccatatgcaaaacattgaaactggacctcttccttatatcatatagaaaaataaactcaaaatggattaaatacttaaatgtaaaacccaaaactataaaaaaaaaaaccctgaaagacaactgaggcaataccattctacacataggaatgggcaaaaatttcatgatgaagacaccaaaagcaactgcaacaaaggcaaaaatttgataaatgggatctaattaagctaaagagcttctgcacagcaaaagaaactatcaacagagtaaacatacagaatgggaaaaaattgttgcaaactatgcatctgacaaaggtctaatattgagcatctataaggaatgtaaacaaatttataaggaaaaaacaaacaccataaaaagtgggcaaaggacatgaacagacacttttcaaaagaagacatatatgcagctgacaagcatattaaaaaaaaaccttcaacatcactgatcattagagaaatgcaaatcaaaaccacaatgagataccatctcacaccagtcagaatggctattagtaaaaagtcaaaatataacagatgctgacaaggttgaggagaaaaaggaacacttttacactgttggttggagtgtaaattagttcatctattgagaagacagtgtggcgactcctcaaagacctaaaaacataaataccatttgacccagcaatcccattactgggtatatacccaaaggaatataaatcattctattataaagacacatgcatatgtatgttcattgtagtactatgcacaatagcaacaacatggaatcaacttaaatgcccatcaatgataagactggattgaaaaactgtggtacatatacaccatggaatactatgcagccatgaaaaagaacgagaccatgttctttgcaggaacagggatgaagctggaggccattatcctgagaaaactaatgcaggaacagaaaaccaaataccacatgtcttcacttataagtgggagctaaatgatgagaacacttggatacatagaggagaccaacaaacactggggcctatcagaggatggaagatgggaggagggagaggatcaggaaaaataactatagggtactaggctgaatgcctgagtgatgaaataatctgtgcaacaaacccccatgacactagtttacctatataacaaacctgtacatgtaccctgaactgaaagtaaaagttaaataaaataaacatgaaatctaaataataaataattaaaaaataaaataaaatagacaaggtggtgaatataatagaaaatcattgcaaatcacaatgccaattttaagtagaaagtatcaaattatagcaggatcaatgttaccatttttcactttctagtgcaacactaggcagaatccaagattaaagacaagggatagagagagtatggacattggaatgtcagagactgggaaatagaagaagttaaaaggggaaaggaaattcaagctcttgacactgctgaagtatcttatgatgggctccaaactaggtagaagggattaatggagtctgaaaagaggaagggtttaagtaactgaagattagaagaaagatgtgaaaattcaggaaaaaaaaggaataaatgtttaaaagctggagaatttgacagttgaaaatactttaggatgtgcatttaaatataatcaagttggggccaggtgcagtggctcacgcctgtaaccctagcactttggaaggccgaggagggtggatcacttgaggccaggagttcgagagcagcccagccaatatggcgaaaccttgtctctactaaaaatacaaaaattagctgggcatggtggcacgtgcctgtatttccagctacatgggaggctgaggcatgagcatcacttgaacctgggagatggaggttgtagtgagccaagattgcaccatcgcactccagcctgggcagcagagcaagactctgttccataaataaataaataatcaagttgaaatattgtagatctagcatataaactgaataaaactttttttttccctagatgttgaattggaagcattgttagcatgcttcttccacttggaaagacgaaatagtgtgtaaagattcatactgtgaacttatttccaagaagcaacacaggaacttaacaagaaaactgacagacaccacagaccctttgaaagaagcagcaggctgcagtgtatatcatgagccaggccaaaaattgtaagtccccagagtgtgaaaaagggagaaactgcctacagcacatacacacccaccggggaacctggcaatccaggtcagggaaaaggccttaaccctacccagctccggagctggtgtagtgagcaatggggagtagatgagaaggaaccacatcgggatgtgctgtgtgtgcactcccagtctccagagggatgaagggaagtcattcctgatcctgtctcacaggagaccttgtggaggtcagccaattaactcaggcacgggtcgcaggttaagagatgctcccaactgaaattcatgatataaacttgagtgggcataggagctgggtgcccctgcttcatgggcagatgaggatgggcatggcctgaaagccctgcagtttccatctccactgggaaggcttatgatctggggcagttttgagtttcagtgcagactggctggaactttgctagctgttgctgttagtggaatgctgcagatgtgagacctgccttgccaagtgcagggaagctaggtgggtcttactgctgctggctacacccccctcatttgcactcttctgtgcagcagaggcagctgtgctcctccttggaacactaccccagcagccagcaaactgtcctccaatcccactagggctgctgcttgcgtctgcctgtggagagccagagcatggacttgcctgacccacctccctcctggttttgccccttcactcctcctggtagcttaacacacacacacacacacacacacacacacacacaaaaaaaaaaaaaaaaaaaaaacagaaacttttgggagctctatggcccctcccattgcttgggacaccagagtacctcccctgggtaacataaggcaaagcataaatcccaccagtaccaccacagccagtgcccttttccaagtgccaccttctagctggaggccaactgactcactccatgatagcatctgcaaggagaataacaccacaccaggaaggggaaaacttgtgtgaccttggccgtcaccattacctgcatcaccctggctaaccaggaggccctgagtctgcccacgtgacctgttcgttactattacacatggcatgtgagaaagccaacacactaaggctatttataaccaaggaatatcacagagtctacatcactcctctgcaacccccctcagagctggtgctggcacccactgctgtgagacttcaggacaggtcacatcactggatcccttgcagacattccccctgcaccagcctggactgtggcagtccaaatgggttgctagactgagtggagcagcagcattcacaatagtctggccctcagggattcctcctcctaggggaaagagggagtgctccacatcaagggagcaacccgtgggacaaaagaatgacaaaagaatgaagacagcaggccttgactcccagacatttccacctgtgggaagtttctttcagcagaggcatgggtgtaatgctgggctcagtggagaaagtctgcagctctgccccaagagtcaggcagccctggtgctcctgaagggtcttggaggaggggacttctctccttcacccaccattgcagacacacctggggctgctcccacaggagcttggcgtgggtgcacctgtagacagccattctagaacagtggggtgactgcatccccacaagagaagtaccttccaggttcaggcttacatgaggggtagagtcacagtccctctctatatgtaacatcagcattcctacagatggaaagaggtatctgtgtcatctgaatagccaggaaactgggtcaggagagtgactgggtagtggggctttcctgctggcctgacaggagggctgaggtagcttcctcccttttccctgaaaagacctcagtgcatttccctgagagatcccctagctgcctctgtcaaggctgggacctctgtgcatcactgggtattacattacccacctgtttggtttttactcatggacacctccactactggcctgaaacctgaactgttcaacctagtaaatgaaatactggataaaataaataagtgcacaccactggggaatgagataaccttcaagagaccactgccattccaatgccacaggagacagtgaacccactcacacaccaagcacattactactacaatgagtatctgagaaagccatcatacagactctataaccaaggaactcatacagagtcttcacccctgaaaccatgcagagctgaattgggttacaataaactagagtcattaaaatcacatcctcaaggagagaaaaagaaatttaaaagaacacatagtcgaacaaaaaataaattaaaaaataattagaataaatagttttctgcaatgagaaggagccagaaaaataattctggcaatatgaccaaacagggttctttaacaccaccaaatgatcacactagctctccagcaataaatccaaatcaatatgaaatctttggaaataccagataaagaatacaaaaggatgactattaagttactcaaccagatacaagagaaaagtgaaaaacaacataaagaagttataaaaacaattcaagatatgaatgaaaaattttctaatgagatagatttaaaaaaacagaacttctggaaatggaatacatatttaaggaattacaaaacgcagtggaaagttttaatagattagactaagtataagaaagaatttcagagccttgtcaaaattctgtcaaaagcctgtcaaaagacaaggctttcaaattaacccaatcaaacaaaattaaagaaaaaagaatgaaaagaaatgaacaaagttttcaagaaatatgggattatgtaaaagggccaaatctaagaatcactggtgttcctgagggagaagaaaaaccaaatagttttgaaaacttatttgaggaaataactgaggaaaacttctctagccttgctagggattagacatctaaatacaagaagcacaaagcagtcctaggagactcactacaaaaaggacatcagcaaagcatatagtcatcaggctatctaatgtcaacatgcaggaaacagttctaggagcactgagacaaaagcatcaagtaacctataaagaaaaacttatcgaatgaacagcagacttagcagactgctaagtcagactcagtagaaaccttacaagctaacaggaatttggatcctacctgtagcctctttaaacagaaaaaaccgtcagccaagaattttgtattcagcaaaactaagtttcataaatgatggagaaataaagtatttttcacacagccaaatgccaaaggaatttgtcatatgcatatatatttaggattataatatcttcttgtttgattatttcattattatataataaccttctttgtctttttttgattgtttttactttaaagtctgttttatctaatgtaagaatagctactcctcacttttggttttcaattgcaaataatatattttcaccctctttaccttgagtctataagaatccttatgcgttaggtgagaaagagaaagtcttccctaactcattctatgaagccattatcactctgataccaacaccaggaaacaacctaacaaacaaaagtacagaccaatatccctgatgaacatagatgcaaaaatcctcaacaaaatactagtaaaccaaatccaacagcacatcaataagataactcaccaaaaccaagtaggtttcatcccagggacgcaggaatgtttcaacatatgcaagtcaatacaagaccagccacacaagaaatgctaaaaggagttctcaatcttgaaatgaaaggtcattatgccccagaacagaaccttctgaaagcataaaactcactgggtctataaaacaataacacaataaagaaaacaaagtgtctaggtgacaatcaacatgataactgaaacagtgcctcacatcttaataataacattgaacataaatggtctaaatttcccacctaaaagacatagtggcagaatggataaaaacacccaaagtgtctcttcaagacactcacctaacacataaggattcttatagattcaaggtaaagtggaagaaaatatgacatgcgaatggcaaccaaaagtgaacagtagtagctattcttatatcagataaaacagactttaaaagcaacaacagttaaaaaaaaagacaaagaaggtcattatataatgacaaaaggatcaatccaacaagaagatactacaatcctaaacatgtatgtgtctagctctggagctaccaaattcagaaagcaattactactaggcctaagaaaagagatagactgcagcacattaacattaggggacttcaacactatactgacagcactagacacatcactgaggcagaaagttaaccaagaaacactggacttaaactacactctagaacaagcgcactgaactgctttttacagaacattctactcaagaactgaagaatatacaatcctctcatcagcatatggaacattctccaaaatacataaggccacaaaacaagtctcaattaatttttaaaaatcaaaattatatcaagcatcttcatagaccaatgaagcagaatagagaacctagaaatacagccaaatacttacaaccaactgattttgacaaagcacacaaaaacataaattggaaaaaggacatgctattcaataaatgatgctgggaacactggaaagtcacatgtggaagaatgaaactgaattcctatttctcactatatacaaaaatcaactcaacatggattaaagacttaaatctaagacctgaaaccattaacaattttagaagaaattctaggaaaaactcttctgaaaattggcctaggcaaagaatttatgactaagaccccaaaagcaaatgcaaatgtagcaagaacaaaaataaataaatggcacctacttaaactaaaatgcttctgcacagcaaaagaaataatcaacagagcaaaaaaacaacccacagaatgagagaaaatatttgtaaacaatgcacccaacaaagaattgatatccagaatctcccaacaaagaattgatatccagaatctacaaggaactcaaattagcaagaacaaaaacaaataatcctactaaaaagtgggcaaatgacatgattagacatttctcaaaagaagatatacaactgggcaacaaacatatgaagaaacactcaatatcactaatcctcagggaaatgctggtaaaaccacaatgagataccaccttaccctgaccagaacggccattattaaaaagtcaaaaaacaatagatgtcaatgaggatgtggtgaaatggggatgcttaaacactggtgagaatgcaaattagtacaatctctaagcagattcctcaaagaactaaaagtacatccactatgtgatctagcaataccactgctaggtatctaccaaaaggaaaagaagtcattatgtcaaaaagacactggcactcgtatgtttatcacagcacaatccacaattgcaaagatttggaaccaacttaagtgtccatcaatccatgagtggataaggaacatgtggtatgtgtataccatgaaataccactcagccatagaaaagaatacaataatgtctttttcagcaacttgaatggagctggaggccattattctaaataaagtaactcaggaatggaaaaccaaacactacatgatctcacttacaagtgggagataagctatgggtatgcaaaggcatacacagtgatataatggacatatgagactcagaggtcggggaggttaccaaggcagtgagggataaaaaaaataaaactacaaaatgggtacaatgtacagtactcaagtgatgggtgcactaaaatctcagacttcaccgctatacaattcatccttgtaactaaaatcacctgtacccttaaagctactgaaattgtaaaacttttaaaaaataaataagtaaaaaataaaaatgaactggataaaactgtaaagttaaataacagtagatagacaggtccagtatataataagctaatgaaggaaggcacccccctggataggactcataaccttaatgtgaaggagagccatcttactgatgaggttgaaaacaattcttatttgatttgatacaacagagggctcttcactaactaataggggaaaaccaattgcattcagatgcacatggccaggtcgaatgtaataaaataaaatgtgtactctggaaaacagtctgcccttgatctcctggaaattgattatctcagggatgccaagatgacaggaaatgttaactgactcccagtgtgacaaggtctacgggacttagaacagggataaaggcatttacagataaagtaaaaagaaacttggaaatcaaaatataaaaagttgtgaatatggatattggcaccaacaataatagtggagaaaaggatggagaataaaaggtaaatggggctgggcgtggtggctcacgtctgtaatcccagcagtttgggaggccaaggcgagtgggtcacctgaggtcaggaatttgagaccagcctggccaacatgatgaaacctcgtctctactaaaaatacaaaaataagttgggtgtggtggcagccacctgtaatcccagctacttgggaggctgaggcaggagaatcacttaaacccaggaggtggaggttgcagtgagccaagatcgtgccactgcactccagcctgggcgacagagcaagactctgtctcaaaaaaaaaaaaaaaaaagtaaagggacacttgaattaatgaggaatgtagaagcatgtcctatatatagatcaggaagaagcagaaataagatgatgaaagattaggataatggatgcattcacttctaaggagatgttgttgaaagatggagaagcaatgcttaatgagtcacaatgaggctggcaattgtccctcttatccctgtgtgacagggctcccttttcagccagtgttttctggcaccacatttgatgtttatggctggtattcaggccgtttggtgtccatagcagttggtagagattcagaatattctcattggctgctaggtgaggaaaatgaggaaattaacctctattgaaaagagtttcaagcgaagtaggcaattaaggggaaacccaacatttagagagaaaagtgatggaaaagtttcgagaaatatttgagacataggagaatgtgttcacaatagaaggcagtataaggagcagattgtgcatgaaaggaatgagaggaaagaacagagaagtagggctgaacagtgtgctccacagtgatcactttcagtaggcaatgaaggagccaggagcctgggaggtggattgcctctacagatttgttatgagaacactcctcccactccttggggagggattttctcactaagcacactctggtctcttctccacccctgaaacagtccctgcaaaggtagagtgacgaatctgatctgtaaattcagggagaataattgggcatgcttagctcagcccatacggtccacttgacgacaggccatgaagatactgagttcttttctactcttccatgtatggtttctcacttgggaagccaccttgcccagtgactgctggtgattctgcctcattctggggtttggttgacagctccactcaccttcactctaagttaccacctccaacctggcctctatcagtaattaacatggcatttgagttctctattggccacatgatgaatgccccttgagcacactttgtttcatacttgttcagaatccagccagcaaagggggaagctgttttgggagaccttctcagaaatccccaacattaccgaccgagagaaaaacatagggtagagagaattcctgtgtattttaaattagtgccaaacaaagaggtaatcaatgagaataataatagctaacaattactgaacacataccacgtgccaccatttttggcaaatgcagaggctaaattaaataacaaactattttatcttttataaatatccaagtaataacaaacatgctattttaattttatcttattcattttttaaatataaaaataaagaagagatcatttacgcctttagctaaacttacctaatctagttaaaaatggcttttatccaaaagtcaggcaataacaaatgctgtctagcatgtggagaaaaaggaacccttgtgaactgttggtgggaatgtaagttaatataaacactatggagaacagtttggaggttccacaaaaaactaaaaatagggctaccatatgatccagcaatcccactgctggctatatacccaaaagaaaggaaatcagtatatcgcagaaatatctgcactcccatgtttgtggcagtactgttcacaatagccaagatttggaagcaacctaagtgttcatcaacagataaatggataaagaaaatgtatttatacaaaatggagtactattccaccattctgtcatttgcaacaatgtggatggaaggggagatcattatgttaagtgaaataaaccaggtgcagaaagacaaacattgactattctcagttattttggggatctaaaaatcaaaacaattgaactcatggagatagagtagaaggatggttaccagaggctgggaagggtagttggtggggcaggggggtgatggggaggaagtggtgatgattaataggtataaaacagttagaaagaatgaataagatccagtatttgatagcaaaacaagggtgattatagtcaataataacttagttgtacattttaaaataactaaaaaagtataattggattgtttgtaacacaaaagataaatgcttgaggggatagataccacattttccacgatgtgattattatgcattgcatgcatgcctgtaccaaaatatctcgtgtactccataaatatatacacctactatatgcccacaaacattaaaaataaaattaaaaaaatttttaaaagccatatctaatctctgtaaaagcacggacaggttaatatagatacagatacagcttcaagctgttataaacttgcaatactatcaactataataatagagcaaatgcattcttccctcctcttcccttcacagatgagttccttgagataacgagactgagtagactcagttctttttccacgtactcacctccccttctgtctctttagtcctctgcaatcagatttctccctcaaccagaaaaaaaaaaggccctggcaaaaggccaccaaagcccttctaattgctcctggactctgcaggcctgatcttactccacttcctcaagcagcttgcaccattacttatgcacttcttttagaaatccctctttccttggctctcgacagcattcctggatctcatccctcttcaggatagggacttctcagtttccttgctgcttccctctccttcaccattccttatgtattagagtttcttggacttctttgccctcttctaatgtttcaacctctctaataactaactcacaatggttacctgccacctgtctctggacaccgcctcccgtctgtctatttcacctactgctctcttttgaagagcagatctccatctaatggctttggctgtcttctcctggatgtctcaccagtgtcttaacaacgtgaactaattatctgctcaatctctcttccctttcctagatgccgaaagtgtctcctaccaggtctcccctcttcagaacaggctcatccgaggcatcctccgtagctgtgtgagggattcttccaaagcccaaatctaatcatgttactcaaaaggctcccaattccatccacaatggaagggagcttggttacacataggtgtgcatgacttgtctcttacacctctgtctttttgttagccatagtcttttccccatgacaccagcagcaaactgtattctcagccagacttaatgtattgattttcatatcaacacagtgttatttcaagcccctaacttagttacccttccccagtcatcacctagactatctggggaataactatatatgtttcaaggctcagctaaggaatgacctcttttatgaagccttctttgatcatctgaagtgagagtaaccactctctgctttgggccctaccttaatctaaacagatttgtgaacctctaggggtagggactacatcttattaatagcaatgccttaagcacagaaataagtttttattacatgcttgaataagtgcttgaatctcttgaggtgactaatcaaagtaaaagttattttaattcattatcacattaatttattattacattttactggaatgtctgatctaccttaatgcaaaagtccactgccacaagcatattctcccatcttctaaaaataatgttaacttacttattacataatattccaactgtagtttataagttctttctttccaggttaaaaaaaaatgtgtcatgataggcttaggcaataactcccaagaaagaccaaaaatttcttgtctgtaactttttacttagaatgatctgtttatgatataggtcttcattaaattattcttcctaaataagtcattctctaacctctgaaaatcccagcaccatgtataccatcttcactagggccagctctggaattcttaggttgctggcatagatgacttgctggatgctcagtgaatgcttttcactattaatattttaaatatttttgttcatatttatgaggaatggaaagttgcaacctgatgggatctaggcagttgaaaattcaaatcttaaaaaagtataatccctcactacatagaactccctaattttcttctcttactaagaaaaagtagttggccaatgctgacctattgtatttcccaatgggaactttacacagagcatccatgtccatgctgcattgctcccttcctcacatgtaagaggaactgcaaattccactctctgagctccagaagaataaaaacctttcaatacatcttagaaaaaaaaattttaattcatttatgataagtaatcattgaaaattctgttctccattaaatcttgaaaccagctgaggcagatccagtgagcccctttatgtataaaaatacttaactagatgctttcttaggcaggatttacatagattagggaactatcaaaccattccattaaatcttcatagcaatcatgagtgttaaatatttctattctgattttgtaaataaaataatccaaggctcaaagaggctgagtagtttgttcaagatcagagagtaaatagtgaagtcagagtcaaattcaagaccatttggtttaaaggatgtacacttggtacaaggcaaaaaacaaaacaaaacaaaagctgatccaggacttcctgccaatgttctgcttttagatttttgctcaataacatatttttcagccagtattcactaaatttatatataattaggagctgtccactctctattaaatatgatcttaaaatattcttgatcccaataacactaatcatactgtctctctgggtaattttcaaggtcttttcctagtcagaattctggtcctaaggttcatccttatttaattttactctctccaaatgcagacatgaatcatcaattttccattttagtgtccataagagatatttaatttctataaatacatcttgaatgaggcataaaaaacaacatgattaagcaaaacatgttcactgccaagagtaaaaaagatctagattcaaactctgacttggcacttcttagccccaaaacttggcaagttccttatattcattaaacctctgtttcctcatagaagaaataatgttaccacccaccttactaggattttttgattacgaaataaagtaacatttgtaaagatcctaacaagtacttagtcaaggtaaacactcagtaattagcagatgttgctaacagtattgttactagtattgttagatttaaaatatatgaacatttatgaatagtctagaacaggtggcagaaagtattggacacaaatagagcttgaactatataactcaaggaaacaggctttgcattaaaatcttaaactatttctgatgaaatagaagtggtggtaaggctgcgctttctctttctgatatacaaaaatcacaagtatctaccccttccaccccattatttttattttgatattgactattctgacctgatgctagcagattttgcttttaagtcattccatctttggttcatatcatccagtcgatgttgaagcatagtagcctcttcagaatttcccaaagcttttaccatcttctgcctgtttccgtcaatgcttttaaatatgtcattgtgggcatcaatttctgcctggatgtcctaaacagaaaaaagcaaatagataatgcaagtgttaggaatcagtatatctttatattcacagatgagttgctctcaagcaaaatagttcatttcaccttaaattataagaaattcaagtgcttccaaaattcttattattctgaaaattatagtctttaaatcttcagtacctccagctttgttctttttgcttaggattgtcttggctatacaggctcttttttggttccatatgaaatttaaagtcattttctctaggtctgtgaagaaagtcaatggtagcttgatgggaatagcactgaatctatcaattactctgggcagcaaaagaaactaccatcagagtgaacaggcaacctacagaatgggagaaaatttctgcaatctatccatctgacaaagagctaatatccagaatctacgaggaacttatatttacaagaaaaaaagcaaacaaccccatcaaaaagtgggcaaaggattcaaagagtcacttctcaaaagaagacatttatgtggccaacaaacatatgaaaaaaagctcatcagcactggtcattagagaaatgcaaatcaaaaccacaatgagataccatctcctgccagttagaatggcaagtacacaacaggtgctggcgaggatgtggtgaaattggaatgcttttacactgttggtaggagtgtaaattagtacaaccattgtggaagacagtgtggcgattcctcaaggatatagaaccaaaaataccatttgacccagaatcccattactgggtatatacccaaaggattataaatcattctaccatacagacaaatgcacatgtatgtttactgcagcactatttacagtaacaaagacttgaaaccaacccaaatgcccatcaatgatagactggataaagcaaatgtggcacatatacaccatggaatactatacagccataaaaaagaatgagttcatgtcctttgcagggacatggatgaagctggaaaccatcatcctcagcaactaacacaggaacagaaaaccaaacaccgcatgttctcactcataagtgggagctgaaaaatgagaacacatggacacagggaaggggacatcacacaccgggggatgtcggggggtagggcgaaaggaaagggagagcattaggacaaatacctaatgtatgcagggattaaaacctagatgatgggttgataggtgcagcaaaccaccatgtcacatgtacacctatggaacaaacctgcacgttcagcacatgtatcccagaacttaaattgaaattttttaaaaggtgttcaatacactgactcctcaatttttttaaaaaatgtattgtaatctatagttcatgtaccagctagttagatgttggtatatcagattcaattagcaatttttgaaatcttatacaactgttgttgccaaatcactgaactttgcctaatatccaacagactcttactctcccgttttcacataggtaaaacttcccttaaaatattacatcttacagaggtcactaagatattacataactataactaaagtgtttttcacattttgaaacatttactaatagtttgtcctttcagtcttataaaatttatttctaaaatgttaaaagaatatttttatatacaagttcatcatctttaagaaataaaaactagtaacaacggtttcatcacacaccggggcctgttgtggggtgaggggctagggaagggatagcattaggagaaatacctaatgtagatgacgggttaatgggtgcaacaaaccaacatggcacatgtatacctatgtaacaaacctgcacattttgcatatgtatcccagaacttaaagtataattaaaaaaaaaacaaacttttaacgtgtcagcaaaaatacttccaaaagcatagaataactgatatattcaggcttatgcacacacaaaaacagagaaagaggggagagggaaattttgacaagatctagcctttatgcacatatttaagtgaagttatctgatttaaaatggttcttaaatttatcaacctaattattttattattgatgtgaaagatcattcttgggaataagcacgaaaaacatatatttggcatgtaaataacaatctaattcttctgtaacagaaaaatttctggctaagtataaagaaagtacaaagaaagtcagtctccctaactttacttgcccttaatctattttgataactaaatataaaagaaaatattatcccactgatttatccaaaacaattgcatgcattatctgggaaatttcaataatttatttatatctagtattaaatgaaaaagccaaaaaaaaagaaaaatagtttatctttataaaatacatttgggggcagtttaagtaaaattagaattattataaatttttttaaaattggttcagattttggggaaacatttggcaatctatatcaaaagccatagacttaaaattcttttgaggaaaatggcagataggagacaggtctaatgcacagctcctgcttaggcagacagaacagcgtctggagactcacaccgtgaactttcgctccaagaaccactgcaggaacataccaggaaaaccaaaagaattcacagaccctttcaaggaagcaacttgccactgcaaatgccacaagacagcataagctcttgggagttttacagccttacccatcacctgagatgacctgagtactcatcctggccaacatagggcaacattataccatccttctactactgcagctggtgctctcttgaaagcaccacctcctggctagaggccaaccaactcaagttatgacagcaactcataacagaacaaccctgctccaaagaaggagaaaacaacagctaattccactgcttaccacacatcagcttaaccacaagtcctgagtctgttcacatgacaacttcactgctagcataactggcattcgagaaaaccagagcactaaaccaaactacaaccaaggattcccacagagtccacttcactcccctgcagcctccactggagcaggtgctactatccatggctgggagacctgaggacagatcacattacaggactctttgcagacattccctaggatcagattggagcccggtagccctgctgggtggctagacgcagaagagcacaaccatcactgcagtctggttctcaggaagccccatccctaggggaagggggagaccactacatcaagtgatcatcttatggggcaaaagaatctgaacagtagcccgtgagttccagatctttccaatgaaacagtttattcaaatgagaaggggaactaaaaaagcagttctggtaatatgaaaaaataatgttctataacacactcaaaagatcacattacctttccagcaatggatccaatccaaaccaacaagaaatatctgaattgccagataaataattcagaaggctgattattaagctactcaaggaggcaccagagaaaggtaaaaactaccttaaagaaattttaaacatggccaggtgtggtggctcatgccagtaatcccagtactttgggaggccaaggcaggagggtcacttgaactcaggagtttgagacctgcctgggcaacatggtgaaaccccatctctacccaaaatacaaaaaaattagctggaaatggtggaatacacctgtggtcccagctacttgggagactgaagtgggaagactgcttgagcctgggaggcagaggttgcagtgggccaaggtcacaccactacacaccagcctgggtgacagagggagacctcatctcaaaaaaagaaattaaaaaaacaacacaggttacggatgaaaaagtctttagagaaatagatatcataaataaaagacaatcacaacttctggaaatgaaagacacactcagagaaatgcaaaatacactggaaagtttcaagagaattgagcaagtagaaaaaaaaaactttagagctcaaagacaaggctttccaactaacccaatctgacaaagacaaataaaaaataattaaaaaaaaaacagcctccaagaaatttaggattatgttaaacaaccaaatctaagaataattcatgttcctgaggaagaagagaaatctaaaagtttggaaaatttatttgaaaaaaaaaaatcaatgaaaacttccatggttttgctaaaaatctagacatccaaatacaagaagctgaaagaacaccttggaaattcgtcacaaaaagatcatcacctaggcatacagtcatcaggttatctaaaaccaaaatgaagaaaagaatcttaagagctgtgaggcaaaagcatcaggtaacctacaagggaaatcctataagattaacagcagatttatcagcagaaactctgcaagccagaagggattggggtcttattgttagcctccctaaacaaaataactatcagccaagaattttgcatccagtgaaactaagcttcataaattaagccgagataaagtctttttcagatgaataaatgctgagagaattcaccactaccaaatcagcactacgagaaatcataaaaggtgctccaaatcttgaaaaacgacttgaaatacaccaaaatataatctccttaaatcataaatctcacagaacctataaaacaacaacacaattttttaaaaaagggtattcaggcagcaaccagcataaggaatagaatagtacctcacatctcaatactaacattgaatgtaaatagcctaaatgctccacttaaaagatacagaatggcagaatgaataaaaatccaacaaccaagtatctgctgtcttcaagagactcacctaacacataaggactcataaaaattcaaagtaaaggattacaaaaagatattacatgcaaatggaaaccaaaagcaagcaggagtagctattcttatatcagacaaaacagactttaaagcaaaaactaaagagacaagaaaggatattatataatgataaaaggattagtccatacacctaacataggagctcccaaatttataaaataattactactagacctaagaaatgggacagatggcaacacaataattgtaggggacttcaatattccactgacagcactagaggggtcatcaagacagaaagtcaacaaagaaacaatgaacttaaactataccctagaacaaatgggcttaacagatatttgcagaacagtctacccaacaactgcagaatatacattcttttcatcagcacatggaacattcttcaagatagaccatatgataggccataaaacaatcctcaataaatttaagaaaatcaaaattatatcaagtgctctctcagaagaccacaatggaataaaattgtgaattaattccaaaaggaaccttcaaaagtaaacaaatacatggaaattaaataatctgctcctgaatgatctttcagttaacaaagatatcaagatggaaattaaaaaattatttgaactgaacaataatagtgacacaacctatcaaaacctctgggatatagcaaaagcagtgctaagaggaaagtatacagcattaaatgtctacaccaaaaagtctgaaagagcacaaacagacaaggaaaggtcacacctcaaggaactagagaaacaagaacaagccaaacccaaatccagcagaagaaaagaaataacaaagatcagagcaggactaaatgaaagtgaaacaaacaaacaaaaaacacaaaaagtaagtgaaacaaagagctggttctttgaaaagataaataaaactgatagaccattaacatgattaaccaagaaaagaagagagaggatataaatgagctcaattagaaatgaaatgggtgatactacaactgatactacagaaatacaaaagatgattcaaggctaccatgaacaatgtgaacacctttacacacataagctagaaaacacagaggagatggataaattcctggaaatatacaacccttctaaattaaaccaggaagaaagagaaactcggaatagactagtaacaagcagcaagattgaaatggtaattaaaaagctaccaaaaaaaaaaagtccacaccagatggattcacagccgaattctatcagacattcaaagaagaactggtaccaatcctattgacactattccacaagacagagaaagaggaaatcctccctaaatcattctacgaagccagtatcaccctgataccaaaaccagaaaaggacataacaaaaaagaaaactacagaccaatatcactgataaacacagatgcaaaaatcctcaaaaacatactagctaactgaatcaaacagcgtataaaaaagattatccatcatgatcaaacgggtttcataccagggatgcagggatggtttaacatctgcaagtcaataaatgtgatacaacacataatagaattaaaaacaaaaaatcacatggtcatctcaatagccacagaaaaagcaattaacaaaatccagcatccctttatgattaaaaccctcagcaaaattggcatagacgagacattccttaaggtaataaaagccacctatgatgaattcacagccaacattatacttaatggggaaaagttaaaagcattccccctgagaaatggaacaagacaaggatgtccactttcatcacttctattcaacatagcactggaagtcctagacagtgcaatcagacaagagaaagaaataaaggacatccaaatctgtaaaaaggaagtcaaactgttagctgtaaaaaggaagtcaaactgttagctgatgacatgattgtatacctaaaaaaccctaaagactcaaccaaaaagctcccagatctgataaataaattcagtaaagtttcagaatacaaaatgaatgtacacaaatcagtagcacagctatacaccaacagtgaccaagccgagaacaaatcaagaattcaaccccttttaaaatagctgtaaaaaaaataaaatacttaggattatacctaaccaaggaggtaaaagatccctacaagcaaaactataaaatgctgctgaaagaaatcacagacaacacaaacaaatggaagcacatcccatgctcatgtatgagtagaataaatattgtgaaaatgactatactgtcaaaaacaatctataaattctacatgattcccatcaaaatactatcatcattcttcatagaactagaaaaaaaaaaaactctaaaattcatatggaagcaaaaaggaccccacatagccaaagcaagactaaacaaaagggagaaatctggaggcatcccattagctgacttcaaactatactacaaggctatagttaccaaaagagcatggtactggtataaaaacaggcacacagactaatggatcagactagagagcccagaaataaagccaaatacatacagacaactgattttcgacaaagcaaacacaagcataaagtggggaaagttactctattcaacaaatggtgctgggataattggtaagccacatgtagaagaatgaaattggatcctcatctctcaccttatacaaaaatcaattcaagatggatcaaagacttaaatctaagatctgaaaccataaaaattctagaagataacatcagaaaaactcttctagatattggcttaggcaaagacttcatgaccaagaacccaaaagcaaatgcaacaaaaacaattataaatagacgggacttaattaaatgaaaaagcttctacacagcaaaagaaacaatcagaagaggaaatggacagcccatagagtcacagagtgggaaaaatattcacaaactatgcatccagcaaaggactaacatccagaatccacaaggaactcaaacaaatcagcaagaataaaaacaaataatcccatcaaaaacttgattaaggacatgaatagacaattcccaaaagaagatacacaaatggccaacaaacacatgaaaaaatgctcaacatcactaattatcagggaaatgcaaatcaaaaccacaatgtgatacccccttactcctgcaagaatggccataattaaaaaataaaaaaaaatagatgttggtgtggatgtggtaaaaagggaagttttacgctgctcatgggagcataaactagtacaaccactatgaaaaacagtatggagagtccttaaagaactaaaaatagaactaccatttgatccatcaattccatacttgggtatcttcccagaagaaaagaagtcattatatgaaaaagacatgtacacaggaatgtttatagcagcaccatttgcaattgcaaaaatatggaaccagtacaaataccaatcagtcaacaagtggataaagaaaatgtaaacatatatgtatacacacacacacacacacacacacacacacacaccatggaatactacaatactactcaggcataaaaaggaatgaaataatggcgttcacagaaacctggatagagttggagaccattattctaagtgaagtaagtcaggaatggaaaatcaaacatcgtatgttctcacttataagtgggagctgagctatgatgacagaaggtcataagaatggtataatggactctgggagctccaggggaagggtgggaggtggggtgagggataaaagactacacattaggttcagtgtacactgcttgggtgatgggtgcaccaaaatctcagaaatcatcactaaagaatttatggatgtaaccaaacatcacctgttccccccaaaactactgcaattttaaaaagccataaaaatgttaaaattatctaacttaagaagacttatgtataaaaatgttttaacacactgattgtttttagagtaaaagagtggaagctatcataatatattagtggtgatataatatttttaacaacaggatataaaactatatattatgataatttcatttttaaaagtacatactttaattggcatatgcatttgtgtataatttgacacatacacaataggactacaaaaataaacaaaaatagtgtaacctctatagaagaggattacagataagtttagttttcatctctatacttctctgagttttcaaaaagttaaactcaaagtttctttttattagataaatctaacaaatttaagatatagagtgtctatccaatttttttcctacttttcccttataaaattgtcagcataactatccatattagtttggcaattatcttttcctcctgaatttaatggaagcaacctaattgtagctaactctggcatgacagccagtaatgtatcataagtaagtgtgaattacaaacagaaaagcagggaccagagctgggtatgaagatgtggtgtgagtctccatggctatcattggtaatgaacagtaaaacagctcactgcagaaataaaaaacttgcatttcaggcaatgaatctgaattagtaaaggagagcaaactcctaaacaccatagttctattgtccttctactctgaagcttttctttataagactctgctatagtctgaatatttgtgtcctcccaaaattcttttttttgaacccctaaccctgacaataatggtattaggaggtggggcctttgggaggtgataaggtcatgggtggagctctcatgaacgagattactacccctataaaggaagccccagagagctgccctgcccttgccatcaggtgaagacccacctagaaggtaacacctatgaaccagaaagtaggccctcactagaatatcgaatctgccagtgccatgatcttggacttcccagtccccagatctgagagaaatacatttctgtggtttataagctactcagtctatggcattttgttataacagcccaaactgactaagacagcctcactcattgtaagtttctcttgttataaataaataagcagggtgaaaatttacataggaatactttaaatactcagaatgcttttctttatttaaaattcactcctagtaagcacacccatgcattctaccaagaatccaggcttagggaccagcatctaagtgcttgtttttcaatcacccatagacctccactaaccagaaacacccaaggaagggccttttgcacctcactactccaatcagcatgttaggaagatgtcagttacatgaggtgaattggcagcactgacctagtattatttctgatgggatttgagatgtctaacatgacactaatagggtcagatttagagactgggtgagatgaacacaaagtttaatagacagctcctgcaagatttatggtccaaatttgcaaacccattgatctctgaggttatctgacccaaatgacaaaaccaaatctggtccaatgcaaagtgtggtttgcagtttgcagaattaggcctaaccgctgaataaaaactctgagattgttgaatcttttgcatttcactggcagttctatcccagagcagtgcagaagagaagtgaatagggcagctgggaaacagagccagataatgattcaaggttctcaggctgtgcaacattatgtgtagaaaattgcagtctcattataatcatagtttgagatgtgccaaatagaaattctcagtgaaaaaaagaaaaagggaagttccgctgaaaagttctttggtgtcatctcctgatacaactgttctatttttgtgtcctgaagtgcattttaagacctctaaagagacatatttaaaggtgtgcagatagtgttttgcaatgattttatgcttacgctatatatctgtaaggtagccatctttctcaggaagctcaatgacacgacaagcaaggcacctctttgctctctattgccaaggagaacctggcttcaaatttcctgtttaagttcctatacatcattatcgatgaaccacacctaaaatcacaagacaacttcaaactacaacatcctgatgtggtttgacctatttgattcctttcacattgaagagaagcaaaaagtaaaaggccgggcacagtggctcaagcctggaatcccagaactttgggaggctgaggcaggttggtcacctgaggtcaggagttccagatcagcctagccaacaggatgaaaatcccatctctcataaaaatagaaaaaaattagctgggtgtggtggtgcatgtctgtaatcccagctactcgggaggctgaggcaggagaatcacttgagccctggaggcaaaggctgcagtgagctgagatggtgccactgcactccagcctggatgacagagggggatttcttctaaaagaagaagaagaagaagtagaaggaggaggaggaggaggaggaggaagaagaggaagaagaagtagtagtggtgcattaagatgcatagttttctaagtttcacaagagcatacgcaacatcaggacatttgggttccaagaacataaagaaaattcgccttctcacatcagatcaggcgatgtgttttccaacccagctaccacgacgaatgggaatgaaacaggactgcatagctggcccaaccaaggatgataagcagttccacaaacctttctttaactgtgctaccagtgatcatatgttcatgttggaatataattttcagtatgtggaaaacccttccacacatgatcatcatcaaaagttgggaagaaaatcaaaccacaagtgatcaaagaaaaggaaatccacagacattattttgttttatttgacatttggtggcatattaactttgccaaatatacccagagtgcctcaaaacagaaaatcatcttaatatttcttctgtatcctcacagtctctgttacatagaaggatcctaatgtaaacagagtagatagatgacacatagatacacatatcaatgtatgagtggattaataggtttattttgattgactggcaaattggccactatagtgctaggagaaaaccaaacaattgaaaaattggaaggaaatgtagtaatcattttgtgcaatttcttcacttgaaaagtttaatgggggaacttaaaataatttagaagcctgcactgcaaagtcctggctaagcttgcactgaaaatttagaaataaatgcagttaatgaatcatgtttcttcgtagatcactatgcaatgatgcactgatttgaaactcaggatgtcagcatgggaggctgtcagatcatgaccctgatgtggcgtcaaatgctacaataaattaaagttccatgaaagagggctggctctcactgcacagctgggagacttggccctactgatgcttacctctgtcacctgcaagcccttctgaactttaaacagcacaaaatggttactgataattagttatgggaatgtaatccatcttgaagcacaaagcaatgctcttccaagcatttaacataagccagtcatgtgcacagaggggccatggcaagatattcaagcagttgaactaacatttgaaaacagggcagaagcaatgtcctaaggattcacttgaaaagtattttaaaacaatgtaagtataatgtagaaggttaagaaaagccaggagttagaaaaataggactacacacttttctctaaataaaacaccatcaaaagcataagatgcaaaccctcagaacagccctccagaagatggctacaaaagctcactgaggttcactgataagtggttagtctttctgtaaacaacacccactattcagatcaagataaacttcacaaatacgggaaaacatttatttatttactttttacttatttaataattagtatttgactacaagttttgcccttaactgggcatttctctaatgatataacccatagagatataactgtaaacactttataatgtatatcaaataacttgtttataatgtttcacagtcaagctactacttgattataaagctacaagtagtagcttgattataaaacattataaacaaattatgtgatatacattataaaacaaatcaataaaacatcatgaaaataaaacatattttgcttaaatatgtaagcaaaaatatttcctcacattataataaacagaactgtctgaaatctctgacaggaaacagagatttagaacagtaccaccaggaagtcttcaacaactaaatgggtgctagactagattcatcctctttggtcttgttaaaataattttggtttatttttgcaccaactatttacttaaccttatgtggcaacagtgatgtttttttctgaaggagttctgacccctttcctgaaggtgaagaagaaatgaggttagaacaatttcgctatcatgtcccaaagctcagcctaactaaacaaagttaatcattagaggaaaataaatccaccattcctttcaaaagtcagactagatttcagaattattatcaggagctcagcaggattactgccagagctttaggttttgaaaatgaggaatcatgattttaaaaatatatatatatattacttaaataataatagaataggcaaataacatcatcttcaaaggttatgtcatatgtaaatatgttttgaaacagtttgtgaggtttctgggatagtaattgtcattaattattcaattaatttattgattttaattattattctataaattttcttccaacagctaatctcacagattttaatcactctattgaatcacatttttgactgacaatagaggtggtatcatcaggtctacagcagcatttctgaattaagaaatcgatgctaataatgttcttttcctattatctgtgatgataaatataggtaagactcgaggtgggtggatagcttgagcccaggagttcaaggtcagcctgagcaacacagcaagtccatgtctccaaaaaaaaaaaaaaagtaagacaacagagtagaaaacagtcaaattactaagtggaacaaactcagatagtgtgatgaaaactgaacaaacaaatcagatcgtgtaatcaaaactgaacaggtcagaaaacccagagaaaaattatcgcatttcaaatgtttaaaactacaagcctggggcacacagcttctcaacttctgacccatgtcaaagcagtccctgttaccctgaaagctcccaatttcttcccctgacacaagtccacccatgggccacacacatgcacacacattggtatataatctcatttccttctttcaacttaaactcatctgttaagtctcagtttaaatgtaatttctccaggagagacttcacaagtactgagattagggctatcattactcttataatttcatctacttttgcttaattatgcagttgtcattgaaaatgtccttgtctgtatcctcccattcggccataagatcaatgtcttctccatctatacacttagactagcacctggtacatacttcacaaatatttgctaagtagggaataaatgaggagactttgaaatgtgtttactatatcttattgaggacacatttgttttaaaatgagatatggcaaactgagcaatacaatatagcttcaaattgtaattataaaagatagagtcatgtgaaaggaggtaaatgccataaagtaattcagcattgagtggtttctctctgtgttgttatgataggaagcatctttgcccaaggagtcaccaagagaatggtactaagagaacggcactcacacacacagcagacacatacatcaaaaaatcccttagagaactacgattatcattaaccattcagtagcaggtctgaataaattaataaaaggcagcagtcactcaaaatgtcactgagctaaaattggccattacactatcctctgtgactattaaacaaaagaaatacagtacacaatgcaaatggcttaagtatgacagtatgttaatagtccctaaagtcatgagatacttcctttaggaagtactttcagggaaaaaaattaattaaaatcagcgtggcaaataaaactacctattggctggatctcagagaggtgtgttggtggactagtcaactttgaatgtgaactcttcccatagtcacccttgagcccatggccacaacttctcatcccttatcactttgttagatgattaggacctgcttgctggcaggcacatcttggtatggggtcatcctcccctggtaagaagttcttcctctttaggtaccactcgagttggcatggttccctccaattgggccttcctaatctgtaatgagctgtcatcttgtaggaacataatacttcctgcctgcaagagactcctagccttgccctttctggttctagaagactagaaatcagtacccaatgtaagaaattgcccatcctgcctgtgctgggaaactacaatcccagcatcacacatgctgagacaaggtgctcaaccacatgccaaacattcttatatgagtataacatgccaaacattcttatatccagtaaaaatcacaaaaccactggatgtctccaaaattcaaaaatatcaactaaaatatccctttcaatttaccttcacaaaaaaactgctgtcttaaagttatgctgaaggtctgctttcacctgggaattttaatgatctgaccagtctataactttccagattagccaccattggaaggcctgctgctcagctgttggcctcaactactaagcgtatcaggatttgagtctactagtccaacagtggaccctcgttttcttaaagcctgaaattccttcaggaatacagcaaaatcccctttctactgtggtcacctaaacttcagactgaacaatgacaactgctgatatgaaaagtggtaaatcgttaaggctagtattctctctagaaacaggttactaatactgaggaagagacaggactgagaattgagggtaaagggactctacctctgcgtgtagaatggctgttactcagcttctgaagggatcctgtggcttctgcattatagcagtaggccttggtctttccctagaaatggcattattgctttgttgggggaaggtggttagttgtatttgagacgtgtgaggtactgatacttttccgtaattccagttttcctgccaataaaccaatgaagcaacatctcaatatatgagacagattttgtaagaatacgcaaaggattttattaacactttggaaagaatacattcatgtacgacaacttcctagaagtaaaatacggccaaagagatcaactttcacataggtttttataaaactgcctaacacaaaaatacacatatatggagaacttcagactgagaattacatcaggactgtttctttgagttcgccttttgtctcaaaaataaataaataaataaatagataataataataataaaaatcccaaatcaagcctttgacaggaaaaagccagtagatatcttctactgtcaattcaactactaaaataggaataagacaaatactaagacatgggagttaaaaggggaaacatgctaatataaccagaacttctaactctgccaataaaatggcttgaagctgaggcaggttaggaacccctggtatctgacctagacttttaagactaatagcagcaattacaatacaaaagtccagctattgcccacaattactgcctctcagggggtctaagtaatgaattattcatgtaacatatgctctatacctttaaaggaagaaacagacaaatctatacaaaacaagctaacagacctctttatggtcataaagtttgtcacctgctgttaccagctgccataaggaagatattccttgccttccccgccccttctaagtggagagcaagctgagggagaaccgtcttttactctcaggaatttagatgcttaaccacatattaaagcgagaggtcgaagtccgccctgtgttacaagcctaatccttacattacagtagaggtgcagagagagattgggagaagcaactgcagccaggagggagcaaagagctaaattcttctctctccacattcatcccaccataacgttcctatcatcaaaaggcaagcagtgactgcaattgttttggaaaagcttccaaacttttcagatggcatgatgttgcatcttttccctctggcaattgtggtttgtaagaaaaagcccattattcttttaatgactcaatccagtcccgcttctacagtatttgtacttgcaatgatccatggggcattcacggtgaaagccactgagcacagctttttaaatattaataattgacttacataccaagtgagggaggacttcacccctttctgcctttctttttctttaaagactggaaattggaagaagattggtgtttggcatccaaaggctaaagagggcaggagcgcatacacgcatgtggaggttttctgttttaactataaatgtaaggtagtatttggcaggctagactccatctagattgtgccaggagccttcctatggaaaaaagagctacacgcacatttaataatccaagcattaaagcttcacagtgcatgcaagcactccatgtttaaaacagacacgctcagataaaaagcctgaggtcagatgtgccactgtcactgtgaagcgacttctgccacccacagctgagtccccaggcagagggctgtacagggcagtgcacggcaggcagtggctggacagataaacctgaggggtatggagaacagaacccatgcctacgaagtcagactttggcaccaatacccagtgttttttgctggatttttattttattttcattttcttttttttttctccaaagaagtttcagttaaattaccagctgacttgagtacaaagagtttcttctgatgtggaattctaaaagtgacaggcatcatgagaagccctcctgaccaaaggaagtaattgctaattagccctttacttgaaaaacatctttaaaggagacagcaaaattgaatattccttataaattatactaaaccaccaaagagtcaatagagcatctatctaaatgtatagtgaaaaaaaaggcaagaaagaaaggaaaaaagtacattcatgaagtttgctttctgcataccttttcaaattttgtcagcagttcccgtaagttgaagttcagaccaatcattgtccagtagcccttgaagcctacatctttccggcaaacttccttcagacaacagcgtttaacttctaaacaccgtatcttttctggctatactttaaaatcctttgtaaaatcctttacaagccttgcccttgagctatggtccatcagcagcagcggcagcttgcgctgggacattttagccaccccactgtgggtccgttttttcatggacttcggagttcgcaaggaatagacctgcttctgtatttcctggtagctgtgttccacgaggctggcatggtctcctctttctctgggaagtccaggattcccttctgctcacctcactaatgacctgcaggccacaactgttctctccagggccccaagcttagagtttggtctcaattacatacagcaaaaaaagaagctatatcctggaaacttgcatgagagaagaaaaaaaaaaagccaagtattaccaacttcctccattcagaccgatttcagaacgaaaaaaaaaaaatcctgggtaaagagccagttttcaaagagcatgacttatgtagagttcgaaggaggagtgtactcttagctgaagaaacaccaaaacacaggacaagaggccaccggttctcactctcccagacaccagcagcctgggttgctatggtaaccaccaagctagtttcagtccatttccctaggtcagcctggcctaagggatgctgtcaatgcaacagaactaaacttgttttaaaaggtgttctgtctgtccagagaaaagctctcgcagcaaatctagtcccttctgccggctttgtggcaggggagagcagcctcagtgggctctggcagctcccctggctgatctgacagcagtgtggtaatcaacttctctttccagcagttgtttattattttaatcagcatcctccctttccaccacccctcacccagtttgaagtgaaagctcactcccacttcctggaggcctgcctgccccaaaagtcagttctctatcttttacattgtctcaatcttgaatggatcacaggttccatgttccagttgggagccaacccatgaaaagaaaagggagtgaatgtacaaaacaatacaaatcacaaaaggaaatacgcgttgattaattttatttttcaaaaaggtgttagcaggcaactgatgaagaaaatagttttaaagtgtttcgatctctttgatgccgctgaaagtcattcagactgttttcttatagggaatttacttgtttctgacataaaacttaatgagagaaactactgtactcaaaatgtgagtaataactacattgaatgtgtcttccattttgatgttaaattactactggcactcagagaaacaccatcttccaggaagttttaagtgtcatcgctttaaagaaaaaaactccaatccaaattataaattctttgtagtgatattatggatatcattccaaggcaaatgtgattttgcttttgcattacatagctatacagtataccaataaagtataacagaaatgtccatttgaaacatgtttctctagttgtaggcagagtttcatcataaagatgcagtgcttataatggtgacactaccacaagtagaataatgtaaattttaatataagtaagtttactttttttgcatcagggcatagaccaaagtgggggggggaacccctaaaatcagaatatgcatctcctaaagggctaatgagttgcttaaatatcaataccgttagcacttatttaatcatgggtcgtaagagattccatttaaaaccagaaaaactaaaaatctatcagggaacagtatacaatgttggtattattttttggatttgcaaatcatttttctttctatttcattcctaacttattttcatatcagtatttaaatagcatgtgttttacatatgcccatctatacaaattttaacaagcttttaaaatattttcattattttttcataaaaacctgtatgtccccaggggcaaaatggctttatgagctttctagcagaacgtgtttcacctcaacgcacatttgatttcaaaaacaaatgtgttaatctaatgcttattcagaaattcacaggtaaaaataatctacagtttggatcaaaacagcactgacatcagcatgaagaccaaccatcagaactgtggtgaagaaacttacagagaaagtggccacagggaacctggtctgtaaagactctggggccacatgctgagatctttcaagagcagcaaataaactttttacataaatacaagacaaaagaaaccaccagcaccagcaccatcaccaccaccacacacacaaaaaaataaataaataaaaaagggagagaaaaagaacaatctttctcagctgggcaaacttccagctaccacccagggtgctggatggctgggatcagggacatgtgcaaacacgccattccattcccccatgcacagatcagaagggtgaattaaacaaaaactccgtggaacaacagggaataccatagtctttctctaaagtagaccctttctgtttaaagggctcttataacaagacaagaatgatatgttattgttagagtcccacatatcttgtatccacacccaaggttaaacacaaggcataaagatgagggaaaagaaagggtatcctttgtattaggccttcttcccaaaagataagagcatgggaacttttatcagcctgataagtacctgagtcctggacaggagaaaggaacaagagtatgttctcctgtggaattcgagagtagaatatccagaaactgttgcctttgtatcagctaccttctcagaactgacatcctctgctaaggtagaaacgatgacacttaccgaaaactcccttatatacagttatgcagcaacaaaaactaagatattgacaaatctagctatgatgtcagcctctttttttttttttttttttttttgagatggagtttcgctcttgttgcccaggctggagtgcaatggcgcgatctcagctcagcgcaacctccacctcccaagttcaagcgattctcctgcctcagcctcccgagtagctgggattagaggcatgcgccaccacgcctggctaattttgtatttttagtagagacgggatttctccatgttcgtcaggctggtctcgaactcctgacctcaggtgatccacctgcctcggccttccaaagtgctgggattacaggcgtaagccactacacccagctgatggcagcttctttcgaagaaagagtacaaaactcagtggatccatattcaaaaacagatcatcaaaagaatatgggatcatttgaaagattttttttaaattcttaactaattttaatcacagggtaactatactctcactaaaacacaagaaagcaactaaaaatgttgttttttaagtgttaaagtcaaatagattattcatgtaaatatccaaagtcattctgtgaaattcaaatagctaaatatctaatatattactcaaaagtattgcactctttgataactgatacattaaaagacttgtaaatgtgagttgcttttataaaagtgagcacatttcatcatgaatttgtgtttgatatctataagataaagtgtactttccattacccagatgtagtggcccatgacgataatcccagctacttgggaggctgaggtgggagaatcacctgagcccagaaggtcgaagctgcagtgagccgagatcgtgccactgcgctccagctggggcaaccagagtgagactttgtctcaaaacaaagagtactttcttagtttaaagtcagtacacaaaatatcatcttggtaatatacctacatttctacagtccttttttatcaaccacctctttgatacattatcacctgtaatcctgtaattattaaaacaaaaaatagatgcctccagtgtaagcaatacatcaccagagagacttaataaattagatgatgacatttgaagtagttgacattttcccaatttaagccaatgtgcaaataaattgttcactaatcctcagtaggtggaatatgcttgacactaccaatccctgtatcagatcaacactgaataacccaggaatctctagctaaataaaccatgtttcaaacatagacatagagtttcatgagaaagcaaaaagttccagaaccacagagaagcacaggaaaactcagcaatggactcaagaaaatctaaatctaaactgcttaataaaaaccacattccaatgccaaaatgaagagagctataggtatggctttgccaacaactttcaaagggtaggacaatttacaaatgttttgtacttaaaaactatatttcatataatttgttaaaagatgacctatttagtaattttattaaggcaataaaagattctttacagctcaaataagaactttacatcttactcctatagtggatcttaaggcacccttcccactaaagacaatttttaaaactgtaaagatcaagtatgttttctatgtaaattctaacaggtttctctttatattggccaacacaaagaacaaaaagaaaagaaaagaagaaaagcttcttaggagcctctaaagtgaagcatatggaaggtcaataggtgattacacataaatcgctacatcatggcttattcattactaaaatgaggagtttctggcatggggagaaaagtttatttgttgtaagcccattctgactcaaagaaagatccaacttatttcttgtgaaagaaatatacacaattctccttttcataacccttctaacttgggatttagaattcaaaaataaaatagcttcaagaccctaatcgtgatctgagttttcaattcattgtcttctaccactgaagttccattagggagagaccagtccatacatttcgactttcaagttaacatcagcctgcagcaaagtgtgtcagctggtagctatttaaggtaatatacagccctaaagggcaaaaagttcaatctaaggatggaggcctgagtcccctgatgaaagggaaaactctccttttatcccaggaagttcaggcactatgctttgtacgcaaagaattatttttaatgtttgtctcttcagtataatgccatctactttgataattttacaggtggtcatggagaaataaaaattaggattcataagaaaaagattcaatacttaatatattttctataacacataaccaaaagattccaatagacattcaaagaggctcaaagagctttttcttcttcaggaaaatgggtgggtggggtaggggttcaggaagagaaataccagctgatttgcttctgaattagccaaccaggtgcaggagtcagccttcagcaaccttctaaatatttaacaattcagacggcactttattaggtgactaaaaataatgccaagacaagttaatgcttccaaaccatattcttcctaaaaaatatgcagcatcagacaagagggaaacaatctcaggaggccaagcctcaaattccagatgtctactgacagcacaagcctgtagcatatgcaactaaatccacagggctctgggaaaaaggctcttaaaggttttcaaaaggttttataaaggtttctccagttttcttcagctatgtagatttagtaaattgaagccaaaattaaaatacaaattttaataacagcaactaaaatgtcaaaacaaatcaaaattgaaagcgccgttttcagtcacaagtaaaaagctggtactttccccaggagggcattgttactataatctgaatacatatttaaggaactgaacattgggtaaacacagaggaagttcaaactaaccccacgcgatcagctatacttttgtgtataatactaagcagtgggatttctctcatgcttggaggctaatccattcattgtggagctactgcttcaactctgaaccatgtccctgtcatcttcttacttaggaacccattctgcattctctgcaaaatcacactctaaacctacttcaactccctaatcatgatccatcttcactaatatcaccaataaccagttaatacttaaccacatgaaccactcacacttacaactatggtttcccacaaaaagtcacacaccacaatcacacattttctcccctccagtcatatttactttctgtaccgttatctctcttccttcagatgtttgctctgagcaatgagttctacatagacggtgaacacagacaatgtattatgcacctttcatggaaatcagtaggctgattacaaaatgaagaattcctttactttaagtcattacatttcctagagattattagaatctgccaaatttgagggtaagggataatttaacaatgcccatcaaatgttaaaatgcatataacttttgactcagaaattctatcactaggaatttgcaaacatgtgtacagacatatgtacaaggatgctcaataagtcctacttgacttattgagctgaaaacaatctatatgtccatgaaaaggtaactgggtaaacaagttatggcagactcacataatgaaatgctgtacaactatggaaaagagagataatttcttttttttttttttttaagatggagtctcgctctgtcgcccaggctggagtgcagtggcgtgatctccgctcactgcaagctctgcctcccgggttcacaccattctcctgcctcagcctcccaagtagctgggactacaggcgcctgccaccacatctggctaattttttgtattttttagtagagatgggatttcaccatatttgacaggatggtctcaatctcctgacctcgtgatccacttgcctcagcctcccaaagtgctaggattacaggcgtgagccaccgtgcctggccaagagggagataatttctaagagcaaataattaacctctaatatgtatgcacgtacatatcctatgtatacgccaaaaagggggggagtgatatgtagttatgtacaggtacaatctatgagatacagataatatttctgtaaagatctataatacagcaataatggcgacctggaagggagggactggagagctgagtgtctagaatgaaacatttcaatgttcaatcttttatactgtgtgaaaatttcaccacagcctgtgtttctattttcatacaaaattaaatcattagatagaaaatacccaagtaaaacacatttaccttcctgagtagatacctattccaaaaagggtggcatcattatatttgaaagctaatgctactggagacaattatttttgcctttaaaagtttcagaagttttgaggtgccagatggtctaacactaccaaaccagccctcaatagaaacaagctttctgcagcagtgggctggtcaatggtaagcttttctaagggacagacagaacaaagcctttttgttgtcataagttactttataactagtaactcctgcttacttaaaggacaactttgtgtctaaacaggcattatataactcgagctattctcttcccaaggaaacgagtatccctattgtcatctaatactgtgatactacggtctaaagttttttggaatgtttataaaaatccattgataacgcttgaaaatgaatgtctggcctgatttgtccaggcaattgaagcatcgctttatctttcaagtaggtttaagtgatcccacctagactgtggcagagtgaaagcgccagagtctactagtgtctaaagagatgctgcaatgtgaatagcaccttcgtacatggatctaagttgcagaagtgaaaaagaaaattatagtttaatcgtgagggcaggtctttcccgtgattttcttgtgatagtgattaagtcttattccctggaccctgtttgtcaggttcagagacaggaggctttatgtgccatgaaggttactgtaacaaaatattaaaggaaatgaacgtccacaggtgaagcaccatctgacactgacatcagccacattcttgtttagggataagttaagccacagtagaagggactttgcaatgtcttgtcatctcaagctctgcatttgaaattgctaaacaaaggaatttaaagtacaatttccatctagaatttaatctggagagtgttttaactttaaaatcagaatatggaataattaggaagtaaaagagcctttaaaagtacaacacaatggggactcaggggaaagtgtgggaggggggtgagggataaaagactacacattggatacagtgtacactgctcaggtgatgggtgcaccaaaatttcagaaatccccactaaagaacttattcatgtaaccaaacaccacttgccccccaaaaacctattgaaataaaaaaaaatactgtaaagaaaataaaaaggcaagacacaaactggaagaagatatttacaacacgcaaactgacaacactacacattggtatagaaaagactatatgtagttcaggatgataagaacttaagtcatcagaacataacttcctcactaaaaattgagtcagatcattctactactatgatagtctgaaaagcaatacagaaaatgttttaattgtatgagaaaatattcattgatgttacatgtaaactagattacttatctgtattatttcatcctggccctatagtatatatttcatgggataaaaaagaaagaataacactctcgaaatcaaacgacctgtgtcatgatttcctttatgacacttatctagctgcttgaccctggaactcttgtctgaaccttgatttttctgtgtagaatattcctctaacacttgagcaaacactcttatcaagaaagacattcactagtactatataattgcgcatttgtttcaacacaaatttattgagatttagatagttttagttacaggacaattaagactttcttattattatatgtataccagaaatgcctgcattgactttttcagaggtgagggttccactagttttcatatatatcaaaaaaattgataaaaactctaaaaatatattattatagtattattatttcggttggtttaacagcaaaaaccgtgattacttttgcacaaacctaatattttgagagaagctaagtgtatgatattttaaaatatttcttcattttttaccacaaagaaaacttgttatgagttaacactggttattattaacaataaaattttaaaataaaatataaataggttacataaagatttatcaatgaccagtaattattattattattattattatttgagacagagtcttgctctgtcgctcaggctggagtgcagtagcgcagtctgggcccactgcaacctccgtctcctgggttcaagcgattctcctgtctcagcctcctgagtagctgggattacaggctcgtgccaccacacctggctaattttcgtatttttagtagagacagagtttcaccatgttggtcaggctggtctcaaactcctgaccttgtgatctgcccgccttggcctcctaaagtgctagggttacaggcgtgagccacggcgcccggcctatgaccagtaattattaaaagccagattgaataataaaatattcatcacatcagtgaagccattcctaaaatagcaatgctctattgtattcattgacgtatccccagaaattacaacagtctctaccatatagtagacaaccaaaagtcgttattgaattactaaattatctcatacatatcatctcaaacaactttgaaactttaaaacaagttggaatcaccaattaatacacccacatatacacactacttaaatatcaaaatatcttaatattttttgatatttcttgcttcttttctcttccacctcctgatatggtttggctgtgtcccacccaaatgtcaacttgaactgtagctcccataattcccacgtgttgtgggagggacttggtgggaggtaattaaatcatgaaggtgggtctttcccatgctgttctcctgatagtgaataagtctgatgagatctgatggttttataaaggggagttcttctgcacaagctctcttgcctgccaccatgtaagatgtgcctttgtttctcctttgccttctgccatgattgtgaggcctccacagccatgtggaactgtaagtccattaaacctcttttttttaaataaattacccagtcttaggtatgtctgtctttattagcagcatgagaatgagctaatacatctcctcacaggatttcttcacgtcatcattcctgaatccagtctctctgtattctccagttctgtatgctgcatgacaaacctaactgaatttgaaaactaatgaaaaagttacttcctttagctcaccttctatttcctcattaaagctagtatactagtagctaatttaaaataaaaaataaatatgacagtttttagaacacttatacaaaatgcttataccttgcaagttctgtttatgctccatcgaaaacacttaacattaaaaaaaaagaagttccctttaagttcccggcttacagatttaaaattcaaacattctttatactgtcgtatcattccctgtttctttaatgattctccatattccaacccccaaataactaaactgtgatgcagtgctgtccaatagaactttctgtgataatgaaaatattccatctttgtgttgttcaataataggatggctattaaacatctgaaatgtggctaatgatgtgactggggaaatacattttgattttgattttaattcatttaaatttaaatagtcacatacaaccagcggcaatggtattggagagtgcagccctgactcctaactttcaaggtgccacaatacagccttatcctacctaccaggcatcattcctacaatgttctaaacaacaggctttcctagcatgccctgatgcactttgtactttttctctgttgacaggattctattttcttaaataatagcctcctcgtgttttgttttttttaaatctattcaaattttatccacccactgaggaccaattcaatttccaccttctactcaaagccctgcattaaaaccctaattcaacaattccctatccaaatcggccatctccattatgctgtactgttaccctgtaccttatttacatgttgccttggcttgtttacaggttgttttgccaatgtgctttcccttccttgtcaccccaagggagttaagctctttaaataatgaagaaaaaagttaaatttatttgttcctcaaatgacctatagaatcctaaacataaaaccattgctcaataaatactttttatttgatatgagcaaaacaatttgaatatattaaaatgattcactcttcatgttttgccataatagaaaagaaagacatgatcttgacagacttttacacatttacaaagttaccaaaatagtctccaaattcaaactgcaagtcaaaaattctagggcttgattttaatccatcgttccattttctaaggatcccaagttaccctgcagatctgcactcatcttaactcataaattgcccccaggacagagaggctcccatcttcctgtaaatcattcaagcttaacttcatgatagaaaacgttaatttgattgtatttttttagtcatactttaaattttaaaagaaagtgctgccctcttgtgaaatgagctagaagatttatcatttcactgacagttgtgtaaatactacaaagggattaaaagttaaattttaacattaaaacaaaaacagggtttatctcaaagttgtatgtgtttcccctgaggtctctccccactgtgcttttctgctctgttggtgaatttcccaaccaaacaagaaatggatattagggtaaactgctcgtccttgcactataattgaaaaataatgaatgagtggtgtattttcactctattgggaatgaaaggctgtagtttctctatattactgaaggaataaagggaacaagagccagcaaaggagaagacgcatcagtgacaacatgggaagacacaagtcaactcactgtctgaccttgggcaagagtttaacccatacatgctctactctcagctataaagtgattatttcaacaatattccaaactgtgtagagttgtgttaatgttaagtaagaagtataggtgacataaatagcatagtgtttaccatcacacagtaagtgcttattataagtcatttaaacaatagggtccctaagaaaatctaacaactgtaatacatgtggtcctttattcaggcattcactatgtggcacaggtactagacaccatgaaaaaatacatatgaaagtattattttacaggagcttccattttgaactatccatgtgtgaaagttgttgataccaaaatggaatcaattatgtcaaaccctagcaaatggagttggaaggccacgaagggggagccctcactcacaaatgcctgtaaaggccttataggagacattcccgcatttactgcacatttgcctgtaacaggacttttagcaaggaaattcccctagaccgcaaagctccagataagcagcttgcacaaggacatctgtctagtaatgacgtctttaacaatgatttgtcgccaactcttacagcaagctcttgtaaccaatgatctttctggtttaacaaacagtttatgaagacttctctttgtctttaaaagtctccctttggtcccagtctccttgatgcgcctgtgatctggctcagcacacattttctgggttataatcctctgctattttcaaataaactcctctgttctggagaacctaagtttcttttcagattgacacatgaaaatacatgaaaaattattccatagtttcatgaagaacaagtatgagcagattcacaattgacagaaatgaccagtataaatcctatgggctttaaggatctaattaaatatatcagttcactcgaaacctacctgagtgacaaataatgaattatctcaattctaagggtactaagaactagacaggagaaaacaaataccaaactgagtattatccaatacagttttctttctttccagagtgtgttttttgtaataagattttgcttttactcctatcctctcttctggaattaggatgaagggaggatgagagattggctggacaaaatagcatagcaagagcagactgagctattttgactatatttctaacatcattaacaaacttgagtaactcacacactggttttcatttacccaccacattgggtctcacatgtaaataggtccatttacataagaatattaggaacaggtgtgcccattttaaaatgtgtttaaaatgtagaacattctttgattttcggtacactgagggagttgtctacataaagtaatctttagaaaaattcttttgtaatgtagcagatcttttgtcaaattaaaagccgccccctgatacatttgctttcccagtttgaatttttatgtgtgagaggttttcttgacttaggaaaacctcccatttcttgatcggtattatgatagggaataaaggaatgttggcatggtgaagtgaaaaaatgcctcaaggagagtatggatcttatatttccttaatataatacatattttctctttttaaacaaaatctctttttaaaaataacctgtaagaatggaggaatgacagtcatgttgttctgttattctaattagttgcttgtctgttcaaatagtagacagccacagaggaacctagtaacattttggtgagctaactgtggaaaaaagtctccaattaaatgcaaagaaaggaacttaacatgcacacattttaaattaaataatgctttgactttactggagtcaggcaaaaccagtgttgactcatcatacacttaagggaatgcttctactaaataaatgaaggttaaaaaggtggaaaaacatgcctcaataacttttcaagccgaatagaattgcatgacactgtaaccactaattttcttaatcttgtagagggggtagaagtctgacaaagtgaactgttaagtaagtatacagtaaaatcgaaggagtagacctaggccttgttaccatttatttaatcaggtaaaatagaatctgtttagtgacccatatgaaagatcaacaagaaaaggatttcaagttcagagaataagagaaatgaacccctagagtgtgtgctaaataatatgttttcaataaaggtgtgttgattcaatgtgatggaccactgaataccattttgacataaatttttttaaagagttgctttctcccccactcccattacaagcagccaactctgctctgacctcccactttttgccagagtcagaaccatgctttgagaagcccataatactcacatcaccaacacagctttctccatacctcctgccacttttaaaatttgttctccttgagccccaacagccccgttatacaacacagacttcttgatcatcacctttaagggtgtcttctccagatccttttattttttcagattcttatgcatttcctctaacccttcagattctgtctcttgttattaatcaaaaaactaacatcacctgtatgtttgccaccttgtcaattttgcaaagtatcgttttatgacgtgaatcctatttccattatttacctaaatgtttgtgttttctctgttccttctaaattgaactaagaggaaagcccaaggaataatgcagaagttatctttgaagccagtgaatttaaagacatcttcaaaacaaaatactttataacaaaacagtatctaaggactataagtattttaaaagatacaattctattgaactgaataaacaaaattatttttaataattaaagcagacacaaataattccttagagtgtccttaagaacaaaaattacttgggaatagaatccaatttaatccctggcatggatatacctccaggactttacaaaattctatgctaatctcaacctaaaataaacaatagagggaccaactctccacaacaaagagtttattgagaatagcaagaaattgcaattcgggttatgcttgctatggcccaccacaggtgcatgcaaagaggctgaagcaaggggaagcttttgaaagaaaaaaagtccacatgaactgttttgaaacaaagaccactggttccaggagcttgttacaggaatccacattagctcattgatgaaggcagctcttgttaggcaaacttccttgtgcaagcagcttatctggaatactatggttctgaggaatttcttgggaaaagttccatcataggcatacatgtgtgtgctcccttacttcatggcctcctggctccattttattactgcttggcataaaccactccattttggtactggcaactcttacatcaactaaattcaaatttattattactctttaatgaagttgagataaagttggtttctctgacaaactaagaattacaaaatgatacaatttctttttagaaaaacactgtggaaaaatgtaactaaaacactgccagggaaaaaaatataaagtaggccctaaaaatatatgactaatatatagccaaatatataattccatatactttatattttatggctgtcataattatctccatttttagaacttcttgagattattatgatattaacagtttgtaaaactaaatcatattacatgtataataaaatatttattttcacttcttaatgagtcagataaaaatcattcatttggaataccctggtattttattcaaaaacccaattcagtttagaaaagtattgaacctatgtatgaagctcttatattttgcatctctggatccaaaatgacatgtaagcatcagccatttgaacaaatcagggagatttttccaatactaattttagagttaatttaaaatggcataagaggataaggattaggaatttttacttaacaagcatttagttctgtgcataaggtttctacataggcctacatagggttttgcttttccttcacatgtattgatttgcttcagcaattgtggattcatgcctcttattcatatatttccctgctttgcaaaagtaaatataaattagtcatacgtgattcaatattaagaagaaaaatttcccatcgattttgcctttttcaggaagatgatgaaaataattaactacattacaaatgcgacacgacagaaatatcatgaactcaattgtgcaggtaaagcaattttaaaaaacgtgtgcatgtttctagaagaatatagtgctgcaatttttgatccagtctcaggaccacctcagcaaaattaacaaatttttttttttttttgagatggtgtttcactcttgtccaggctggagtgcaatggcatggtctgggctcattgtaacctccaccgcccgggttcaagcgattctcctgcctcagcctctcaagtagctgggattacaggtgcctgcccccatgcctggctaatttttgtatttttagtagagatggggtttcaccatgttggccgggctggtcttgaactcctgacctcaggtgatctgcccgcctcagcctcccaaagtgctgggattacaggcatgaaccaccgtgcccggcccaattaacacaaatttttaacaaaacaaaactatttacaaaataaataaaaatctgaacaacatgactatccaatacaacctactctcttacaggaaaacgttaaactcttttcttcttgttttactcaaatgtaatattttaaaccttaacttatactttggatacttacagtctccttaaaatacattattttccattcctctctgatagaccataatctaaactttcacctttaaagtcccccctaccaacttccatgactctttctctagttttaaaatgataaccactcatgtatgttactttctagtctccatcattttctgatagagacatgagctgttgactacccagtacctttaagtttagccttgaacttttctctcatgcaccggtaggttttccaggacaatctattataaaatagtagatactactataaaatagtagctatatagatactataaaataacaataataactccaggaaaaatatcctgaagatcaggatgaaaggaagactgaagcagaggatttgggattctgataaactccatggaaaaataaaaagtttatgtaaactcagaaggagcaaaaaagtattaaattaggctcatggtcaaaatttctctgattatgtaaaatctatttgagaagcacatccaataatatattttacagtcagaaatataatctacccagggaaatcaatattaaaaaaccataccaatatttattcccccaattctagggaagactatatagtcaaaataaaacaaccgccctactggggaaaaaaaatctcctccttcttgggctggggagactgtgtcactattttgtaatttccccaaaataaagaaggcattacaaattaaatagttaagaaaacgtgacgttgtagagtcccctgagagagtagaggaggtggacagatttgtgacattttatctctagacgaactttcctgtcactagtacaaaacaggaggaatggagccatttgcagcacaacttatctgaacaaggggaaggcaagcacaaaacttctcaaaaatccctcaaaatgtattacttttgcctcttgggattagagttagaaaaacaaaagattgcaaacacaaaaaaagaagatattaaggtgacaatgaaatcagattatcagaaaatgaaaaagaaatggcttgaaataagatctaaacatgacaaggacaactaagacaaaaaattaggctttatacaacgaatataatctctgtggacccacactacatattaaatccacacctgttaattttgctggctcataatactgggtatttgtataagtagtctaaattaaaggaaaattagccataataaaaagagaagttcagaccacgcttttgcagctttttaactgggtcaaaattggccagcccaaacacagacagtaattaagaaaatatcatcatcttttcaaaaagggacatacactctatgccttgtttgagatctcattaacttggaataagttctagtcaaagacaaacaggttttacataccttactagattttaattatagctaaatatagttgctaatttcatattcatgtaaacacttgcattgcctgtgtcaagattcctcagcaatatttctgtgaactgaaaagcataaagtcaaccaatcactaatcaaccgctttattcatggcaatattattcgggtcttgagtattttttccttaataacgagttctactcaattgaatttctaaaaacgtaagagaaactcaaactctaaaagtagcattttggtatctacttaatataagcatggcatccagaatctataattaccttagggccaaggaatcatttccataatgggttatgtaaacccaaaataaaactctacatgcccccctaaccatctgaatggaccaatcctcttggccaagggcgttccagagttaacctgaaaaactagttcaggccaagatggaagagggggtcaacatgcctcattacacccctccagcattaacatcaacacagactttaagtctgatatgaaacatctgtaatctgttctctctgaagcctgctacttggaggcttccccagcaggataaaactttagtcttcacaaccccttattgtaacccagacattcttttctacattgaataattctttcaaccaataggcaatcagaaaattttcaaatctacctatgacctggaagcacccgtccctccattttgagttgtcccacccttccagatcgaaccaatgtaaatcttaaatgtattgattgatgtattatgtctccctaaaatgtataaaagcaggctgtaccccaactaccttgggtacatgtcctcaggacctcctgaggctgtgtcataggtgcatccttaaccctggcaaaataaactttttaaattaattgagaactgtctcagatattcttgggttcagagttattatcattggtaagaatgagttaggaaccctaagatacaatctagtgcacagtttgtactactaataactgatcttcctcaatttcaaaggaaaaaaatcttttatttcactttatttacttattaatctgaaataaatattctttgttcaggaacttctggtcttcaaatgaaactgataaccaaaagactgctggcattaaaaactatttcaactacaaaaattaaaaattagtatattttaggtttcaaaaacaatgaggatcacagttgagaagcagttcttttcaaaacattttaatttataatataaatattgggaccaagttggcagactttcatacaaacccctaataataacagttgttaaaacaagcatttatatagcaattttcatgagatcagagctttgaataaacaaacataaactgtactcctgattatatacctccctgctcaaatctgtaagttatgagatactctttaagggataaaaacttaacacatttttttctggcaatttctcaataaactctaaattcatgatcttagtacagaaatatataaattgaatgtacgatatcagtttaggaagacgtaaaatagagtttagacactgtaaagcttttggggttccttggtattatactaagggatacacttaatgtatcatgtttgggactggactttggcggtcctctctaatctactctttacaataattcaattccatctataatatacttgataagtatattccaatttctctttgcgcatctgacacagtggggaactacttctcattaacattagattccacaatttgttcttgatattaaggtggaggggggagatgtttccacgatatgtcttagcttcctcttgtatcacagaaccaacacattttcaaaagataatccttcctctatttgactataactatcatgatcccttggtttctctctctctctctgtctctcaatctctctctctctcaaaaccaaaaacactttgttcactgggccattttttcaaatcttaatgttgtctgcatcatctctggcacatgctggagcctttcctgggaatagcctccctctctcctgcccctgataatgcctcatggccctgtggccaagatactatcaacacattcttcagaattatctgcagacgctcttccctggaaagtctgctttggcatttcaaagctttgttaatgcccctcttccatatagaaactcccacagcaacatggcacagacagccctaacacaacacagatcaccttgtctgtttatacagcttcatgattcaaaaaaatactgaaaataaaagcaataagataagaaaaaaaaaaagtaagaagcaataagactgtgtatttgattgatcgggtgtggaaaggaagagaaacaatgtattcaagaatgatacctaaatttctggcttgggtaactgagcaagattaacaaacaagggaatatactaagggaaacagatttgagttttaaagggtctgttgaatcacgaacttgtatgtccagtgagcagttgcatataataatttagagctcagggagagttatgggatggagacaaagcaaatagattgttacagaagcctgggaagcctgggaagagtatatccagtgaaaatgaaagagatttaaggacagaaatctggaaaattagttaagtatggagcaaaggaaagtgaacaaagaaaaaaagtgaaaaaaatggccaaatgtagcaataaaattaagagtatatgacaaatcaagaggtgaggacacttgaaggagagtattgtcagtgtacaatgggacaggaagataaaattatgtaaaatctggggagaggtaagcagtaaggtcatcaaagatcttggcaatgcccatgctgttgtcactgatgcagaacatcattgccttccttttcttttatttttattattttattttattttttagaaacaaagtctcattctgtcccttaggctggagtgcagtggcaagatcatagttcactgcagccttgaagtcctgggcaatcctcccacctcagccacccaggtagctaggactacaggcatgagccattcctgactaactttttttaaaaaatttcttagagatcggggtctcgttatgttgctcatgctggtcttgaattcctggcctcaagcgatcctcccacctcagcctccttgagtagccccattgccttctaaaaggattataagcaataactacaatttaatatatatcattctctcatacaagaaaaagaaaatacacataaagtatgtgtgcaacttccaaaattaattttaaataccactggtaactcagagcactatttagtaactttgattaattgaaaatcaattctgatgtaattttccaaacagatataccctagacctaactttttgctaagaaaatggatgttgtatcactatgaaattctacatacagtgacaaagacagaactatgacagacctatgttaagtgacttctttcactgttaaacaaaaattctaatgatttactacctgtgaatccctatttaaaggaagcatccaggccctagagataagcagtcccaagaggaataaaaccaatttcaccacattcaaaacaaaacactgcagtctgaaagaatgacaaaaaacatgaactattttttctatttaaatacatttcaaagaataaaaacagtatgaatacatcaacaaggatgacagatgctcaagagcttatcttccgagtataatgagcactgttttaaagaaaagtcccctgtacttcaaaattgtttcaaatgtttcaactagaaaatcattagtggtttttttaaaacagtgctctcattagataaaaagcttttcggagtttataaactacattaaccatttggggtatttcagaactaactaacatgttggaaaagaaaatttcctaaatactatcttgatatctagagctaccaaacactgaagctatacaaatacagcgtagtgtctaacaatgtctgatgcataaggttaaatatgtctcttctatgagccataattcctgaatcctcctattcactcaagttgtttaaaaggctcacgtaaagaagccataataaaactttttaaaaagatttttttaaaaattcagaaaaagaagaacattaaatcagaaagtggaggctatcgtaggcaattataattgagcacagggctcccagcaagtgtaaatgagcctggagctccctggctgccaaagctaacagaaaagcagaaattagttacatcattacccaatgtccattagggtggaggggaaaaggcaagatgttgaaacatatgccacgtacagaaaaacaccatttctttttttttttttaaacaacgtgtatgtgaatacaagtgcttgtataaaaatacataaaattttctggaaagctgtataagaaacagtggttattctgggtgtggtacttaggaagaatcccagggcaggagacgttgcacgttataacatgtatctactactatagttgctctttcaagaaacgtgcattatttcatagtgtaaaaatctatattagatttatatatagtttatattaaactataattttattttataatttagaagtataatataaatgaatgtaaaataataaagaagatagtacagggcagagtaacgtaagggccacataactacattagattctgaacatcacaatatgatagaaatcaagaagcacttggctgggcgcagtggctcacgcctgtaatcccagcactttggagggacgaggcagttagattgcttgagctcaggagtttgggagcagcctgggccacatggcaagaccctgtctctaccaaaaatacaaaaaactagccgggtgtggtggcatgcacctgtggtcccagctacttgggagaatgaggcaggaggatttcctgagcccaggcagcagaggttgcagtgagccaagatcacatcactgcacttcaggctgggtgtcaatgaagactccgtctcaaaaaacaaacaaacaaacaaacaaaaatcaagaaagaagcacgatttcaaccacctcatcacaaaatagttaccaataaaaaaaacctcaaggctactctgttacagtttgtaatcaaacttaaagatagctcaaagcagaaatccaatcatgttctttcacaagaccagtgagagagagaatgagagttcaagaaagagagaatgaacgaagaaaaaagaataaggaagatgtaaatgctatactgcaagcaactataatcccaatgtatagcactggagtgagctataaagatgactattacaatgtctgcaaatatgtattaaaatgtctggaaatatgaggaaaagaatacttctgctgctaaaatctatcttctttgttatcttcattatcaaaggaaaactttcttagagaaaccagcttaaaactattttttttttattatactttaagtcctgggatacatgtgcagaacgtgcaggattgttacataggtatacacatgtcatggcggtttgctgcgcctatcaacccatcatctacattagtaggtatttctcctaatgctctccctcccctagccccccaccccctgacaggccccagtgtgtgatgttcctctccctgtgtccatgtgttctcattgttcaactcccacttatgagtgagaacatgcagggtttggttttctgttcctgtgtgagtttgctgagaatgatggtttccagcttcatctatgtccttgcaagggacgtgaactcattttttatggctgcatagtactccatggtgtatatgtgccacattttctctaattacaagcataagaaagtatgaaacaaatcatgacggcttacacttcgatggaatagaaacttttattaaaaatttgcaacatactataccttaaaaatttccacttttaaaaatactatcactattacactcaattctagggtacttaaaattcatacatataaattataaataaacacccaaatacagtgtcaaaagtcaccacattcatatatttaaaaaaaataataattttctaagaagtcacagccaaaggaaagaatgactaggtttaaatatttcaataatgtgaattattaaattttttttaaaggcagcaggggggcctaggctgggcacgatggctcacacctgtactcccagaactttgggaggccaaggcaggcagatcacttgaagtcaggaattcaagaccagcctggccaaatggcataacgtcatctctactaaaaatacagaaattagccaggcgtggtggcatgcacctatagtcccagctactcaggaggctgaggtgggaggatctcatgaacccgagaggcagaagttgcagtgagctgatatcgtgtcactgcactccagcctgggtaacaaagtaagactccctctcaaaaaaaaaaaaaaaaaaaaaagaaaagaaaaaaaaaaaaaaagaaaaaaaaaggctagctgctaagtaatactgagaagtctatgaattcagaaaaggacattgcaggctgggcatggtggctcacgcccttaattctagcactttgggaggccaaggtgggcaaatcactgaagcctcagagttggagagcagccttggtaatgtggcgaaaccctgtatctacaaataataggaaaattagccagaggtggtggtgtgtgcctgtggtcccagctacttagtaggcagaggtgggaggatcgcttgagcccaggaggtcaaggctgtagtgagcccagatcatactacttggactctagcctgggtgacacagtaaaaccctgtctcatgtctccaaaaaaaaaaaaaaaaaaaaacacacaaataactggaggttttagattgttgattgcctttaaaaaccatttcatactaggtgacaatattcccatatatacacaaaagactaaaaacatattaacaggcctagcagttctactcaagaggaataaaaccacacaaaaacttgcacataaatgttcatagcagcattattcggaatagccaaaatatggaaacaacccaaatgcccatcgactgatgagtggacaaacaaaatgtagcctatccacacagtggaatattatttatcaatgaagagaaaggaaagtaccacaaaagctacaacatgaacaaaccttaaacacatgatcctaagtgaaaaaagacagtcattaaagcactataaactgtaggattctatttatatgaaatactcagaatggcaaacagaaagtagacccaaggtttccagcagctagggagaagtagggatgcggagataatagctacagggtggtgatggttgtacagctctataaatacactaaataccactgaaatgcacaatttcaatgggtacattacttggaatatgaattatattgcaacaaagcttttacaaaataaaaaacatattatcaagtcaagattctcttctattgtctccgttaatcttaacctcataaaccctaatcctgagccattgctgccagaaacagaaaagaacttacgccatcccagccatgcatctgtgggaacattcaagtaaagtctcctagttgtcacccacatggcaacgctaaccagggatggccaaaagatgaccctgacggacagtcacaaggtggcagctcatctgaagggcccccaactgataccaggacttcttcacccaagctcctcaattcaagatacttcagggtggcccagcagttcagattttctaaacccaagttctcatgagctatttactgggctctaaaatcctgaattcttgatcactgcgaaggcagcatatccacacatcccatgcctggactgtccatgttctcactaggcaccagcaccggctcggacactatgcgtgatcttatagtttgcctgaatggggctgaacaataggagttcccctgggcagcctgttctgactgccaggttgggcttttttgctcagctgtgcagctagacatttaaaagcaggcagaatgcctattcctgcacatctaatccaaaaaccttctagctcataggaaacactatactaatcatgcttgagattaccagtcaagtagtgaggaaatattttctgacaaattgcaaaatattattttttcaagtattttcagtttcctgggattgaataaaaccattttaaaagaatttatcataccgaagggaaggaaaagaatgaaaactagtctaacagataactaaaaacatgcagttaattcatcaaatagaatattagtgtagtgcagcccattaaatggtacttagattgcttttccttttgatgactactctggtgactatctgaaagaaattgtgtgttcactgagataatgtactcactacaaaacaatacatcattcaatgccacacttctgaggaaaaaatattttgtgaacaaaatggagaagcaggccgggcgcggtggctcacgcctgtaatcccagcactttgggaggccaaggcgggcggatcacgacgtcaggagatcgagatcattctggctaaaacggtgaaacgccgtctttactaaaaaaaatacaaaatattagccgggcgtggttgcaggtgcctgtagtcccagctactcaggaggctgaggcaggagaatggcgtgaacccgggaggcggagcttgcagtgcgccgagatcgcgccattgcacttcagcctgggtgacagagcaagactccgtctcaggaaaaaaaaaaaaaaaaaggagaagtagtgagttatatttcaagtttccttactccttaagaaatgtactatctgacggaataggtaaaataattataaatatatatgtccaatttattttgttaaatgcctcattgcacataagcaatgaagcactggcaaaatactaaattatgccaaatattattggttgtttaaaaacatactttaaaaaggtaaaagttgggccaggcatggtggctcatgcctgtaatcccagcactttgggaggccaaagcgggcagatcacctgaggttgagagttcaagaccagcctgaccaacatggagaaaccctgtctctactaaaaatacaaaattagccaggcatggtggtgcatgcctataatcccagctacttgagagaatgaggcaggagaatcgcttgaacccgggaggcggaggttgcagtgagccaagatcttgccattgcactccagcctaggcaacaagagcaaaactcagtctcaaaaaaaaaaaaaaagtaaaagtttacaatataaaaataagtctattcttacacagtatttctaacatttgtgaaaacaaatcacgggtatgctcttgctgttaagatgtaaaaattaaataagaccgcaggtatcagagaaaggagtttctgcagttcaagactgaggacaatattttacaaaattgtacatctctgctgtcaagaaagacaatttataaaggtctgagtcatgtttgctattatttcacttctcatatttctgaaattttcaggaaaaaaaagtagaaaaaaaactgcacctcaatctgtctgtaagtttctattacttacttcccagatcttcaatttgaggagatgtcccccatcttactgagactctccagccatattcacaaacgtttctcagcttttgatttctttttcagtgtcagtatatttataaaatatattttaacacttggatacaattatagaacagaatatagacaatatgaataaccaaaaaccaaatgttaaaaaaagaggatccattttcataacttagtgcagttgagacttaagttgttttcacataggatggaattaagaggaaactgggttttctcagtacaactttggttccctcaagatcatgtaaaagctagatggtccccacagaattcagaaagctttcggatatgcatgttctaataaatgtctttacatttttgatggaccctggcgcttcccaggtcccttacaagccaaggtatctgaaagactttttcttaacatccaaagggtagcaatgtcagtcttttacgataactcagaaaaggtcagaatttcttcaccatggaaaatttagcctccattccctctaaattaattttccttctttttctttctttccagagcattagtatgcctcagtgaagtatgacattattgtgttccgaatgccaagtggaataacttataaaactttttttaatagaaggaaatagaagatagagcccaaagccctcccaaatatgaaatgtgaaaagaagtaaatgagaggagaaccgatccacagtagacaaaatgaaataaaatattctacgctcttttgaaatgatgacaagcacctctctcaacatccttgattacctgttaagttaccacaattttccaatacatacgccaagctctcagcactccctgctactcctttccctcacaaaaccttttcttccttaattatgtatccccacaaattagtcatttttggaatttaaagaatgatgagccaagagtactttaagagctctctaaactaaaacttctttccaaactccctctctttcctccaatatttggaatataagctatacaataagatatcctaagatcagcattgctggagttggccaggtgaaattagtgaatgccagacaggaggttacttaggaatagttccaagtcatcttcaaaagaatagttacacacacacacacacacacacacacacacacacctctctctctcacacacacacactcactctctctttctctctctctctcttttggttttaccttcagcaatgcaacctcaaaaacttgtactccatcctcatactagaagggaatatcacttagcaggttcagctacagacaaggacagagaaggatctttccactgcaactgatatgacaccctctgctttgcctcaaccaaggtcaggggacatgaccgctaataccactgcatgtatgaagggaaggcaaagcagggaagagagaagaaccaaaaccaaaataataaaagtatcttctttcttcttcttttttttacatgcagatgaaaaaaaaatctgaaaagtcttcttggggtggttattgtgaaagagcagggctgaatgagggacaaggagggtgacagttgcagcacaggacacataagcagataaatactgaactcaagcctaatcttcaggactacaaaccgaggaaacatattaatggtatgcagagtaacttaaatatgcatataacaaactctccagctcaattctattcaataaatatttattaatgacctgttttgtatcaggatgatatggtttggctctgtgtccccatccaaatctcaccttgaattgtaataatccccacgtattgtgggaggtaactgaatcagggggaaaggtttttcccatgctgctctcataatagtgaataagtctcacgagatctgatggttttatgaaggggagttcccctcacacactctctggcccaccgccatgcaagacgtgactttgctcctcctttgccttccaccacgattgtgaggcctccccagccatgtggaactgtgagttaattaaacctctttcctttataaatcacccagtgtcaggtatgtctttattagcagggtgagaacaggctaatacacaggccctcagcaaagcatgaaaattaacaagactaagctctccttttgagtgttaatccttcctataatatatatgcttagtaactcccaatcagaatgccacttcattttttatttattttttgagatggagtctcgctctgtcacccaggctggagtgcagtggcgagatctcggctcactgcaagctccgcctcctgggttcatgccattctcctgcctcagcctcccgagtagctgggactacaggcacccaccaccacgcctggctaatttttttttgtatttttagtagagatggggtttcaccatgttagccaggatggtctcaatctcctgacctcatgatccgcctgcttcagcctcccaaagtgctgggattacaggcgtgagccactacgcccggccagaatgccacatttgaatgctttaaaatgttttaaactgtcttccatattctagatctccattctacattagcaggtatgcaatatgcctaaaatgacacaaataaattaaattacaaaggagatggaattatctttcacatatctaaatcatgccatggctaaagcagaagcaaagtttcagctcagatgaggagcacagtgattacatgacaacatctacattggagttcaaaagcaccaggaacaatccaacaatgcttaaaggaattagtctctagacttaaacacttaggcatttaggatgcaacatccctgcttccttgctggacatggaatcacaagactcagaatagaggttactttttgagagaagaagggggatctgatcaaggaggcacagacagcttctaaggatcagcaataacttggaatagtgattgttttaattatgattcttcatgctgtccatgtatgttttacatactttcctgtatgtatgccacactttaaaataaaagacaatacagcaagtatctctggaagagcacacaagaaactggcatcggtggctgcctcttgcaagggcggtgacagtctatggtcatgatgcgtcatttaggacgcagtacactagattttttactacacatcctttttgctttttttttttaaactatgtagcaccttctgaaaaataagtaagagcaaataagcaaatatgctaacactttgctcacgcatgatattaagattcaaggtaagcaatgaagatttgtatgtcacagtcaaagggaaagattttcaagaatgtggataagtactgctattggccatgctcagaataaaagaaaatttcataaagagagctaccaatgtaataatcaattttccatacacagggtaatcattaatcaaatttaacagttgcagaaccttattcctccagcccaaagatttgtcatattttacaggtccaatgccacacaggttaaatgccctgatcagttaaaccagccctcaactccagaacctcctatctgcccgggcagtttaactctgtaacaatgaccaatgtatcccaaagagatgagagttgtgaatcgtcagatctatcatcctcagcctcagggagccccctgaggaatctgagattcaccatactgtaagaacccttaatagtcacataccaaccaaaatggaatcaacagaatgtttctatgcgttcttttggatgattctatttaggatatgagttagtaaaccatgaaatctagttcacagaacaactcagaatgaaggagctttaactaaagcatgtctattagagaaaaagtcaaggaaaagctgaaaatgttggaagttctaaagaaacacagtttaaacagctcagtagggcttccaaagagaagcatttcagtggaattcttgtgggatagaaaccaatggtttctggtggaagttttaagcactggagttctgcacacatttcaaaaaaaaggggctaacaccctcctctcaggagtacaataataaaagaatactatattcatacagatttttcaaaggaagtgaacactggaacaagagctttgagaggtgaataaaatatctgattaaaacgtcatgtttatatagaccccaaagaaatgaaagcagagactaaaacggatacttgtacaccaatgttcatagcagcattattcacaatagccaagaagtcaaaacccaagtacccatagatgataaagagataagcaaaatgtgatatatgcataataattagccttaaaaaagaagaaaattggccaggcaaggtgactcacgcctgtaatcccagcactttgggaggccgaggcgggtggatcacgaggtcaggagttcgagaccagcctgaccgacatggtgaaaccccgtctctactaaaactacaaaaaattagccgggagtggtgttgtacacccataatcccagctactcaggaggctgaggcaggagaatcgcttgaacccgggagacggacgttgcagtaagctgagatcatgccactgcactctagcctgggtgacagagcgagactccacctcaaaaaaaaaaaaaaaaaaaaacacagaaggaaatgcagaaatgtgctacaacctggatgaaccttcaggacattatgctaatgaaataagccagtcacaaaaagacaaatattgtataattccacttgtataaggtaagagtagtcaaattctcaggtacagaaagtagagtggccattaccagggattggagggaaggaggaagtggggaattactgtttaatgggaacagagtttccgtttgagataataaaaaaattccagagatggctaatggtgatagttgcaccactgtaaatgtttctaatgccactgatttgtacacttaaaatggttaaaatgccatattttgtatatttcaccatagtttttaaaaagatcatattaacagagttacaaaatagagcaatgaattcaaagacagaaagataagggttatcaatattattaaaaacgcctcttatctgaatcacatgaagaaacagaaagtaaaccgataaatgaatgtaacagctattactccctttgacaatgctttggcctttacaatgggaatgacaccatttagatgtaatgcccttgtgcaaagcacaactgtacccaacatcttcctcttggagacaactctacccccaaccctaccccaccccaccctcctatcccattcatcctcccactgtgccatgctcctccccagccccctaaccccccatctgccgcgtagtgcacacacacacacaggtagggcaaaaggttactgaatggggcctaaaactaggtcagtgttttgtttgtatatatcaaatcttatttctcaatgatctacaaagacataagatataaaccagaggctgcaaactgaaatgcctaaaagagacatgcaggtaacacaaacgcagactgtgatttgtgtataagaaaagccacaacaccaggtggatcacaaggtcaagagatcgagaccattctggccaacacggtgaaacgccatctctactaaaagtacaaaaattaggtgggcgtggtggcgcttgcctgtagtcccagctactcgggaggctgagacaggagaattgcttgaacctgggaggcagaggttgcagcgagccgaaattgtgccactgcatctctagcctgggcgacagagcgagactccgtctcaaaagaaaaaagaaaagccacaacacaaacttgctacagaggcagcaatctcagtgttgggggaaactgagtggcctgtaggcagctgtggacatgtgcaaacccactgtaaccaaatctaccgatttttctgccttaaaagaggaattatttctaactcatgaaggtggagtagaattggagaaatgcagaaaggcggggaggaaagcggattcacgtttgaggtcggaatgtcatttgggttcttctctagtctggcccttgaccagttgcgagagggaaactgatttaaaggagattggagtgatactttgtgcccagaaaacctgcagacgtctctgaaagccatgcttgggataacaaactatttattactgaccctgtgataaggagagtttttcagatgtttgttgaaataatttttgcagtaccatggtaaacaaactgaaaaggtgagagataatagactagtttaaaaatgtaaatcaagatttgcatgaattctttaaataaacacccatcactgcttaacatatttttaattaataactatacaagtccatatttgctttctttgaaagtatgaggcaatgaaaataaactactggtcactgtcagcccctaatttctgtgatacagctatagaaatattgtctgaaagaaaactgtttgatcggtccagtgtcaacagaaacttttcagccagaaactgattttttttccttcttttcaagcttagaacaaggctttataaaatctccagttttgtttatgttttcaaaacaattaaacatcatttgatgtttctcaattatttttgtcacataaaaggaagatgaaatatattcaactggccccatgaaagcaaaaacaatcttagtaaggctgtgctttaggtttacttctgtggtacagaaggtaaagattctaataagtaatagaggactaaggggccctagggaaaatatgtagagcaaatcaattcataagtatttgcattagcacattccttcataaatttgccagcttctcactgaacatggcaccaatttatctcagtcctccggcttttcaaccacttcctttgaaaaatctaaatgaattctaatggttgtgattttagaccagtattctttacatgccaaaataaacaaaattctttcaagtttttaattctgaaaaccaacaaagtcaagaagtcgcaggtaagttaaggaatcaaatatgcagataaatacctcacaaacagattatcccatcaaatttccatggaaagcataaaccataaaaatccaactcaaaatagtataattacatagctttccataagacaggtagccagtaagggtatctaaaatattgatgaaggcaaaagacagttattttaacaagaaactgattctattaattcattgttgacctagaattacagaagtctgctgtggctgctccatatttgaaacgttacattcactggtttctttacagggggcatcacactatttcttccagacgtgtggatattttcttcctaatgaaagtacttcattagggcctttattgccaatccaataattcaatgttagtagccattagagtgccttaatttcaattttagccactgctgtggaaagtgaaatggaatttcagaagcactattttcctctgttataatggtcatcttgtcctctcttctgactctgccctcagagaaaacacattccgctctcttttctaaaaagaaatctctgtctcattactccctcaacgtattcatggtatttgatttcactgtcaaaaacgatctagactcactgcctcatcaagcattgatttttaatctaagttcctaaggctatttactgaaatgctctcgtaaagacctgacttcctatcctatcttagtactgtatcaccactgcctgctgcacatttctagctggagagctgacttagctgccaggatgtcaatgaagccgaaaactcctcatctccttcccattgccccttctgcccagccccagtcaaccttaccctcacttcactcttcctggtaatggcccccggccacccttctgatcttctgaactgaaattttggaagtatctccaaatgttccctcccctctcgcacacccatgataaccaggtatcagtggctattttctaccaattcaaactgcccacatctacttctgcttttccattttcagtgacatttccattcttcggttgttggctgactcttgtctaagctcttactgtcgtcgtgcctggtctccctcttctttccacctattacttttctgtattacattataaattgtggccagattaatctttctaaagcacagtaatgccctcccttgctcaaaaaccttcagtaatatactcaaatctagactcaagttcatattctttgacaagaactcaaaatcctgtattatctgacctaattttacctttctgtcctcattttcccaatatgctccttttaacagacactacttggcaacactggcttcatcccattcccaagccactaatcaagctgtcccctctgccctcaatgtcattttctttctttcccaccatttctacctttaggaacccagcataaaacatctacctggtggccaattttcccaaatagaaataatctcccaaatctgaattactgtaagactttgttcctctctctcaatgattactttcttctacttgtcttcttttattgccccagagatatagttttatctgccctctaaaattccaaaattcaaaattcaaaaattattaaaggtatcatgtatttttcatcttcctgtctttcagtcccctaccaatgcaggataattttcccaagatgtgctatagaacctgttgttgaatgaagggaaaaaatcccgtgaataattttttaagcactgaaatctaaatactaacaaagcaaatagtgaattagaaatattaaaattaaatacattttctatctctgtaacttgcaaagctctaagacatttttacaccaagacttccaaacagctgacttagtaatctatctgaaagaggactaccatttttcttcactaaattctgtgtgccataatgaaattaaaagcaatcttcaatcttccccagtgttccaaaggggatctatttcaatgtatgaatgaaacagcgtagttaagagtaacaagtacttagaatcatttaaagtcatttacaaaatagccttaaacattaactcttactatcactgtcatttgcaaataaaacactttgtaaaaaatttccaaaggtgaattaaaggtgtattttatatctaagttccttaaatgattgaaaaaatgaatttatatacacaagcttcactgacatcactaatatttctgattgataaaatatattgctaaatcaattatttcgacctttctcatattacagatgaagaaattgaggcccagagaatctaaacgacttgatccaattcacacagctaattacaaaatcaggacccaaactcaagtgttcagtcctctatttacagagctactacttaggctgataaagtaacaccagtgggaaaataagtttatctaggagattcctttataattttctggaagaaatctggctgattgggagaactgccactgtaattctttaaaatgccatgttgctagcactgtctctatactaatattaatggagttgccaataatcttgctcttctgttaattagttatgtctcattttaaaaacaaaggtgatccagaatgaaacaggtatcatctgcaacaatcattgtccaatacgagagtgacagtcactttccaatgcagatgggagttcctacaatcctttcctgttttctagagctaaatttcctctttgtgagaaaacatattttaaaagtccatttataaataaaagcctataaatgttcatgctttatttccccttggataaggtaaaacaacattacaatacagatgatttctaacattcttgtaaagatatcagaaaagacacattattattccatctaaaatagtaaaccaatatatttttcttatcacatgatcccacaaatatataactggctattattcttaaatttgatgtcataaaaatacttatatcttttcttgattagaagataccatccagcctggcacagtggctcacacctgtaatcccagcacttcaggaggccaaggcaggcagatcacttgcggtcaggagttagataccagcctggccaacatggtaaaaccccatctctaataaaaatacaaaaattagccaggtatggtggcatatgcctgtaatcccagctacttgggtggctgaggcaggagaattaattgcatgaacctgggaggcggaggtggcagtgagccaagatcgtgtactccagcctggacgacacagcaagactccgtctccaaaaaaaaaaaaaaaaaaaaacaacaaaaaaaaatggataccatctattgtaagataaaacactcattcaatggtatatttgagaagagtaatattacacatatgtataaataatagaaaatattcaactgtttattaaaatttcatgaagaatgtgataaaacatgtcacgaatacaatgaagatctatttatattaaggatgagcaaaaataagcaagagctttaaataaactaattataaccaaaaaaaggagaagagggagagagaaggaagaaaaaggaggacaaggaggaagaggaggtggaaaaggacaaaaggaggaggcaaaggagaaaaaagagaaggcgtaggaagaataaacatcttttccataaaccaaacagatcagcttaacaattcccttcagcattactagcaaatgaatcagatagttattacactcttatactgggggtctcatatgcaaggtaaaagatacggcagtgattgaggtataaggagagtctgacttgtgaacacgatgagaatcactatacctttcctaattaagtatcagcaacatccacctgtttcacatacacaggctacatatgttattattaacactatgagaagactctgcattgccatcaaggagagaatatacaaatctgagaagagaattgcatcatagcgagataagtgctatgggagcccaagatagggcgtaaactcattctgtctgaaagggatgagagacaattcactgataagatacatttgatatgggccctgaaggatcagtaaaactttctagaagaaaggcatccaagcaaaaggataggtacaaagtcagaaaaaaatacatggtttctctggagaaccataaaaagtttcatatacagtatggtttgttcacattagcaataaaacaactatcgttctctaaaatggttcataatcaatgttttataactcactgaaattgctattcccactcctaataacagttattagtaaaaatgaatattacaaataggcgtttttctaagcactttacctgtaatagctcatttaatcttgacaacaaccctaagaggtaataccaccattaattactctcattttgtagatggagagactggggcccaaagaggttaactagtttgtccaaggttacagtctgacttcatgatacccttagatccaatactgtaaatcacacactcaatcattaaccctactaataccacactggagctgctcttactatgcaagctctcctcacttacacctgaccaacctaagtatgctgtggacaaaaagaatgggaatcccagatatcttcaggcctccttagaatccttaccatgtctcttcttttccttcttctccctcagtgtttcagacctcaaagctgctatttcactttacaataatccttaattccctcctcattctcatagtaatatcaccaagaaggcagccagatcaaaaagaaaaaaagtaaagagtttgtctataacaggtaaatccccagagttgtcttgtccccagctcaccacacctttattagagaaggtaggttttcatgaaatacagacatagagatgtacaagagatggaaaaaaagtagtaagaaaaccagtattatcttggatgctgtttctcattgactacatacatctcagcacagtgatggcagaaatttaacatctcccaaataatacatttttcaagagttctggttcttctttcccttgagaagctatgctttttttcaaagtgattttttgaaataagaaaggcctgtaagtctaccaattaagcagatggagcctttattagaacaggagcagaagctaaaagggcaatggcatgcacaccccgattaatttacccaggcatcagagttaaaggaacccgctctggagcaaaaacatagtagccaataaaatgcaaatggagagtttagcagcacaggtgggtacttaaaaatgatttaagcaaactggcacatagtagtgacattttccattctgcaatcatggccatcacaatgatctcattaaatttacaagctaactccaaataagccaggctcaatataaacagaaggcatctaaagtgatgcaagaggaatccaatatataactctccatttgcatccttaacaaaaaagataaagagagacacattcatgcagacacactggatatctgggagagctccagaaatatccacacttacacattacatgtgatgtggtactccaggtttaaagacctttcctattacagaaggaatgcccttcctgggtggtctagtgttgaatcatccacctggttttaaaatgcttccttatttctaactcaactgcaatagaaacattatccgcaaaatttcactttcaaaatgggggcagatattaaggcatcatttttaagtcctcttctctcctatggagtccatctaactttgtcttcttctttgtcatctaactttgtccatctaactttgtgttagaaaattagtagaactgggatatttcacatttttgacacattttgacaaacccaaccaaattccacagcaacttcacaaagattaatgtacatctccagaaataaatcacatagaataaaaaatgtattcaccattgagaaatttcacaaggcacattaacacctttttctgtgtagacacccaaaagttttaaaggtaaattgggcttctcccatattctggtttaagaggttgtaaagttgtattctgcttcagtaactattcagcttcattctataatgagttgcatttctagactgaccaaattgataggcagagtcctcaaaggataatggcatcatttaaagtagaaggcactgcttaaatgccaaataatcctgatggcataaaaaacagctgtactttactaatgaatatgacattgtggtcatactactacatattgatttaaaaattaataatgatagtctggcacaatattaaaaatgtgtttatcgaccaatttgatatgaattttgttgtgcttatttaatcacatagataccaaattcataatatgctactaagacctcgagggagtcatctatgactctaaacttactatgatcacaaagaaattatatctaaaataatgggctattgctaagtgtcagcaaaatcgaatgattctatttaaaagatcaaatagcttaatcacatcaaagttatgcatggtcaatttaatccttatctttaaaaaggctcttgttgaaagaatataaattctgatgtgaggaacataaaagttgttaaatactatacctaaatatatcattttaaatatttgcatgtaaataaaacatatttggtgtgttctaactttatttggctgttattgttgtgtttaatgatacagcaccatgcttagctttaactaatatagcatataatatagagtattttaatttccaaactttaaacaataataacagagtaaaagaactgggaaaaggttatcattgtgccaagtacatagtaggcacaaaaataaatatctgtcaaataaatgaatagctagatgggtaaataaaattaaaatggggctcatttttttaaagtttcttggttaactactgactactaagattctttgaagcaaatagattttgaaaaccaactctaaagtcttttagcctgtaaccaaagtacagttagtgcatgcctaataaataagcatgtgttttgtacatgcctagttaatacatggaagattaaattcaaatgtcaagctaaagactggtttgtggcaaaatattcaaacaaattgaagaaatatttattaaggaatacactcaaggaagcactgtacttagtagtatcatcaataaaaagtaaatataatatttaaacttgaaaaaatttcagctgaataaatttccaaatttagtgtggcattgtagaggagaggtaaaacctccagtggatatcccaaagcttccattttccaatgtatgacaatgacattaaaaattatgaccctaattataactttcaaatagtgacagatggcttctctgaatggtctctgtaccttttaatttagtttgcaaaaaagatccatctgaattacaatgtaagtgcattaacactcacatgtattctctttttaaacacccaggtgcaatttaatcaaagcaagcttttagagaaacaatacaatacagtcaaaggaaaggatttctcaatgttctgctaaatcgagggatggcttttttgattatctggaagaatagttgaactgcccatttcaaacaatcctccctgaactcccaagcaagctctgcatggtaccgagtgggtagcagtaaatttgagattatgctcccctgcaagcatactccccggtagaacagtagctctgtgcagcttattcaatgcaaggtgatcatgcttcaacagcttggctatgcagagcaagactgatggacatttacgaagagctgaaaaaaaagaacaccttcctaaagagaagtccacctcaactctcctgaaatgatctgaagaagtacaggggccaagttcactcaatgcaatcccaagggcaatctcctgcagttcatcaacaaagcatagccacaatgactttagactggaagatgttcaaagcaaacataaatcaatactcatagttctggtctccataaacataacctcagcagatccagtattaagaaatataacttgctgaagctgccaagaggaatttattgccaaacgcaaacctggataccaaattgaggtgacttacagttacactactttaaatagaggaaatatcatgtgaaatcatgatgatggtttcagaatagttaattgatagcagggattggatgggtaggccagtgggtgattaaaaacattcttagttatgtttctaaacatatcatttgtataatacagaatgcttctctttttgctcaccagagtgatggtatggtggatataattcagccaaaagaggcatcaaatcattaagaactcacaatgtgcagacagatggaagacagaacacattcctgactaatcccaatgaaaattatccactgatatctcaagaaatcatttctattgaccctgaatgtaaccaactacagtataacagtattatggcacaagttctgcttgaaaatcaataatgcagggtttgaattgaattcatgggactttattcaataatagatttctgctcacggattcaaaggcaaaggatagtcaataaaggccacaaatagtcttcccgtattcctaacagatttctacaccaggtggtagaacgctatggcgggctggctgcactgatgcccacctgcgcctggaatagaacctggcacaagaaacacaggctcacaatttataagagcggaactggcatagaattcagagagactgtacaatgagccagtgggcataagatttggggagactaaagaattcttttcttgaaaaggaagtggtaagccattctgggtatttttagaggctattaaataactataataatatacataaaaatcaaagtaaaaggctaccaaagatgttcactttggttaattttagattgtgtgaaattcacctttatttttaaaatcttttttaaaaaagggcttttcaaaaaaaaaaaaaactatcagacaaaacacaaatttccgaagtaaccactgatccatgagtgcataggaaacaaactgacttatatttgtcattagcattacaaggcttgctactgcaaattataatggcttgtagcttaatccaaaggattcgctaacagttatttctctcatctttattatacatttctatagattaaaggtatccaacaaattgtctttaaattctagccacaaaccctgctttattaagtagttcttaagcaataatggtaattataattaactgtgtgaattatttaacaatagttcagaatcaatacttgttaaattattcaagatttcacctgtatgctgttaaggcccactgcttatctaattcagagtaactgaattaaacacagtataaaacattgtacatccttagggtccaatgctactgccgagaaggagttacaacatggagatcagtgaaaactgtttcaagataatgagacactagtgcaaaggtcctgtggtaggaaggcttggtatgtacaaggaagagaaaagagccaaatacagtgggccaggggacaggagtgatggttaaaaatttttaaaatgtcagagagacaaatggccctgcctgatcatgtaggacctggtagggcagcgtaaggggtttagattttattataagtgtaatgggagcctttgggttgtttcaagcagagaactgacatgacttggtttatgtcatgttatgtatttgcttccataacttatgttatgtatttgcttcaaatactagaagcaaaaacaacacttagatggctactccatttgtctggataaaatggcatggctttgatggattaaccatgaaaatgaagagagacagatgattaagaatatactttggaggcagagaccaatgtgctagctgaggtacaacaaataggaatacatagggtaggtgaaaaaatgagcaatcaagcgtgacttagagtgttctggtttgagctaaaggattcagaaactaactgaatgaaaaagtcctaaagggtatcatatgagcacagagaaactcctagtccaggtgtctaaagggaaaggcagtgagataggcttcccaggagaagtaatgcctgagatggcaactgaagttagacaagtggactcctaaagaaaacagtctaaacagacagaggaaatcatatttatgaaggctcagaattaaaagatcatgtccaatcatttatgaaactgaattaatagtgattatggccaagtaatataggaaatgacttctaggaagctgcgccattgagaagtgtgtcattttataatattataatatataatactgactctccactgaaactacagatctagtgctttgtggacattctttcaatgtaagtatttctgaacagttacaaacaaactgttttaaataaactaaaatgtctgtaattgattcataacaatgtttcatgaaatttagcatcttttctgtatctcaacttttctgtcaagtattttataccctataaatgaatatcgggaaagaggggggtttgttatttagactaatgctctaatttgtgcctttgaaatgttgagggtttcttaaaggttcatatattgaaagctacacgttatctttgtttaaggtcaggaattgcttctaaacttctttaattatcatgtaaataactttcctaagaggagaacaacttagaaaaagcctatatttctaaccctacatagactccatagcccaaagtacaagaaagaatttattcatccacatatttaacaccactgtgcaaaagcacatttgacctcctcatttacaagttaattcatagggatcattctaactgaagtgctgctggtaatggaagcaccacaggccaaaggaagcttgcaatgttcagggaatatctagctccttttgtttattcattcccttgttcattcattcatttactttgcttgaagaatgtgatgcaactgacatgtaatccatcacatatctgagaaaaccttacaattattttcgaatttgtacttaattaggaagatgagctgagactaaagggatgtatttaacctagcggttaggttcaaaaactcactggaaaccttcccaggaatctgtccttgggggaaggtcctgggactcctgtattttttcctatgatttggtagccactcttttcactcttgtttcttcttcatttgctctttctagaatcagctggatcttttctccatgctttactgtttctgttttaagataatatttgaatttatattcttgtttaccaccatgaatctcattcaacacctccccacagcaccttttagaagcaggagaaagcattacataccagcattatacctattctttcaggctacacctgcaaccattggtaaaattaatgacaggcaaaccaagctgctgagacttctagtgttgagtcgttactataaattcagaaaaggaaaaaaaaggctctgactcataatgagagaatcattctttcccacagtcacaggtgagaggaggaaagaagaaatcaatgacaatctgatgagtacttttagtatgggaaaagataaaataaaatagtgttttgaaaatatatatgtttgcatacatgcattagaacacattttaatgcgtgtatatatatttaattttacaaaatacaagagaatcatatcactattttttataagttccttcctcagttttctttggggaggggtttcttgtcagctttattgaagtataattaatttaaaataaaattttaagtacacaatctgatgagtcgtggcaaatgtatacagtagcgggaccaccaccacaatcagcatataggtcatttttaacactctagaaagtcctttcatgtccctttgtagtcaattctcaagcccctgtcaacaattgaactgctttccataaccataattttgcctttctaaaatgtgatatgaatgaaatcatacaacatgcatttagtgtttttgtttttgttttgtaattgaaaaaccatagtggtacacatttatgggatacaatgtgatacatggatacaacacggcatgatcaatcaaactaattaaccgattcatctccttgcttacctgtcatttcttgataagacatctcaaatttattctcttagaaattttgaaatacataacacattattgttgatttggttggtagccactcttttcattcatgtctctccttggtttgccataaatcctcttatctatctgaaactttgtagcctttgatcaacaatttccccttccttctctccctccctcacccaccaagcttctgataaccatagttctactgtctacttctattaattcaaatgtattagattccatagataagtgatatcaggcagtatttatcattctttacaaaggactttaatctctttacataatgacttccaggctcatttatgctatcacaaatgacaggatttacaccatttgtaaaggatgaatagtataccattatggagatataccacattttctttatccattcatctgttaatggatgttttgttgttgtttccatatcttggctattgtgaataatgctacaatgaacgtgagagtgcaaatatccctttaacactgattgcagtttctttggatataaagacccagaagtgggattacttggttgtatgtatttctatttttacctttttaagaaccttcataccattttacataatggctatactaatttacattcccactcacaatatatgagttcttttccttttctctgtatcttctccaacaccagttatctttcatgtttttgacaacagccattctaactggggtgaggtaatatctcattgtggttttgctttgcatttcccaagtaattagtgatgctaagcattttttcctgtacctgatgatcatttctgtatctacttttgggaaatgtctgttcaggtactttgtcaatttttaaatcagtttatttgttttcttgctgagttgagtgcttatatatattggctgttaaccccttatcagatgtacggtttgcaaatattctctccccttctgtaggttatctctccactttgattgctgcctttgctgtgcagaagctttttagtttgattcaatcccatttgcctatttttgctggtgaacggccatattaaaaaaatcattgccttaaccaatgtcaggaaactttttccccatgttttcttctaggaattttacagtttcaggtcttatatttaagtctttaatccatttgaagttgatttttgcctatggtgtaagataggggtctactttcattcttttacatgtggatatccagtttttccaacataatgcattgaagaaactgtcctttacccattgtgtgttcctggcacctttgtcaaaaatcagttgactataaatgtgtgggtttatttgtgggttttctatcttgttccatggatcaacgtggaattgcatgccgattttatgacagtactatgctgttctgattacagtctctttataacatgttttataaccaaggaatgttaggcttccagctttgttttttgtttgtttgcttgctccagatttgttttagctatttagaatcatttgtggattcatacaaatttgaggattattttctatttctgtaaaaaatgacactggaattttaacaaagattgtgttaaatatgtaaattacattgggtagtatggaaattttcacaatatgaagtcttctaatccattaacacagaatatctttccatttatttgtgttttctttaatttttcttcaccagcgttttatagttgtcagtacacagtcatttacctctttatttaaatttatacctaagtattttgttgttgttgctactgtaaatgggattgtttacttaattttctatttggataatttgtcataggtatatgaaaacactgctgatttttatatgttgatgttgtatcctgcaactttattaatcagtcctagaagttttttagtggaatcattagggttttctatacagaagatcatgacatctgcaaatggagacaatttcatttcttccattcctgtaagaatgcctttaatttctttcccttccctaatcgctctggctaggacttccagtactatgctgaacagaagttgtgatagtgggcatccctgccttgcccctgatcttagaggaaaagctttcaactttttaccactgggaatgatgttagctaaatgtttgtctatacatcctttactgtgttgaggtacattccctctacagctaatatgttgagagtttttattatgaaagggtgttgaatttggtcaaatgcttctaatgctttttctgcatttatcgcgatgaacatatggtttttgtaattcattttgttactgtgatgtatcacatttattgatttgcatatgttgggccatccttccatcctggggataaatcccaatgatcatggtaaatgactctttttatgtgctcctgaatttggtttgctaatagtttgttgagggttttttcacctgtattcattatggagattgccctattgttttcttgtttgttttggtttggtttggtttggtttttttgaaacaaagtcttgctcttgtccccgaggctggagtgcaatggtgcaatctcggctcactgcaacctatgcctccaaggttcaagagattctcctgcttcagcctctcaagtagctaggattacaggcaagtgccaccacgcccggctaatttttgtatttttagtagagacggggtttcaccatgttggccaggctggtctcaaactcctgaccttaggtgattctcccaccttggcctcccaaagtgctgggattacaggcgtaagccaccatgcctgggcttgtctagcttttgtattgctagctttgtaaaattagtttggaagtattctgtctactttgattttctagaaaagcttagaattggtattagttcttcattaatatttggtagatttcagtagaggagtcatccaattctgggcttttctttggtgggagaatttttattactgattcaatcttcttacttattattggtctgttcaggttttctccttcttcatgattaatcttgataggttgtgtgtgtctagaaatttattcatttcttctatgttattcaattagttgctgtataattgttcagttcttatgatcctttgtattttgggagtatcaattgtaatatctcctttttcatttctgatatttacttctttgggtctttttttttttcttggttagtctagctaatggtctgttgattttttttttttcaaaaaagaatctcttagttttgttgaaatttttcttttatttttctagtctgtattccatttattttggctctgatctttgttctttccttccttctggtcactttcagattagcttgttcttctttttattgttccttgaggtgtaacattagattgtttattcatgatatttcttctttcttgatataggcatttattgctataaatttccccctttctgctaattttgctgcatcccataagttttggtatgctgtgtttccatttttctttgtctgaaggcattttaaaatttcattctaattttttctgtgacccagtggctgtttaggagcatattgtttaatttccacatatttgtttattttccaagatttctcctgttattgatttctggttttatcccactgtgatctgaaagaacacttgatatgatttcaatactcttacatttgctaaggtttgttttgtggcctaacatctgatctattctggagattattttatgttcacttaagaagaacgtgtattctgttgctgtggaatggaatgtgctgttaggtctatttggtctatactgcaattcaagtccaaagtttctatactgattttctgtatggataatctgtccactgttcaaagtgggatgctgtggtcccttgctatcttagcactgcagtctacgtatcccttcaggtcattttataattgctttatatatttaggtgctctctaatgttgcattcatatgcgtttacaattatgtctgtgaattaatacctttttatcattatgtgatagcctcctttgtatcttttatggtttttgactttaaatctattttgtctgatataagtatagctcccctggctctccttgggtttccatgtgtgtgaaatatcttttttcaccccttcactttctatgtacatgcttattaggaaagcaagtctctactaggcaacatgtgattagaccttactttttctttaatccatttggctactctgtatctttttataatagagagtttaatctattctttatttccccatccattgagccagtcttggttattttattgaagaatttaatccatttacattcaaggcagttactgataggtaagaattgctactgccgttttggaatttgatttctaatttagatcctttgtttccttcttcctctgtactgtcttcctttgtggtttttctggttttctgtggttgtatgttttgaatcctttctttttatactttgtgcaactactataggtttttactttgtagtataaaagttgcagataccaagatgaaattactcttctcaaacccaaacaaattgcagccagcaaagcacatagagaggtcgtgtgtggatgtctgagataaaacctatctcaagtactttctaaaatagccacacaagaactttttcatgtccttcacatatctccctcccacaaagggacccaaaatggcgaggaaatggaatatcctcctccaattcacttttccccctgtagaaaccatgggtctagggaaattctctgtgtgtgccactgtcccagcttgggggaggggtggtacagtcaaagaaaactgttccgcttattgttcagccacagcttttctcagttctgtggtcaagtggatgtctcaagttctgggttattcacaatggtattcttgcctgatgatagttgttagttgaatttctgggagagaggggaacagagaatgaggcccgataacttctattctaccaccttgctgatgagatttattttaggaaattggctcacatgattgcaaaggcttgacaaatccaaaatctgcagaataagtcagcagactggagacccagggaagagctgctcttcaagtccaaaggccatctgctagtaggattcccttttcttctgaggaggtcagtctttttctattaaggccttcaactgattggatgagacccacccacattatggaggataatccgctttactagaagttgactgatttaaatgttaatctcatctctaaaaaataactgcataaaacatctagtttgaacaaaaatccggataccatggcctaaccaagttaacacacaaaattaacaatcacattagtgtggagagatgaaaatgaaatctggggaacacaagatttgtgttagaaggcagtagagtgattgaccagcctgctttatctgggactgaggggtttctcagagcaagaggatttcaatgctaatgctgagacagtcccaaataaaacaaaacaaggtcactctaaagcaaggttatttcatcagtccttgttcttgtttcaatctcttccagtttatctctgaccttctaagttatacagattcatgggcacaacagtctttggacaagaaactaccaaaataatgaaaaaatgtactgtagtttatacagaagtttttggtgaattttgatcatgatgatgagtgtccatctctaagtgtactgatgaagtctagtgtacaagcccaccaggataatgtcatcaaagtttcaaagtgcccaaaaaatcagacaaatagcctttacccagtgaaacctatggtcctttttgcaaattttctcaaacaagattatcagtgaaatgttggtatagcagaaagagcatttcctaaacttatttccatggtaaaagttggttcagaagaaaagaagatgtttagaaaatattgacatgagaagatgtttagagaatattgagatgaacaaagttaaatagcagaacttcccatagccttaaaaatataatgtgcatcgtgcagctccaaaggaaagcataatttgcagaattttccaaactgggccacagaaatcactttcacagtacacactatctcccagaatagggttcaacagagatccagtttgttaaagacaggattaacaagacatacatagaaaatatttcagctcatcaaaatatttgcagaaacataatttctggctcaacattgattctcataagcaattttgcagactccatatttgtttatgtatcttagtaaatgattcaaatgttgattcactagtgagttttacctttaaagagaaaattacttttcttctttcactttaacatatttacaaaccagcaaataaatgggtaaaggatgtacaatgaggccaaggacatcatgtggtggagccacagcccctcacttctctcctccttacaggcgttcacctgaagcatcctgggtaacagatctctctctgagcgaggaattgcaggtcacctgtaaaattattctaattgacttacacttcactaaatttttaaagttaatattggcacttacacctcaaacagaaattccaggataaaaactcaagaaagctaagacaatgagattttaggaaaatgtgtgttgcaggttatggagaatttctaattcagtatctaaattatgtaagatcaaatttatagaatccaattcgagagtgttggatactatatttctaagagtttgcatcagtgctactttgacccactggaaatactgctttaagacccagatcaatttgagagaaggtctgagaaacatttttaatataatacaaggcattcatgcaaacttgaaaacagatacttactggaatgagaaaatgcaaaactaatgaaaatattgaaaatgtcagtacattgtgtagcacttaaactgagcattagctaattttaatgattgctttttcctgtgctactgccaatattgtcagcaacagatgttgttactgaaaatgctaattattataggtcatagacaccctctagctcgctctctttcttgctctctcttttggtttgtattggtaattacatctgtgcatggataagctgcatatgatttgaagttgtgttttgtgtaggatgatgtcatcacatcaaaataacaaagagatcagttgtttaacttcccaatgtcaaacattgttttacaaatagtactgaataaaactaagttcatttatgatcaccaatcactgcattgtcacatttcaggtcgacaaggtacaattagaatatatttccatttggttataacaagcaaataacctcaaattaaaatgttaagacatgaaaaaaatcacaaaacatatactatattaaatttccaagaaagagtttttgcagtatggacataaatgccactaagacaggtacaaaacttgaaaattatttttagtaactcaaaaatgcaaacatttacaaagaaagataaggagaatttaaaataagagtaaaaagctgtcataaaatcctcaaaataatttcttctgcttaatttctaaatatcccagatatcaggaaacttagcctgcatttatactatgaaaatctgaaatgaagatttcttactttatacttaagtattaagttcagttgttagatacaaaacatgaaataccaaaaaaaaaaaaaaatggcacccacactgaagttaacagattctgagattagctgcaagaaataggactgtagcgttttaaagtagaggtgacacaataaacagaatattgattcacttctaagtaattttatacaaataattgacaggttatctcttgtcaaaactgaatggtaatggaaaagttattcggtcacaatgaaataagagtgggaacagacctggaattggagtttcataatgaaacagcaaaggaagttctattatcaatgccctgcctagcaaactggtagttctattctatcctaattcatctcatcaagtactcttgcatacctattatatgccaatgctggatatcagggctgtgattctgtgtatagcaaacctttggcagatgtgctataaaattttgatgcatgaaaaatttaattttgttaaaaattttgtaccgtgctgttttggatatataactgtcatggaaaataggattaactgagaaggtcctatgacctggtacaaaggtgataccattagcctaagatccaaggggtaatgaccaagacattccaaagagagatctgtgttcattagtaattagaataactttttcaaggcaatagagttttactcaatagcaacagagagctgcagggaagccaacgatatatcgtgagaagtggattcttccataaatatgagactaggctcagataaaatatttgcaaactttagtgatttttttttgtcgtttatttttcatttatttatttattttgagaccgagtttcgctcttgtcacccaggctggagtgcaacggtgcaatctcggctcactgcaacctctgcctcccgcgttcaagtgattctcctgcctcagcctccccagtagctgggattacagatgcctgccaccatgcccggctaatttttgtattttttagtagagatcgggtttcaccatgttggccaggctggtctcgaactcctgacctcaggtgatccaccttcctcagcctcccaaagtgctgggattacaagcatgagtcaccacgcctggcctttttatgctatcaaactttaatattcaaagttgaaaaaaaattacaaagtattccacatattgtactggggagacacatgacagaaaaagacaacttcttcatgatagaaagaacacaccattagctgaataataataattcatttatacaaagctcctgagtttaaacaaattatattagtctaaagtcagtttcataatcttgcagatcggcctagaattttatgaagtatagtaacaacatgcaatttttaattctttaaagccttaaaatcagctaattgatttcttcaggcaacatcattcataattgagtggaagttgccccacttcacactcttctttttctctcataatcctatatggcttttcagaaggccacacggagtataactacagcatatatggcataccttatacatgtgtaggcaatgtgctgggtaagacatggccatgcatggtttaccttacgagctcagagatatgacttactgtttctactgcctagatgtgaaaagggctcatagacctcgaaagtaacataatcaaatgtaaaacagtatctaattttaaagcccagtggatctggaattacaaggaagcagaaaaatggagacaggatgcagaggtagaattcatattctggaaagcatcatatttcaaacacacccctataattcaaacattttatttgatggaaatcatatgaggctctgagtattgatataccactgctgtgtcaagagttgactagaccatttctgaattaattaaaatataaaagtaaattcccttaaaaatactagttattttaataatgctgggcccattcttgtaacttctgctttctttttaggaactaatggatatatcaatgactaggtatttttaataaatcattggaatgtctacttttttcatgaaatatcgaaagtttttacgataaagactgaaattttgttctcaaatacttagggaaaaatatacctcattacttcgatgacagaactgcttcctagtaattggcatttcttaacatcaaagagatgttaaccacgtgttgaaacatcaaacacacgtataccacctcaaaggaaataaacaatttgtcatggacaaagggtcaataaatataacaaaaaattcttacaagtaatcactgatgcataaaatgctcaaattaacaaagatataaaaattataaaattcaaggctaatcagagtatggcgagatgagtgttctcatatgctataggagtagacattgggacagcctttctggaaagccacctcgcaatgtataacctttgatccagcacatacacagagaaacctatcctaacaaaacacaatcatttgttacagtaaaagatatgcataaaaaattcattgcaaccttataagatcaaaatcagaaagctatttgtccagaacacaaaatgcaacagaatgtttaccactgccctaaaaatatgacataaaatagttaaagaaatacaaatatgcttataaagtactattagggagaatcaaacaaaaaaaattcataaaaacaaaaggaattctataaaagacaattctaaatttgtgcaaagatgctttacatgcatacaggcgtatctcagagacattgcaggtttcgttccacatcaccacaacaaagcaaatgagtcacacaatttttttggtttcccagtgcataaaaaagctattttacactaaactactctattaagtgtgcaatagcattatgtctaagaaaaataatacacagcaggtcctagaataatgttgtttcattcaatgtcatttaattcaacattctttcattataatattgatgagaaaaaacaatgcttccagtcagggcccctgtctgtatggagtctgcactgaaagtgttcagtgttcagtgagtagtgcttgtttgtgattgttttggaattgcatggtgggaggaggcgatactgagaattttcactttgcaaacatttgttcctttattaatctactcccaccactatgacagacatcactcattgattcacctaaaactgggtaaataagtatctcacttgtatttactagtctttcttaaatgtatgcatagcttacaattcaatgttttagaagtattttggtctttatttagaagtttggtgatcttttgtgatgagaaatatgctgtaggaggccgggcacagtggctcacgcctgtaattccagcactttaggaggccaaggcgggtggatcacatgatgtcaggagtttaagaccagcctggccaacatggtgaaaccccatctctactaaaaatacaaaaaaaaaaaatcagccgggactggtggtgcgtgcctgaagtcccagttagtcagcaggctgaggcaggagaattgcttgaacctgggaggcggaggttgcagtgagccaagatcgtacccctgcactccagcctcgttgacaacagagtgaaactcagtctcaaaagaaaaataaaaaaaaaatgctgtaggaatttaactcttctttatatcaattgactcatgataaaactggttttgttatatgacattttgcttaaagtcgtagtttccaagaacctatcaacaatgttaaggaaggacttactgtacataccttaattttaaaatattttattgcaaaaaaaaatgctaacgattgtctatctgggccttcagcaagtcataacctttttgttggtagagggtcttgccctgatttgatggttgctcagttaagggttgactgacattttcttaaaataagacagcaatgatgtctgctccattcactgattcttcctgtctgccccatttattgaatcttcctttcatgaaagatgtctcggtagcattttgtccacattagaacttgtttcacaactggatttgttcttctcaagcctctcaaagccactactttactaagtttgtgtagtattctaaatctgtcattgtcatttccataatgttcatagcatcttcaccaggagtagattccatctcaagaaaccactttttttgctcatccattagaggcaactttccaacaattcaagttttaccacgagattgcagcaattcattcccatcctcaggctccacttctaattctacttctcttgccatttccaccacagctgtagttatttccttcactgaactcttgaaccccgcaaaatgatccatgagggtaggaatcaacttcttccaaactcctgtaaatgtcactattttgacctcctgccattaatcaagaatgctcttaatagcatctagagcagtgaatcatttccagaagcttttcaacttactttgcccaaatccatcaaaggaattactatctttagcagctatagctttatgaaacatttcttaaataataagacttgaaaatcaaaatatcatctcgatccatgggctgaagaatggatactgagttagtaggcatgaaaatagcattactctccatcagagctcttggttgaccagtacattgtcaatagcagtaatattttgaaaagaatctttttttctgagcagtaggtctcaacattgagcttaaaatattcattaaatcatgctgcaaacaggtgtgctgtcatccaggctttgttgttccatttattgagcacagatagaatagatttcacataattcttaagggccctaggattttcggaatggtaggtgagcaatggtttcaaattaaagtcaccagctgcattaaccactaacaagacagtcttgtcatttgaagcttcgaagttaagcactgacttctcctctctagctatgaaagtgccagatgacatctaattgaaagctgctgtttcatctacattgaaaatttgttgtttagtgtagccaccttcatctattatcttagctccatcttctggataacttgctgcagcttcaacatcagcatttgctgcttattatttgtacttttgtgttatgaagatggtttctgttcttaaacttcatgaaccaacctcttctagattcaaacttttcttctgtagcttccttaactctctcagccttcatagaattgaagagagttagggcattgctctggattaggctttggcttaaggaaatgttgtgactggtttgatcttctatccagaccactaaaatgttctcactatcaacagtaaggctattttgctttcttattatttgtgttttcactggagtagcactttaaatgtctttcaagaacttttcctttgcattcacaacttggccaactgttggatgcaagaggcctgcctggcttttgacctatcctgactttggacagtccttccttgctaagcttaatcatttctagctttttatttaaagtgagcattgtgcaattcttcttttcacttaaacacttggaggccaatgtaaggatattaactggtctaatttcaatattgttatgtctcagggaatagggaggcccaaggaaagtgtgagatgggaatggtgtgttgatggaacagtcagaccacacacaacatttatcgattaagttcagcatcttatatgggtgtggcttgaggtgcccaaaacaattacaatagtaacatcaaagatcactgatcactgggtaaaataatatataataataatgaaaaagttcgaaatattgcaagagttaccaaactgtgacacagagacacaaagtacatgctgttggaaaaacaacactgatagacttgtttcacagagggttgccacaaactttcaatttgtaaaaatgctacagctggaaagcacagtaaagctatgtgtgataagatgggggtatgcctgtgtacacacagaaaagaagagtgaaatgaaagtaagacattaataatattcccttctgaatagtatggttaactggtaagttttattttcttcttccttcctttctactacattttacaaaatgtgcactttctttttaatatatccaagagtaaaagtgtaaatgctattttaaagctaatgaaatctattttcatttgccaaacaaaattataagtgatttgctgtatatgcatattcaagctgtcattatacttctttgacattcagaggtttttctaaaaaacattttttataccttacaaaatcaacttagagatttaaaaaaaacaagtttcagcatagttgacatatccatttcactcctcacagttaaaggtatgtccagaataataacctcccgcctccaacccagtgtgtccctcactgcttcgttaattaccttaattatttgtttaacctcttaaagattttttcaatataaaataatatcaagagaactacttaattgagtactcttcctcactttcttccagccctaaccaaccaccccatttccccaaatacacctgtactaaatcaggtatatatcaggaaatacatgggctggttaattcctggtcttcaatttctgtcctttattagtaaagaaaacattctactgctttacacagtgctttgtgccttaaatgagatttctcctagaccgcaataaatatttgctaattttgatttaatttaaagacgagggaggttaatcaagagcaattaatcaagagcacaaactagatgtcataaataaataaatacattttaaaattctccaacaacctttgagttatttctagtctagcaatattcattctgatttggaaaccaaaagtaaaattctatggcccccaaccaactgaatggatccctcctctgggccaagggcattctaaagtaaacctgaaacactagttcaggccgtgatgggaatgggtggttggacatgcctcattataacttcctctctttggaattcaggcacagctgactagcattaacattaatacagcgaccttatgattgacaaaacagactctctctagtaacaagatatcaacatgacagatagcaggccctgaaagaaatgtaagtattttaccccaaaatatatttctttgacatattttgaaatacccctgcaaagctgtctcttctggggaaaatctacattccatagagaatccccttccctttccaggtctttttccctatccaggagagaattaattaagagtctggtacgtttttatgtctgataagaaacatttacaatctattctctctgaagcctgctaactagaggcttcatctgcaataataagaaccttggtctctgcaaccccttatcttaacccagacactcccttcgattgattccaggtctttagatgaactctttcaaccaactgccaatcagaaaatctttgaatcctcctacgacatggaagccacttcaagttgtcccgcctttttggaccaaaccaatgtacatcttacacgtattgatggacgtctattttctccctaaaatgtataaaaccatgctacaccctgatcaccctgggcacatgttatcaggatctcctggggctgtgtcatgggccatggtcactcatatttggcttggaataaatctcttcaaatattacagagtttgactcttttcgttcacagattcatccttggaagccagaatgatatatgttgttccatataattttcagtaaataaggaacaaccctatgtttcaaacattgtaattcctatcattctttcaccagataagcaggggaaaattcaggttatctggcagtgtaaaaattctagatataaagaagtttaaaatgtaatgatttaaaaacaacagtatgtgtgctaaaagaatcacaccatatgtgattaagtcaaattataaagcaccagctttaagtaatgactcagagaaatgagaaaagcaaaacaaaaaggtatagttatgaatgggcttcacattgacttattatgagtaaatcattcctttgacaaagtttatgcttctttcatagataaagaccaggatagttctagagcttaagaatagaaacttgacaactttctactaaccttgatgaataagaaagacaaaaagatattatgtcaacaccaaaagaagggcccccatgcctgtctcaacaaaagttatcagttgcaagccttgttaaataaggttacacaccaactttcctactatatcgaattttagagaatgacagctttcataaaggacaattttgttgctcatctctacaggaattagtaaaatataataaatgagggtatcaactctacatatttcatgctttgaaaagttgcaaacttttatagtaggcatgcctagcttttgcaaaaggaaaaaatgaatttttaaatgtgtttcagttaaatgtaaatgagctaaatgaatgaaagctgcagactcaataaatgtttattgccaggtaagttaaggcactttttttttttttttttgagacagtctcactctgttgcccaggctggagtgcagtggtacaatctcggttcactgcaaccttcgcctcccaggttcaagcaattctcctgcctcagcctccccagtagctgggactacaggcatgtgccaccacatccggctaattttttgcactttcagtagagacaaggtttcaccatgttagccaggatagtctcaatctcctgacctcatgatctgtccaccttggcctcccaaagtgctgggattacaggtgtgagccactgtgcctagccaaggcacttttaagccattttgcacttgtcaccatctgaagttgaaacatgaagaatccaaaaacaaaagcatttcaagttcttttatgatgctcaacagtaaagtatgcaagggctcaagtaatctgacaagcttttattagaatagggttgttgttacctataagacattttatcataaaaatattcaagcatacagaataattgaaaaaagagtaaaataaatacccatatactgacaaccagactcaacagctgttaagatgttaccatatgtgttttatctaaagagatacatttcattaattaatttttggaaccaccttcaagtaaatcatttactccaactatttgattcatttgatgtcaatagtccaaattagaaacatataaaatacactttggtagtacagtcccatgaaacccaaaaatggaatatatccatatcatcgcagtttggtcattgccactactaattaatcctataggattaactcttttaagcttctgtctcctgatcttgaaaaaatcaggaagctaaacttgagaatatccaaagtcaccataggttattaaatgttaccatttcaatacccacaggaaaactctactctcactgccctgtttgatctgcatatgaaactcggaaaaaccataagacacctggacgacagctggccagaagctgccccgtaccctaacccgcaaggatgtggacacatttctagaaatcactccagcttttaaagtaaggatgacatttggcataagtaaactattgaattattaagttgtctaatgaggtactgattctcaaccacatgcaacttcctgaaattttggtttatatgacataatttctccaatctttctctagcttcctatcaagcttactgctcagcttttagaaataagcataataggtcattaggcttccattagaagcaattacttcaaaatagagcaaatgttcccctttctttaccaccacaccgtataaggatcttccacaaagacaggccatgtaatgaagcaatctaggttttgtttcaagaattaatgcaaaacagcactcagtcattatggtcattaattcaggttattcactacctatcaaaatcacactctcaaaaaacatattatgcaaagccacttgagatttaccagaatgtttaattattattgaaattcaagaaagatcttccttcttcaagccttcccagcatctaagattactaatgtatagatttttaaaattatggctgccctaattctggattgaataaagacttcaaaatacttcatttgactagatgctgcagactcaggggctattagtcctgctctgaagacatggacccttttatgtagccccagtttgaatctaagttgtttggaaatagtatgattttactggcagagaatgtacctcaatatggaagctggctgtgtgccccaggaaagaagaaaaatgaactgaccctgcattgcagaaagacctaaggtggttagtattcaacattcttccgcctcagttgagacacacagaagtttgagttagtcactgttttcaaaacgcatttcagcagtgcatggtgagaaactcaaatgtaggtaaatattgtcattgattgttatttgttgtttttattcataggaaatttaatatttcgatttccataatactccagctctgcatagcaaattcataaacattaatacactggtcctataacagctttctaaaatatgtggaatgtaaattattcccactgtctagaagacaaaactgaggactgatatgtcacttgggtattacataagatcaaacaagtaaggaatcaaatctagatcttgtgattccaaattcagcatttttcccattatactttacttgtactgtattctaaataatttctattaaaagtacattactgtgcatattttatagatatgatttacatagcatttaacataagctgccctagatagtactaagaaaactcaaaactatcaaattctctaagataaagtagtaaatttatcacaatgaattagaattatatttccatgacttttacctaatcccatggtttcaaaatcttactgtcaatctaatattaaaaagagaaagtgttcagggttgcctagggctggggcagtgcggtgggaagaaataggaaatgactgctcatgagtgtgagggatttctttttaagaagagacaaaagtgctctaaaattagattatagtgatggctgcacaaccctgtgaacatgccaaaagcactgaattgtacattttaaaagtgacttttacatgaattatatatcaataagactattttgaaaagaaaaaaactaaagtcaaagtatatagaacttctgctttactgtactaatttttaaatctaaggaaaaattgaaatttggtttatttattcaatatttacaaatactgttttgtccacagaactagaaaacaaggtatagtcccaaattcaagagtttacaattcagaaggtcaaaaagaaataaatagctaattatagtaccaggcaaagttaaatacaagttccacaaaaataaatgcacataagatgtagtgaaagatactacagtaatctcctgggagcttaaatatggagtaccagtgggttgtgtgaccttgggcagcacaaaaaaaatatattaaagcactttaagagcaaagctctacatagatgttaaggcactgcttccctatttataaaataaggaaattggtcatttctacaatttccataaactctaatgttctacaaatctataatttaattctagacagactgacttctactgtgaattatttttcatttttgcttgaaatattgtgtaattccctcatcaactaagtcataacataaaagtataacatttttgtcactcccataccaaactgacttacatccaaaagaaggctgtttcctttaaaagaggcattctgaagaattatgtccttattttaaagatacaaatattatgcaatttcttttttagaattcctttttggaaatgctgtctgtgtttgagtatctccaatattcacaaatatttttcctttgaaaatgaactaaattttggaaacagtcaaaaagatctggcatacatagctggcaatcaaaagggcaacttttttattaatataaaaatgtaaatgaatgaactttgtagacatttatgatggacaagtacccaatgttctctgaatacaatcagcatacttttgtgctccatgtctgaggcagaagaatagggtctggagacaggcagcctaaggccaagtcatggctgagttcttggaattgggccaaaaggaaaaccccatctctccatgcccaagtgagaagaggccagagactcccctctttacaaaatccctctaccctagcctacaaatgggaaatgcctctgattggttgcaggccaaagcttaccttcagcctctgattggtcgcaagccaaggcttcacttcagcctatgattggtcacaggccaatccttctttcatatagggtgttgtaaccaattggaggcctctaagggtacctaggggtgtcaccaaatttttttagtttaataaaatccctaaagcaaattgcaatcagggcttttgggccacctgctcaagcccattcccactctgtggagtgtacttttctttcaaaaaatctgtgctttcattgcttcattcttttgttgctttgtttgtgcattttgttcaattctttgttcattgcgccaagaacgtggacagctcccagtcaagactttgcattctggtaacaagtttactcattcagtctattcgcagagttttctgctctactaaaattctatctactcctcaagatccatattagtactaacacttctctgacattttaaattcagattttactgccccttcttctgtgttcaaacaacttctagttttattatactgtatttgttgcatcccattttagaaactacagtgactgggttctcagtatctgaaattcagacagttctgggatagaatatttgatcccacacaggtaaatcattcaacttgactaggtttccgtttatattctataacagggttatgattttcatctaacaacttcataaaatatttttaattggtattgcctattgtctgtgaggatacaagaaatcaggcattcaagctggtagtggttatgtaaacaggtgctaccttgcaagatggaaatccggcaataaatatcaaaagcttttcattggctgggcacggtggctcacacctgtaatcccagcactttaggaggctgaggcagggggatcacgaggtcaagagatcgagactatcatggccaacatggtgaaactccgtctctactaaaaatacaaaaattagctggaagtggtggtgcacgcctgtagtcccagctacttgggagactgaggcaggagaatcacttgaacctgggaggtggaagtagcagtgagctgagattactccactgcactccagcctggtgacagcaagactcttgtctaaaaaataaaaaaaaaaatttaaaaatttaaaaagcttttcattgttctggtccttttggtccagttatgctattctaataacgtaccctggacataatcaggatgcacttaatgatgtataaggatcatagaattatttatcatgagaacattggtaacaacctagttacctaaccatagtgggttccctgaataaattatggtgcagccactcaatagaattttatttacattgttttaaaaaagtcacaatataagacataaaaaaagcattcatgacctacaaagcattcacgatgtgtaaagtgtaaaaggaaggctataaaatcctagaataaagctacagagcaaattgcatttcccgtacttctatattacaaccaccctagcctgcaggatgccagggtaggtgcagctacactctagacttttaaaattctgaacccagagtaaatacacaatcagataatgttttcaactaaaaaagttcccccttttctctacctctttaactcttgcaacatttaccctgaagaaaaaggaaaattcttcattttataaaatttttgagccaagaatcaagaactttttttttccggctataattaatactagatttataccaagaatactaaattcggattttggggggtgagtttagactcaaaactgatggcaccaaaaagcataattcttaaaatgtatactttccagaagtacatttaaaattctcagtatttctttccatcctctactaagcaaccatgtttgtttttcctcctgtatcactcacagtaaagacgacttctttcctttgctttgtttagtttctggcaatggaataggattctttttaatatgaggttttatgtcaatcagcattatatcagtttctttgtgggttaactagatttttaggggccatctcagagcctaatctataatccagaaaaggcttcataaattgaggagcatcctacaggatcttctatcacaagccccactggtcaagggaagttttttcttgcatttcctcaagctgagactcagagaaaataacaaccccagggaaaatttcaaagatttattttctccttcactgttgaaagcaggagtttatggcatcttcgcagtggggtgaccagggtgcatctgaaccccagtgagtcaaagtctgcaggggcatgaatcctttggaaaaattctctgggcgactgtaatgtgaacatccttgttaagatgtaagggttacttcagagataaagataatgaagattatgatgccatcaccacaaccaagagacatgagactgtgctaggcatgtcaggtggatcatctcatttgatccacactcaatcaaggtgggagaataatcctaccaatagtggtaacggtaacaacagtagccaacccacatagcagatatgtgccaggctttgtttttaccattttatcaatattaacttatttaactcctacaacaaccttatgtgtgtgtgtgtgtgtgcatgtgcgtgtgtgtgtgtgtgtgtgtgtgtgtgtgtgtagattgagagagagagagagactaattccaaccctatcttctgaaaagggaactgaaacacagagatgtggaaggatttgccaaggttacataactggtaagtggcaaagccagaactgtttgaatttagtctcacgctagactcgtgtgaacgactaaaattcctcagaacaacatatttgtacttccttgtttcccatggaaaatgcaacactgcattttacatttatgctgcttagcacatatctctgatgcatgacagccattcaatacatgttctttgaattaaattttttaaaaatatatacatatttcttattttaaacaactcagtctgttaagttagttgactcctttcagtttctttcttagggagctattatgtccttttaaatataatgataaaaaactacatgtgggtatggagaactgggttcaatgaacacataatttaacgtttgtactgttaagaatcaaaccaaattaagttataaatcaaaaaccagaaccaactattttaatatggatggaaatgacccaatccatctttcttatcaaagtgcaaaatgaactcatttttaaaaatctttatttccttaacattatatagccaatacttgaacatcgaacatcgaaatagttttgaaaagaatatatttccttacttttaaacttctaggaaaacaagtacatagccacctgctcaaaactgtcaggaactttggaaggccgaggcaggcagattgcttgagctcaggagtttgagaccagccggcgcaacatagtgaggccctgtctccacaaaaaaaatacaaaaaaattagcccggtgtggtggcatgcacagtagctgtgatcccagctactcgagaggctgaggcgggaggatagcttgagcccaggaggtcaaggctgcagtgagccatgatagcaccactgtactccagcctgtgtgacagagaccctgtctcaaaaaaagaaaaaaaaaaagctgtcagcaataaaacatccattatagactatctctgtttccttatgtccaaaatgaaatggttgaatcagatgatttccaacatctcctcattctccagaattccatgttttaaaggaacatggaatgttctcatgctccagctcatgttttaaaggagactgcaggtgaaatttctttagacaaggaaatgcatatggaaataattcagaacaaaacaatatctattacttagttaatgtaatctctctttctatatcttctatactgagtgacccattttatcccaatataattccaaaaattctctatctaaaattacaggtagagagacactggctattgaagcagaaaatctatgttgaacacaagctgcaccgcatactagctgagcaactaactactggcatgttccttcacttgctgacttgcaaaacaaatttctttcctatctatctcttaaggacacaagataatataatattgttaatattacatttattaatgatgtaatatatgagaaaacacattgtaaactctaaaatactaaaaatgtaaggaaactgtactagcagtatcaagatattttcccatcataacagctaacagttattctattgttgtagtcagccatttttctctcaattctgttaaaataaaaacaaaatagttgtctattgtgcaaacagttcaacatcttcttccatttgatgtttttccaaaattcttgcttaactttatgaagccatactttcacataagcctattatttattaagcactaaaaggcactgtctgcttttataagtgagctttgttataaattaatctttttagagttccacagaactgaacaaactagaagatgaaaaatgaaaagcaaccctctgatgcacttcacatcctttccaatttcaattatttggactcatttacctcgcccagaaatgaataagctttgtgaaactgagaaagctaccaaggcataacattttctacattcttttatctctatggtaggaactctactaattacttattttagagaactaaaaataaactaccaaatatactaagagaagttggtagtgatcacagttaagagtaagaggaaggagctatgtctgcacatttaaaatctagcagtacctacagctaggaaatttccacttgaaatttaataaactttgcctctaggaaaacacaaatcatcaaccctttaagttacaattatcaaataatactctacaaataaaagagaccttttatccgtatccttaatactacttcaactccatctcagaaggaccttctatttgttccggatttgtactagtattacacttctagacatacaccaatgataatgatatcttggctataaaagaattttaaaatgctaccttatagaatgtattagttattctttaagtgagtgacaaagcattgcatcagatctaattatactgtttttagctaattatattgactttatccaagtcattgatagcatgagttttctgattaagaaaatgttagttaattggataactttttaaaaacataattttgacaacacatatcaacttggggaactacagcaaaacagaggtccaagagctttctaaaatggcacttgtgctcttggaagccacaggaatcatgtctgatagtggcaggcaggggtgcaggtgttttctccttgatcccgtctcacttttgtctgtaatcttgacctgactaggaagtgcagaaacaaacgcagagtagagaaagtagtctgtgtgggtatccatacagctcccaggaaacacacctacagcatccatagagagggttagatggaggcaaacccatctacatacgccatttttctccattaaacctcaaccttcacacagtttctgtactaatctaaccaagactttctcatgaagccaagaagagacaactcatatgatcaagtgggaattctaacttgcagactagagggtcatgactctgagctccatggttcaaacaatctatgtatgagttggttattgagagaaactgagggaatccaagagttgaccttaaaatacacacatctcaacaatcagatcatgttaaagtaaatctccattgccctggatcacttcaggatttaattgtccaaggagagcagggttctcctgtgaaaaaaaggtggggaaatgtttgagagtaaaaaatacaaaattcaaccggtcgaaaatacaccactccattcagtgtcttctaaaaaaccacatactcaaccttaactacctctaaatacagggagctgtacatgtagatgaaaaataatatgtgaccttacttcatcagtgaacataaaaacctgctgagagattaatgtgccttcatgttcattatctatttactcattagcactacaagcaactacatagttctgtgttgtccacgtccacacatgaaaacacacacacacagccacaaagcaagccttttgtagacatcactggtcaatcgtgacttcccaggtggaatcttctggtctcttctatttttcacagaatattcagaagtagttgctttaataccacagaagacacagtattccggggaagactttgagatcagcaccacactgaaagctcaagccccctagaaggccaggctaagaatagccatagtttcactctgtatgtaaatgactagtcaccaaaatcgtgttgtgtataccacatagagaaaaagaatcaactgtggtacaaaaaggcaacagtagaaagtaagaacaaaattatacactactaatatttaatacatgatttcaccatggcatatatgtataatttttaaatgaatacacatctatatacagctagatgtttaaaagatttttgctgaagaaatatgatcagaatagtttggggggtgactaaaaccacttaaactaaaatgatttacatatacattcaagcaaatagaagttatatcacttaaatcaacattttctaaaatgcttgagtcacgaaggagtcaatttacagcactaaatatttttaaatttttctcatttttctataatgttcatatcccaatctactttacaggaaactgctttttaccatgccctcaattgctaaatattttacagaaattggcactaagaaaaaaataaggaggacttacaaaaatctcttctgatttaacattaacacaaataacccagttctaatctaaagacttcatgatataaaacaccccaaagtaatcacgtaacaataaaaacaaattaaattcaatattatttttcaaatcatttacatcagctttttttctactgtgctctactaaaagaaaaattattttataggcatgaaaattttaaagaaactaagcaaacaaaaccatatctgagaaaattagcatccagtgtagggtgattttaggtcatcagggcaatttcaatgctgctaattatatctccaagtaagcagcacttacgtttttgcttcctgctcaaattttattggatgtataaccgagaagaaatatttttaaaggcaaaaaatacacgtgaatgtgtaaatagattgtgggaggggagtatattttaactctgagagctgtgacatgccttttttcattcctcccttctctttgaaacatacaagaaaacccacaaaatgagaatattctacacaagtatctactcgtgtaacacacacactatcttctgacaaacaagagaagtatgaaaataagcagaaaagacgagctgccacagagggaaaagtctaacaaaagactaaacaaataatacataaaaagaatgatcctcaagaggaatttaaaagaagataaaaatattcagacactgaatttcaaaatgccaatatgaattttaaatagtcaaatttccctcagattatgccacattttattctcattcattttggtctctacatgtatttacaatagactgtttctgtatttttatggagatacacaaacttaaagcatttttttctaagaaactaaatttagagaatgtgggaggaataaggagaaagtcaagacagcatttacaatttaatgggaagggaatttacagtgtcttaaagcaaataaatgtcaaacccatttaaacttttaggtatgacacatggactattgataattaaaatacaattaagtatttttggttggtatagctacctctatcaatatttgagatggcaactgttaatatttaagtctacaactaaattttcatttcattacattaatatagctcaataacttagatcagttttcaaaatataaccacacaaataaaatttatctgttactagtttatttatttcatagtaattgtgccgcttcctaatctggatttccagttctttaggcaaaatctcctatgtcactgccttatactgacacctgctgcaatgtactggaattgtacatttctcattgcgttaatcaggcagttgttaattttgcatatgggaaagaatacgtggaagatagtatttcaacagcaaataatgtaaattttaattctctaaatgaaataagtaacatttattctaaacatttaaattttcatggtatctttaggaaattataaatcaagaagtcttcccaaaaagcacttctgatggtaatttatccaatgacttcagtgacttaacttgtgcctatttgcggtagaattagcaaactaattagcaactttctccaatacttgacttctgctgtttcatcttttgcactaacttaataccttcgactttagaaaaatatttggttttgtgaaagtacacacacaaacggatcaggaaaatgaccctgctcttaaaaaaaagaaagctttatacattcatactggtagttaaaaaaattaaatagcatgaattagtgaatgagcttttcttatctattatcaaaattgccttttcatgaaaaacataaatgttttaccagaataaacttatccactgaagtagagcaaaacacaacacattgaaataactaggtttacaaatctttgtaactgaattaattaagctccattaagttttaattaacttcttatgcaaataaaactcttgtaagtatttctgaaaagaataccccactacctgaatctgtctcccaaaacttccggaaaaaaaaaaagtttccagacagcaatatatctaattggccaaattgtaagaaattacagtgtgatataataaagttaatggaatactgcttcccacctcaatctgctgccatataagcatcatctagatgcctggacatgccatactgtatatcatcagaaaaataatattttcttagaggcagttgttttgatcacaaatgagtttgggcagctaacagagcaacaagatacattcttgagaacggtactaaaaatatgataggaaggaggaatatagtactgcggtagtgtaaaaattgctattataactctctccttttatatcaaaacactctaattttgacaaaagtaatgacatagtatcaacatagtttgaataaaacaaaactatgatcaaacatataacagctgacttaaaaaaatacagcagctgattgaatggtttatgttcgggatgacgtagtattagaaatttgcaactgtcaaacaagttgtctccagtaagtctacttaattcatccatccaagtgaaattaaattcttcaagtgtaactataatatatggagatttaagaatataggggatgttttatgatgaaattcagtctgatcatttttttaaaatgtcttttaattgttttaattgaaaaagcaattagctataaaacaatggaacattttttaaaaatctactgaaagattatttggcactcttcttttaattttactaaaatttacataagattaatgtgccattcactattaagatactgcaaagtaccagagaggtaacaggtcttaatgaatgtagtagttttgcatcatattttctccaaacatttcactagcccatctcagaagacaagattgtgtcaattgcaaaagaaactatgtactaaaactaaaacctgttttagatttttaaacaaaatgtaattatgcaattcactttaacagctttcacaatcagttactaagaaagggaatctttccttgataagaacctgaaagattagtttttagagcctgagaaacagtagaactgtcagacacccgagatccttattttcaatcactcagttaccttacagagcttctgataccgaggagaagaaactgccatcctttgtaagcgatgcaacaaaaccacaactttctgcagagacgttctcaccacagccatcattttaagtttaccacacttctggagacacctcagaatttgcattataaatgaagagcaacgatcatttcctcccggtcactggacaatgatttgtcagttctctgagcatgctcgtttccaggaaagcatttgaaagatacagggggttaggttctaggaaaaaggaggctggtattccttcaacttctcaatttaaaaaacacagacaaacgccacagagaaagccccccagcagatgctcacaggcagcacttgctcagcccggcatggccagaaatgaaggaagttgtcgagcagccaagcgctgccggctgcgggagaggagtgcgctcagtagccaaagaggatattaagtgaaacattaaagctgcagatagaaagcggacatcccctgggaacagggattcaacatatcactgccaccaccacggtgcatgccctgtagctggtttctattaagagagaacagagcattcaccgtctctaaagagggatatgttcactacccaataaatgcagctctagctgtgctctgtgaattagtgaacaggagaccctgttataaatcttgagaagagcagaagggtacacctgactctgatgacaacagcccatacattaagtgctaaaaaatcacccccagacagatctcagcccaaaatcacctaaaacaaaacaaaacaacaaaaataaagcaaaacaaaaaatacttgcaggggttatatgactaagacaccctaaaagcagagcgatccagtggattctcatctgcctgcctagaaggaaagccattagaaatggaataggttaggatttgtctaattaaacagctaagtgaataaaaaattaaaagtctgtaattgactactgaacattccaaattgccacatttccccttagacagcatcttcatgatctcattgtatttgccataaagctgttttaattttatgaataggaaatatgaggccataattatatcatataaaaatccagtacataattttggggttctatgtgtatatatatacacacacttgagacatattctctactgcagcctgaacatcattgcaaatatcaactggggtaaagtactatcaggagatgtgcaaaataaccctggatgattaaatgactgggtcaaagagcacagccagaaatagaacccagatgttgctcattatcagtgtcctgctcaaactggtaaccgggctaatgctgcaatttcacctctgtctaatgttgtcatgattctttaaaagaaatgcagtattttcaagtatttgtttttcctcctttacttcatttgcctttcttagtccttcatgttacaacgatttaaagtcctatattgtgtcttacagaacggtgtttatcaagcagtgctttgccgactttattgggtcttatagaactgtgttcatcaggcagtgttctgtggacttctgcctgtatcttttttccctgcaggtccatactgagaatctacactgcctccctctggtgaggctaacaatgtcaccatatctgtgtaaagccaaaagtggagaacatattcaaaggatagagtataaaatgttaaggtatttggcaaatagatagaaatagattagtgattgttcagaggggagggaattggcggggaggaatgggaaattgctagtaaagggaaggggtttctttctgaggtaatgaaaatgttctaacttgattgtggtgatggtcgtacaatcgtgaatagactagaaacaaatgaattgtaaaatttaaatgaatgaactgtacagtatgtgaattatatgccaagaaagttgttattaaataagtatgaagctataattcctgtcctagaaccagcagatgaagtccccatgagataggcattcacccctcaaacacagtgctaagcatgcagctgggcacaggagaaaatctaaaacaatctataatcaaagtctgcatctatggaacaagacgatgaaaatgaggctaaaagcaaacataggagataaaagtgtaataatcctaaaacgtaaattattagagagcaaaaccagccacccatgacaacaccactccagaaaggcagcagaactcaggattttacccagcaaagaatcagagcatttcaattaattggtaatgccaaatgtaaagctgaaatttttaaatataattaaaagaataacaatcttttagaatatgaacatgcacattaagaataaatgcacttgaactaataaactagttggaagtcaataatgggctttcatacaaaagcaaaaaataaagtttctgcatctttggccaaatactcttatctgaatatagattcacagtgacaactgcataccaggcaattcctcctggatgttactccaatgcttcatttcaacaaagtcaaaacagatgaaatttgccatccccacacatttcccgctaacttgcaaccctgctctgacattttcttctatgttcccagtcttaggctctaacaccacttggcaatctgcctttccccttcctcagtctatgtatactattgagtcattagatctactacccctgccattgtctcctttctggtaattattacctgtagcctggatggctacatgagtatcctaacaggcctctcttctgtcactcttgtctagttcaagtccattcctcataccatcagctaaattcctataaagcaaaaatcccattgcatcactcttgttactatcctttatgacttctcttcattgccactggattaaaatataaatacttgcatggcatttaagaccctctatgagctggactgctcagttctcaaggagcttgtctctcctgcagggctccaaagaatcggcttttctcttgccaaaaggcttctgctggggaataaatcctaacagccttgcagcagggcaatgaaacatagatacataaatccaaatcatcatccatccttaaaagaatggcatgtatcatagcatactcccaaaagttaatcatcttccatgtgctttagacctatccttatcaaaattcacccaagattcaccttaaactgagcatagaataaactgctttatcttcctgaaatactcccatggccttggatctggttgtcataagacatgaagcaagtataaacagcgaatgtgtcagctaagtagttctacatacacatcctgtgcatgcagcaaagatacacggagctccttattccatcttccttagtgcacaaagactgtgcaccaccagcaccaccaccaccactgccaccaccatgccaccagaacttttctgttatgatttgccatgcttctgtacagtcattttctccaacaaacgtctctccatttccaaacaagtttctattttaaatgtctgtttactcatacaaaaggagaatcattaatatacaacaccataaaaaaattaaaattctcttgcctcagaaaaactcagtaaaaggtactaaatctctaacaatcttctatctataaggtgctgaaaataaaaccatggaacttttttaaaaatagaatggagagaacactttaaaattaagagcatttaataacaaagcaagggagtgaaaaatcatgcgaattaccgtaatgtgaaacattctaaacataaatgtacatatttatctttaaacaaaggaattttagtggactcttagtaaatgtcctctttattactttctaccagccaaaagagactatttttagcaacactaaagtaataatgtattatattttataaagcattataatgtattttaatatttttatcagcaccctttcttgatgctgtttgccataagtaatcctgtgcttagatatttttattttgaaagattttaaacatttctatttacatttgtcttccactgtttgaatattcattaaatattgagaagagtcttagctatggtaagaatatatcctaagataaaatatgtcagaagacatcattaaactctagaataggcctgtgttttgctggtgctcattaccagggttcatttaaagcctcctttattcattgtgtataaactgttacctactcaagtgcacagcctagatagctactgaaattaaaccattgcataagttaactaactgtgagcatttataggtcaggctttttcttgtttaaatcataaaaaaataaataatctagcatctatccacacttagagtcctctatgacctcctaaaatacagatgatggctaaatattttatcaattaacatttatagtgacctcatgaggctcaaaagagtgagtcaaaggaacagatttaattttgatacttgcctggtcacactcattaccaagtcacaaaatgtattgcgcaatgaataagatagaagcagcaatgtatttaaacagaaattttcaacaaatgaatcttaagaactcaacagtaaaacaccatgagttttcatgcacagggacaatttataaataagctcattccaaaaagatctgtttttcaaattgtgtaacttttcagtgaaaataatttcaaacttaaagaacaattgtaagaatcagagtagttcaaagaaagactctgtatccttcatccagatccacacatttgttgacattttacaaaatggtctttttcatgttttcagagaaaagagttcctaagaacggatttaaaaaaggtttcaatgctgagtttcataacggtgagtcaaggtccaaggacagcagtcagtattcacttaggatttgcacacagggcactgcgtaggcaacaatacagataatataatctctgcccttgaagaaccatgtgaccaactgggacaagcagagacatgtatcaaaagacaatggaggccaggcacggtggctcaggcctgtaatcccagcacttcgggagaccgaggcaggtggatcacttaaagtcaagagtttgagaccagcctggccaacatggtgaaaccccatctctactaaaaatacaaaaactagccaggcatggtggagcacacctgtaatcccagctactcaggtggctgagggatgagaatcacttgaacccaggaggcagaggttgtagcaagctgagattgcaccactacactccagcctgggcaacaaaacaacaacaacaaaagacaatggaacacgtgttcacaggtacatcagaaataatagttgtcaaactgatgtgagcatggcatggtataaagtaatcagatgtaatactatggttgacaaggagacttccccattgaaataggtttttgttttgtttctttgggagtggacagagtctcgttctgccacctagaatgaagtgtagtagtgcgatcttggctgactgcaacctccacctcctgggttcaagtaattctcatgcttcagcctcccaagtagctgggactacaggtgcgcaccaccacgcccgactaatttttgtatttttagtagagatggggtttcaccatgttggccaggctggtctcaaactcctgacctcaggtgacctacgcaccttggcctcccaaagtgctgggattacaggcgtgaggcaccacactccgcatgaatcagattttgaactggaaggttcaagagtactgaagcagaactacttgagggcaaaaaaagattcagacgtatttcataagattccttataatgtttataaatgaaaagttttatattagcacattttgtgtagaagaaatatttgaacctcagactacatatacaatcacagttatcaagctaatgacataaaagtaatatcatcaagcctaatattcttagttataaactaagccatagagcttttgcagcttttatattaagtatgtataataaatggagaaagaaacaacttcacattaagggaaaatgcccttataatttaggattcaataaagctaaccataatagggcttaaaatgacaaaaagcagaatagctgtgagcctctaactctaaataaacaattattacttccataaaacaaggtgggttttttcccctctaacattaagtaaaaatatctaatagagcttatttcaagaaacctattattcacaggagagcacggatttcataagagaataaagtgacaacttcaccttttaagggtaacacatttgcatgcagagggatcaaaagcacacagggcaaacacaggtactggtgtggtttcccatgcacttacctgcatctgctgtttgagttccctggccaagatactatcctgaagagcattctcccgatgagaggcatccacaagcacattcactgtggtctctgcttcttggatccacttcaggaagttttccagatctctgcgagaggcctgcaccgtcctccactcagcctccaaggcgttctgtctgtcagcaatactgaaagtaacaatatgacagcacggctccattacttacagtgttgtgacattccacatcacgcatcccctaaataaaaaactaacaggcagcccccaaaggaccttttattcaagtcaccataggtaactgggagatttatctgtatgtgtgtcttgaataatccttagtggagggatcatgtgaattctgagaagagtgaaagggggagagccataaaaatattaaaatcacatccatatcataaaataattataactacattttacagctcataattgtaagttaaattattcccccatatgttgtaggtcaatacaaaaggcaattctattcattcagtcactgaatcctaccactcctttaaggattaaatattcatacagtcagcgactatacgaatatttgttgatactgcctttatgtaagtcaatacaattaccttttgtgttgacttacataaagacagtatcaacaaatactcctacagtcagtggctaaatgaattctaggaagaaataatatctgaagaaatatttaagacaaaataaaaataattgaagcagctgattttatatattttaaacaattcatatatatacaagttggtttcttatttagtaatatttagaatgcattggacaaatgagcttctataaacccttcattaaatctacatcaaaattagaacacagagctatcttggagttatatgagttaagagatacacacacctgtaaattcaacatttaaaactttatattcttcagagctctataataagaaaacaactcaattttaaaaattagtatcgataatttcactcctaggtatttaaatccaagagaactggaaatatttccacagaaaaacttgtacacaaatgtttgtagcagcattatctataatggccaactagtagaatcaacctaaattgagacagaaattaataaacaaaatacactatatttatacatagactattattcacccataaaaaggaatgaagtactgacacgtgttacaatatggatgaactttgaaaacactatgttaagtgaaagaagttaaacacaaagggccagatatggtgaaattccatttatacaaaatttccaaaataggtaaattcatatatatagagaaagtagattaggtgttgcctaggattgcatggtggaggacaatggaggctgactactaatggtatggggtttctttggaggatgataaattttctgaaattaagagtagtgatggttgcccaacatggtgaatatactaaaaatcctgatgaattttgtgatacagcagtccctcctgatctgtaggggatacatttcaacatccccagtgaatgtctgaaaccccagatagtgccaaaccttatatataccatgttttttcccatgcatcatacctatttttacaatataaattaggcacagtaagacattgatgataataactaataataaaatagaacaatcataacaatatactgtgtaaaacttccgtcaatgtgatctctctctttctcaagatttctttttgtatataccacaggtaactgaaaccacagcaagcaaaaccacagataaggggggactactgtatacaaattgtatcacagtaaaaatcagcatatctaatagactttatttacacgtattttttctctctgtccatccattcatccatccatccgtccttctatctgtatatatacatagagggagaaatgtctggaatattaacttaatattcaaacagttatttttgggtgctgggatttaagttggtttactttcctatttgtactttttggcattttttttattttataatgatgcagtatctttttttaacatatcattttaaaaaatgggcaaaagatttaaacctatacgttaccatagaagatgtttagatgacaaataaacaaatgaaaatatgctcagcacattaatcattagagaaatgtaaattcaaaccacaatgagacattacttcatgttaaaacggctttaagaaaatgactataccaagggttggcaggaatgtggagtaactgcaactctcatacattgcaggtaaaagtacagccattttgaaaaacagctggcagttttttgtaaagttaaccatgcattagtgatacaactcagcaatcttacccctagatatttatccaagagaaacaaaaacatatgtctaggtggggcacagtggctcatgcctgtagtctcagcactttgggaggccaaggcaggcagattacttgaggtcaggagttcaggaccagcctggacaacatagtgaaattccttctccactaaaaatacaaaaattagctgggcatggtggggcatgcctgtaatcccagctactcaggaggctgaggcagtaagaattgcttgaattcaggaggcagaggttgcagtgagccaagattgtgccactgcaccccagtctgggtgacagagtgaaactgtctcaaaaacaaacaaacaacaacaaaaaaaaccaccatatgtctacataaaatctgtatgccagtgtatatagcagccttattggtaatggccaaaaactgaatacaacccaaataccaactggtattacatacggataaagaaagtttggtacagggatacaatggaatactattccacaataaatataagcaaactactgatacatgcaacaacatgcatggaatctcacatgcattctgctaagtcaaagaaaccagacactaaagactacatactaacattctgtttatatgacattcttgaatgtcatcaacctcatcctagcacttacttcttaacctgcagaatcagttcaaatttcctcgcctggaatttaatttcctccataattgatcccagtttacttctcaaactttatcccctagttttcttcaatactctgtttaggtaatagtggtgtgctcctttttctctagaatattcttaatattgtgtccacacgaaaatgttatatccacataaaaatgtcttgctgaccctctccatttatcacaatcctaccacaatcctacgactcctttaagggttaaggactacctcttccagaatattccatcccagttcagtatccttgttatgagttcgtaaaaggtcaataatcctcttcaaacaatgattaatcacatgaatcctggaaaaaggccttgaatgatgatcttgtttcattcttaaattgtattttaactacattatatagttttcgtatctttccacccattctataaactgcatttcagcagaactttttataccttcatattcctgagtcctatttatacaagtatttaccaaatgacaatctttccataatattcctttattttattttattttattttattctagagatggagtcttgctctgtcaccaaggctggagtgcagtggtgtgatctcagctcactgtaacctctacctcccaagttcaagtaattctcctgcctcagcctcccaagtagttgggattattggcgcctgccactacacctggctaatttttgtatttttttaatagagacaggatttcaccatgttgactaggctggtctcaaactcttgacctcaggtgatcggcccgcctcggcctcccaaagtgctggaactacagggatgtgccaccacacccagcaaatttttgtattttttttttttagtagagatagggtttcaccatgttggccaggctggtcttgaactcccaacttcaagtgatctgcctgcctcagcctccaaaagtactggcattacaggctgagccactgtgcccggccatgctatgtctttaaaattagctcctacggttaaacaatttacaagaaaaaatcaaactaccaaatcaaaaagtaggcgaaggatatcaacagacatttctcaaaggaagacatttatgcggccaacaaacagatgaaaaaaagctcaaaaccacaatgagataccatctcacaccagttagaatggcaattactaaaaagtcgggataaaacagatgctggagaggatgtggagaaataggaatgcttttacactgttggtgggagtgtaaattagttcaactattgtgaagacagtgtggtgattcctcaaggatctagaaccagaaataccatttgacccagcaatcccattactgggtatatatgcaaaagattataaatcattctactataaagacacatgcacatgtatgtttactgtagcactatttacaatagcaaagactgggaaccaacccaaatgcccatcaatgatagactggataaagaaaatgtggcacatatacaacatggaatactatgcagccataaaaaagaatgagttcatgtcctttgcagggacatggatgaagctggaaaccatcattctcagcaaactaacacaggaacataaaaccaaacactgcatgttctcacttataagtgggagttgaacaatgagaacacatggacacagggagggaaacatcacacaccggggcctgtcagggggtggggggcaagggaagggagagcattaggacaaatgcctaatgcatgcggggcttaaaacctagatgacaggttgataggtgcagcaaaccaccacgcacatgtatacctatgtaacaaacctgcacattctgcacatgtatcccagaacttaaagtaaaaatttttttaaaaaaactaaaaataataattgagctaattataaaaaataactcctacataccatttttcaagaagctcctagatatcccccacagaactcagtttgcaaatcaagaaggaggaagatatgagaagcataaaaaagagatccagcccaggaagaagcaaaggggctctcctgttaatggtgagaggagatcacagaaaagagggtctgaatccaaactggagcaggtatgggctgtcttcagcgttgccaccactctgtattcctgttttaacgtgacaaaacttacaaaggatacactcagacaaaatgaggaaatcgccccaagaagaaaacaaataaaccaaaccaaaacaaacaaacaaaaaaggcaaaaacaaacgaataacacaaaacttccatgagatccaagcaacagggattctaaactaggagcaaagcaaatacccagcatgatggctgtgcagcaggcctagaaagcatgtctccagaagagaggtcaccaaggaccaaggaacaatattagaagtgatagcctgctgaatgtgactggctttgtggaaaattgtactgtcaggtcactggaaaatgtgggagggattagcaataggtgcaaagaaaactaggcatataaaaataaggcaattattaatttcaggtaaaacaaacacataggaaacaaaattacagtaaacctcagtttttagctggtaataatgtttggacaagcaaaataatgtcaacactgtatatgtatttacctaaaattcaatggcgaagcagggaaaagaacagtagcatccctaagcaacttcctatgtatttaccaaaataggatatcagcagacaatttctaatactaaagaattgaaagatgatggcatacccattttatttagaatatggaaatgtaaaaatgatagaagaaggtaaggagaatagttgcctctaggaaggggactgcagtgagtcgagggaaaagaactatattctgttataaacctttcagtgcttagtggttgttggtttttttgtaatcataggtgaattttaatttttaaaatttagaagttacccactagaatttgagtagttgttgttggtggtgttttatccttccccaaaccctgcccatattttccatttttaaaacatcaacagaaaaaacattaagaatagccaaatgaaggctgtgctaaaaaggcactagaaaacaaagattaaaggagtgcacatatgcaatcaatccactacacacaggtgattctcctttaagaacattcaatatataaaatttagtcattaaaaaatttagtaaggtcaaacaccttcatttcccataatcagaattcttttttattatttaagaatattcatatgcacataataggttatatggcaacagctaatgtaaaaagagatcattacagattaattctattaaaccctgagaatgtccaaactagggaaaaggatgcaaatgtccaagaaacctaagtgtaaaggcagatgattcttcttatatgacagatatttaaatacctagcaagtataaaggacaaggctacgaggggaggtagacaacctacggtcatacttcaaaggaaaagtgagctaagggaccatgagcacttggcctcagacagtattccactgggtaaagtaacttcagcagcacactttggtgaccagtggaacattctcaatccagaagctagaccacccattgacaaattatctactgatcatcagtgagaaaagagatactactttaaaaaatattcactttgtatgaaactttcagaaaaacaaattttagttgttttgtaagagatgtctactttgttggttatataagtaaaaaaatatggattttggattaaggtagacaaagctccattgctcactagccatgagcgcttgggcaaggattgtcttcatcatccctaaactttgcctgatacacaggttttccatcatctgactctggctcacctccccaggaggcatctccccacttcacacttcatatgttatttatctataaaaatgaaccaattattaatcctctgagtggtcactgcctctgtcgcatccagacctctacattttacttttttttaccttaaatatcctcctgctcctttcctccagcctccactaattttctccatcccacctagttaacttctactgaccatccagacctgggtgcaaacactttccaaaaccatggtaccttccccaaggcatcccatagtttcccctaccatggctattggtgtttcattgctgctatcataaataaccacaaactttgtggtaaaaaacaacacaagtttattatcttacagttttgtcagtgatcaacacgggtctccactagactaaaatcaagttatcagcagggctgcatttatttctggagggtctaggggtgaatctggttcctcttcttttccaacttctagaggttgccacattgcttgactcatagccacttcttccaccttcaaatccagcaacagcaggtaaagtcgtcaaatcacatctctctgaaccactcttctgccacctcctccacctttaaggactcctgggatgaaatggggctcacccagaaaatccagaataatcactttgggggacacttttctgccttcctcattgtatctctgatcatgacagtaagcaattgttttcttgcctgtttaaagctgttgctcatcagtgcacccaataggaccaggacctacatacagtagaaactcaacaagtatttattgaataaacttatacagcaataggaataacatctccatattgcagcaatatttgaaggaggaaatgagatatacacatataaatgtatcaagatatagtgaatactcagtaaatattttccctaacctcatgtatgaatttggtgaaatactaggcaattaattttgcttattgcatgcaaatgtgaaatttaatgataagtgtcctggaatttttttttaatgcatatatagctggtatcaaatttttatcataaacttaactactaaacataatgactatactaaaagtcaaaccctacttatagcagtgcaaattgtcttcatattattataatgaatgtatgtgtttaagtttaaaatcatagcttatacatgttattttatattctgatttttgaaattaatataatttatataaaatttctaatagactatagcttagttgtttcctccacctccagtttattttttcttacttttaaaaattagaccctaggctagagtatggtatactcaatattacaagattttttatccattctcaaggaactccacatgatttatcataatatcataagtcaataaaatcactgaaattagagtctcaggaacacgtattcatactttattacacaggtgaatataccacctttaatgccatttgtgtacactgctctcaaaagacaatgacctaattctatcacctccaccatttactagctgtatggcttggggtaaatcatttcaaatctccaatttatttttttcatccttaaaataaggggcttgtactggatcagtaaattacccatttcaaaatctccagagatccttttaaaactacataatccatcacaggaatcacaaaacctactagaagtgttcctccactctcacctccatccctagtttcaaattcagcttcattaagaattgctgcatgtaaacgaaagatgactggcgggaatagatgagtagtgtgccgatcgcaaaaaaggttgggaagcattaatgtggaagagttctaagatcgcatccagcactgaacttgcattcgtctatgattctcaatgtagatttcatatttggcagttctgactgctacgtctcaagaaagatcagaacacagctagaggacgtattgagaaaaataacgagataatacaagggaaggaatgctgttacaggaaaagaaatgattttaagcttaggaatttgtggctagaagacaaaggcaaagaaatttttttctaaatcttttgttaaatctacaaatcacaaagaacacagactaaaaacctaaagatacaacattttaagtttagaagggtaacattagcagaaataatttttttttttacttcaaacagaagaagcaacagactataaaagtctttactgcaagaaatgacaccaagtaaaaatataaatagcttcccaaaaaagatttaaggacatccacgggtgacagatttataacactttacagtaaagggaagtaggattttttttaaatgtaaacgcttagcttttaaaagatatttttgtaataaaagcagctatgacaccctatagcctataatcattttgtaacacaataaaacatgacatacttgcctttttaaaatgttattttaaagatgttaaataatacttgatattttaagctacaagatatattatttaatcaattgtgcatttacttataattggtcaaaagagtatttgaacatgaatagatatgtctctctttttaaagagtttaatgaaaagagcatctcaggaaacccatcaatgtgtgttgccaaattttggtgtgctcaaaaggtgacctttacattaatataatatttaaatacatttatctcttttagaatgaaaaacagcagcatcagtagtttgagtggcaggtagaaaacttacaatgaaacaataccttaaacttttcagtgagcaccttcacaaggtaattttgttcttttaaataatattcacctgggaaatacattaaagcatgctgtggggaaaaatgcagttgaaagaagagtcagtcttcatttcacaatcccctgctgctaccccatgatccctgcccacagccttgtgaacccaaaggagcatctctcttggggctgtgattgtcaggaaataaatagtcaagaccacagagccatttctttgagaggatttccctcaccacatcctatttcccctttagctaagtcactaccagatatttggtcttcattagtcaaccaatattgaatcataactccaataccttccccagtctgctccaacacactccccaacccttcttccaccatgctctagagctcctcttctaggatcagcagactctgctgtaccttccatctccccaggccaatccctttttgtcttcactgaaaccagtttccatagggccattatttctcctgcaaactttttgttttttccagagtctggttctgtcgccaaggctggagtgcagtggtgtgatcacagctcactgcaatctccacctcctaggctcaatcgaacctaccacctcagcctccctagtagctgggaccacaggcatgtgtcaccacacccagctgatttttgtattttttgtagagatgaggttttgccatatttcccaggctagtctggaactcctggactcaagcgattcacctgcctcagcctcccaaagtgctggattacagacatgagctactgcatggggttccctgcaaacttttcatgaagtcttttcctttttctctcagatcctttatgcctcagtttgagaagctggaataagggtcctccctgctccccactgctacctccaggttattgttcacccatcttccaggcaaaatcccactgtagaaagcacaacacatgtatccactctgttcctatactgagcttcaggttcaggggcactgtatatagaggttgaccactgcctcaatgaggaagtgaagtttgaaatccaacttaaggtctgtttgccaagccatagctctagtgaggaatgacaccacccagagaaagggacacattagacactattatggaccacaggcaatcctgttctcctctcatttccaaagatcttactcttccctgctccatctttctcccacttccatctgcattcttcttcattgcctcattgagtagatgaatgctattaaagagtagttcaacagggctacctttccttacatttaataatataaaccacaaataggcactcattactgcccagcaataccatatatttaccctaggaaactctccatcccactcacaaagatctgaacttacacccaatcctctctcttccaacttctcttagtcctacctccaacttcactgacaatgtgctcgatagatcataaagctcagttcttgcatggagaacctttcatcttccaccactaatggtctagttcacgtacatctaaactcaccttctcgttgacttttctggtcataatgaaaaatgcattccagttcttaccaaacccaattctctaaatctcactttcttatcttctcaaagccttcctgtcctccttcctttgtcccctctgcatttaatcatcagtctctcatctagtgggtcattctcataggcacacaaacatgctttactataatccattttaacagaaaagtcaatcgactctcttaaccttacagcccccacactaagcactacctaaaatctctgtccctcttcacacaaacttctctaaagttgtttccacaaactgtttctacttcttcaccttcatctcactctctagcttccagccacattacttcctccaaattgctctttccaaaatcaccaggaatgtccaagctgtggaattaccaaaatagtgtgctgtgtcatcctatttggttattcagcccaattcaatccagtagatcattctttcttagaaacattctcctctctccatttcctctaagagatattctcctccctctatttctgaacatgacaaatctgcgttttttcacttcattggaaattttttctgagtcccttttgctccttcctccttttttgttcaatcaccaaaccctaggccttatggactcagttaagcatacccctctcttcttcatcttcactccttccctggtgatctcatccagtcccacatgttcaacctccaatgtgaatgctgagaactctcaattcatatctgaggtccagaacatctgagttccagattaacatacataattgcctatttaacctatatacttagatatctaacaggcatctcaaacttaacaaaatccaacttgcaatttttgttcttccaaaactcccacatcctttcccaattcggtgaatggtaccaccactcatccttttacaaaataccatcttggattgtttccaagcccttaaggcatatatctaatccaccaaaatgtcttttctacttccaaggcatatcgcaaatctaacatcttatttccatcattgctggcatacagtagccacggggaccaccatgtcccagttggaccacaaccatcacttcctttctgatcttcgcaattattctactatacccactagcaacctattatccacataagatccagagagattaaattttaatatatatacacattagacagtgtcactcccttccttaacaattccaatagctttctattgtacttttaatatccaaactccttcccatgtgatatgattaggttttgtatccacacccaaatctcaccttgaattataacccctatatccccatgtgtcaagggagagaccaggtggacataattggataatggggatggtttcccccatgttgttctcgtgataatgagtgagttttcacaagatctgatagttttataaggagctcttcccccttcactcagcaattctcttcctgccaccttgtgaagaaggtgccttgcttccccttcaccttccgccatgattgtaagtttcctgaggtctcccctgccatgctgaactataagtcagttaaaactctttcctttataaattacccagtctcaggcagttctttatggcagtatgaaaacggactaataccccatgtcttacaaagctcagcatgatctggcctctgccttcctctcctaccgcatctcaagctcttaccatcatattcattatattgcaaccacatgctgtgctctttcctgcctcatgacttttatatttgctgttcactctgtaattttcttcagatggttccttcttaaccttcagaaccagctcaaatgccaccaagttatgctttctaaatttgcctcagttaagtccctctcttacatagcacctctttaatttctcttacctccaaaacaacctcctataattatgtattattttcctatttaccacttacgtacattgcaggctccccctatgcaatgtcagcttcctgggagcaggaatgaggtgtatttatggttgaatctttagggctggtcacagagcttggcaaataggaagctaaataaatacttgtttaactggttgattaatcaattaatggaaaaagaaacaaatgaaaacaaaaacaaagactgtgggcattgtttctgtgggcattggctctttagtttgtttgatatggagctaaatgtgctgagaaaatatccgcatgcttgagtttgatatttacaaaatgaaaacattaacattcataggcatttatcacaaagacattgttggcaattgttttttaaaaaaagtaataaaatgatacttgaaatattaaaacaacgtaacagaagaggaaaatatagaagactataatttttacccttctctttttggccagctttattcccagcttggaagggaaaactaaaaatcaaatcctagcaaagaaaataaacaaaacaagttgaaaaataaaggtgattttcagggaaagaagtaagcttccgagaggataaatcaagttgactgacccaaatctctgaacctcatattggtgggcatgctaggaggataaggctacctgtacttttcacctaagcccattcattcgggaatgacagctgctacagcattcatttttaagagcttgaaggttgagcctggctgatatcaggccttatgaaacaatcccaatataagtatcttctactgatcactgttaaaaggaattgaccaaattggacaaagaataaatgctgaaaaaagcttcatttttattaatctatagggacaataaacatcattactgaaaaagtaataacagatataatagaagcttccaaatatacaacaaaattacttggaaagtcaatcaaaattaaatttttgaaacttaacctgttttcagaatagttacaaaatcagtctttactatacacaatatttaaataaccttttgaaaactatatacattccacatgtctagctggccattattaattaataaatattaatgagaaagataatagcatttcaaaagaagaaaataaagttatcttactgaataaatctgtatttgtgctcccacattaaataattgtgtcttatgaacagacacttctcaaaagaggacatttatgtgaccaaacatatgaaaaaaagctcaacactactgagcattagagaaatgcagatcaaaaccgcaatgggataccatctcatgctagtcagaatggcaattattaaacagtcaagaaacaacagatgctggtgaggctgtggagaaataggaaggctttaatgctgttggtgagaatgtaaattaattcaaccattgtggaagacagtgtggcattcctcaaagacctaacaacagaactaccattctacccaccaatcccatttctgggtatatacccacaggaatataaatcattctattataaagatacatgtatgtgtatgttcattgcagcactgttcacaatagctaagacatggaatcaacccaaatacctatcaatgatggactggataaagaaaatgtggtacctatataccgaggaatattatgcagccataaaaaggaatgagatcatgtcctttgctgggacatggatggaactggaagccattatccaccgcaaactaatgcaggaacagaaaaccaaacaccgcatgttctcacttataaatgtgagctcaacaatgagaacacatggacccagggaggggaacaacacactggggcctgtaggaagggggcaggagaagggagagcatcaggatatatagctaatgaatgctggacttactacctaggtaatgggttgatagatgcagcaaaccaccacatttacctatgtcataaacctgcatgtcctgcacatgtatcctggaacataaaataaaataaaataaaatatttttttaaataaataattgtgtctttttaaattccgtatcttttcttcccaggatggttggacttttgctttggcagaaaatgcttaattgcaaggtaaattcagcaactgtgataattctgcaaaccaaggaaactgcattttttaagaaatttcatctgttaataaaattttagaatatctatactgcactcagaaaagcagacaaagaagtattttatcattaattaaagtagaaagagttagaaatgactatggacaaacaactgataatgactcaaccttctgctaatttaaccccagaaagtactgtgcatttgactaaaggaagtggacttatcagaaagacattatatgaaagagcatatgatgacactttgggcatctttttcttaagcatatactacctaccaagaacttttacacataacttttgatatcacaataaccccacatattagacatgttctccactttagaatcaaggaaatggtgactcggtgagttgaaataacttcctataggttagcacagaaggcaagtgcctaagatgggcttttaaccaaggattgccccatataccttacactcagtgctttctgttctgcctgtacaaacctagaaataccttaacataggcaaggtaaaatgcgataaggacaaggagaaaaacacagagtaattagtgatttctaagaaactatttatagcacacagttatactgtctcatttcctttacaatacttcagtgtagataactatgtgtgtatatacatgagtgtgcatatatatacatacctgtatatacatgcatgtgcaaacacgtctatacacacagttatatgtgtgtgtatatgtgtgtgtataaacacacacatatatgtgtatgtatatatacatgtgtgttacacaggtgtgtatacgtgtgtgtgtgtatgtatatatatatatatatatatatatatatatatatatatatatatatatatatataatgttatttttgccctggagtgccaaaatatatacagctaaaatagcattttagacccaaatcaggcatccacactgactgtgctataaacacatttcaacaatcactatctcaactggcactagaaaatttgttaattagcattaagagatggaaggaaaaaaagtgataagtaaaaaaagtagtggtcaggatatatagattagttagaaacattagagacaggcctacttttcaaagaatccaaaaaatcaggattcagttgcgtttcagaagtaatattatttttgaacattagaaaactaatattatgaaagtaactatattaattactacccctgaacagggtctggggaagcaatcaaacacattaatatttctgcagcaaggaaaaaggctattcatactaaccagaataaataaagactttaataaagagctgcatggtaattcaaagatttctgttatcaaagctgtttttagattttggcattgtagataagggattgtggacttataattgtgaatagctaaattatttaggctaactgcaattcatacaaaacatttcctttgaaagctgatattgaacttcacacattatgctgcacagtattccatgtgcaaatataacaacccttcacccctccagaatttggctgacaatgatgtatataaagaacaggctggaagataagagggcagccatggtaaaaaggcctctcagcagccattagacggggtgtgatggccacgtactggagtgcattacattatgcataaaaaaggccccgtatctttcatctgatatggcttctaaactcaacacagataagaatcagtaagcggaattacagacagaactgagaggcgggtacacaaagcagtcaccaagaatgtcagcaacggctgacagtctgattcaaagaacaaaaatgaaactgtttttagagacaataagagcctggcttgccagtcaagcttgaattccaatcccaactctgccattataagctgtgtagtcttgagtaattccttaacttctctgtacttcagtttattcattaacataggactgatgaaaatgctacctctctcctgcagttgttgtgaagattaaatgaaatgatgtgtgtgaagaggtcagtacagtgcctgacaatgagacgacactcaaaatttatacgcacaaaacaaagccccaaatctcacaaagtatagcagcctgaataaatttactgccaattcttcagaactcacagcatgaagagcattaccatttagtatagaaaaatatcatcctgactgtgttgcatgactttgaacatgtcacttaacttctctgagcctgagaatattagattagaccatgtattctcaacacaggtaataaatggttatttcttttcagggggagggtgaaaaaatgtattctttttatgtataaagcacaaccatacagtacacagtatatcatggtattaaaatttcatgggaagatgagtctacacaggctccttagggaagcgataatgtaaagaaaggttgagaaacactggttcagaagaactctaaggtcactcgtatccattaaagttccttaattctatctttgcaacaatactaccaagaattcagaaaaaagttaaatatacattcacaagctttaagaaggcaaagaaagatttatatattctacaaagatgtccatttaaaatagttaaaaattgtaaagttcactgggtttaaaagagaaaactctctttacatatagaagccctagttatcattcacgaagggatcctatgagccagttttgctctgttttccctgttttatagataacaatatatctaaatcatgtctaaatattaatataattacttatttccaccccccggaaaatgcagagagaaaacacaataaggacaaccacttgtaactacaaagaaactggaacattgtaattgtcttagctatgataaacgaaaaatcaccttgcaatataattcatttttaattgcctcttccatctaatccaactactgctgtaggctgtcttaaaatatttacaaagtaaaagcaaaaaaaaaaaataagaagaagaattggaggtgctaaataaagcaggccacacattcctaacggataaattttttgttaagtttacaaggaaaacaaagtcctaactcttatacatggaatttttggaaacacaaagacagagcatatttaaggactatatctcttttttttatgttagctatattatgcaaataatttttattcatcgtacttactgtaatacgtatatgttttcatccacagttcctgcaacataactcccataacacttgttatagccttttgttctaatattggggtgcctcagggctcagaagcaggcctcagaaaacaatctctctctgtgaccttctcctgccctttcacctccttctttctctcctgaaggcaggagtcttcccctacctttctgtcttggagatggccataaagaaattctctaacctgctttgtctgattgtaggtcttttcttttttttaattattattattatactttaagttttagggtacatgtgcacaacgtgcaggtttgttacatatgtatacatgtgccatgtcggtgtgctgcacccattgactcacatttaacattaggtatatctcctaatgctatctcttaaggttaaagctgtttttaattcaccttcttccctgcctgagttatgatatccttactaaatccaaataacctattataataaaagagaaaagttgtagtaaaatgttagaaagaccaatattatagccactctgctttaaccacttgtgaagttttgtctttgctaacccagtcttattttctccagtatccaaggtatatctaacaacacattcaacctcacattgtgccatcataaccctcttctttgagttttcagagcttcagagattgtaactaaaaataacactctggaagtgtataaaacgtatccatgtcaaaatgttattaaatgcttagccatactttattagcaggaatatatcaggaatataaagtgctctaatacccattttattcacgtcaaaatagatgtgttttgataccaaattggttttaagacagttgcattttaataaagatgtgcgtaatttcacctagacacaggcattcccagtactatatgcatgatgtaaacatctttttttactaatgatgaatataaatatgcagtcttaaagagatgctaatcactgtttatagtttctcaaattctaggtgttcaagtgattcaagtgacagaaaattctcttgtaaacacatattctattttgggctgttccaaatactctgactagacaaagtaatgggaaaaaagatagtaaattaactaaaatcctaaatgcacatagattatttcagggatctagtgttggatccatgtgtgtctggtcctcaacttaggatgccccacccaaatagcacgctattccaattacctttagggataccattaccctgatgcatctgtaaacacctgcactccttaccatcagaagactacaaagtgtattctagataatactgagagcgtaagacaatcagaacacataatcattggcaaggtttaggctgatttaaaaaaataaaataaaaaactccattgtaaaaattcaaaaacatattgtataagcatacattctgtactaagtatgataatactaactcagaacatcacagtataaaaatacataataataaaatgtacttgtagtagccacatgtttggcaggtttccacgagaaagccaaagccatcaaattctcaacttgacaatatacatttacctgccagggccttagacttacctttgtttgagattgatccatgatgtttttaagtactctgtggtttctttcacattccttgtgtcatcactcccatattcctccaggagtttctgcaggacgttatcgaacgccatgacgataccatctccaggacccagttcttgaagcagtatctgaggtgcaagtgcaggtctgtttgttagacttggtcactcagtaattagtataatcaaaacaatggtactcccagcagattttgacatgctttagatacagatatcacaggatgaaaacagactgggggcaaacccttttgttatatgtaagcttaaaccaaaattagtagaagtgaaaagaaacatgtccaagaaagtgatcgagtacatagatgacaatattacaagattattatcattttctttttgagatattttccttcctcaaaccatttgtctttttcattccttctgctgtacctctctgatccttacacggacatgcgtcataaaggactgaatacagagacagttcctgcatacatgcctggagaaacgtgaagaatcaacaacatggacgtcttccatctcttgcccctggatcacaaggtgtgtttacaaagataaccacttgaatggatcaagctgccaagcaaggtttactgagagtttgcttgaatagccaaactgatgctgaatttgtccactggcattggttctttgacatagtttttcagcctctgagagtctctggatcaaggtactcaccatgaaatctaaatgacaactgaaacctttaatataatgctttttgtagcaattgggaagattttaaatcagcctaaggtttcagaagaaaagaatcacactgctgattaaaaaataatgttctaatatgataactgaaacactgacatcacttttaattgtattcctctagttaaggggccaggggcttcactattacttgggagtcatttggtggaaacagtcagcagtatcacaaacacacagaatgatccagaaatgcatataactggccacttgcttttaaaactgtaaccaagtaaagtctgcatttgtggagaataaaaacatacttccacattttcgattgttttctacatatactttcttaaattcttcacaaatatacacttccatcttaggctagctgaagggcaaataaatgttataccaaactataacctcacaactaaaacctccaattcaagaatattttataattttatacagagaatcttaaaagcacttttaaaaataccatagttgttcaatattatcaactctataactgaactgatgacaaaaaagatgtctgctattacgaaattgataaaacagtttggttaaaaagtcattaaaggaaactaaacttacttatctgatttgttcactatagtagtcctcaaatgaaagtcttggaaaaacttattaataaaaataaccttcagggtaagtaagtaatatggtttggatttgtgtccccacccaaatctcatgtccaatcgaaggaggagcctggtgggaggtgactggatcatggggatgaatttcccctgtgctgttcttgtgatagtgagttctcacaagatcagatggtttaacagtgtgtgacacttgggaggccaaagtgagcagattacttgagctcaggaattgcagacaagcctgggcaacatggcggaaccccgtctctacagaaaatacaaaaattagctgggcatggtggtgcacgcctgtcatcccagctacttggaaggctgaggcaagaatcgctggaacccaagaggtggctgttgcaatgagctgagatagtgccactgcattccagcctgggcggcagagtgagacaatgtctccaataaataaataaaatgtgtggcacttctcccttctatctctctctgtcttgctgccttgtaaagaaggtgcctgcttcccctttgccttccaccatgattttaagtttcctggtacctcccagtcatgcttcactacagtagccctcaaatgaactgtgagtcaattaaatctcctttcttcataaattactcagtctcaggtagttatttatagcaatgtgagaacagactaatacagtacagaagggagcaaaagagggttcctggaatcttgaaagtgttctctttctagatgctgatttgagggtgtgtttcacttgcaaaaagtcagtgagctataaatctcggagacatgcatattcttacttgttatgcctccagaaatttttcgaaaaaaatcttccagatcaaattcttcatataaatttcattagacactctaagaacttaggaaaaaacatggcagggtcctattgttaagaattacagtgaacaatagaaaaaaagtatatccaacaaaacaatactgccaaaaaatatctgatgagtcttacttggttatcagaaatttgtttggtgagtggatcccgtcgggcttgctgaagaatatagagtcgagcctcatattttctcatcagttcttcagtctcctccctatggtcatcccactgaagactgtcaataatcatgtcctcaagctgctgctgtcttagctcaacgccatgctgggtgccatcccactggttcttgaccctttccactgagggtagcattataaaagaaaaaaaaatcccaacatgtaaccctcaggagaaagaaaaaatatcatatatcaaatgtatcacaaataagtctataaacagaagaaggcaagctgataaacacattttgaaggaattttaatatacatctgccatcctatacaattgatatatttctgaaacggtgtttgagaaaaaaaaatcttgaactcttattttcagtgctctaaaacaactcccaaaaaaatatctactattataaactgatactgccaaacaattataaagaaaatactgttctatttaattttgtatttacagttgtatttatagacctggtttgatgaaggtagggtttaacagtacttcatgacagaactttaagacagagagatagtcacctgttaccctcaaaggagaattttctaaggcagtcttgattttagaagaaactgaactgtgtaagaatttttttttgcatttgttttactgtagcaggaaaactctctaaaaggaattttatatattcaagttcaagagaaatgctaaaagtaaaagagactcatgaactgtgcacccagcagctcttcatcataaaaattccatactggctcttgtccttcctcttttattattgttcattcctttcactcattatcaccttctctctctttctatttctcctcaagctttctctcttctcctttctctatttttaacaaggttttaaggacagacagatctaaggaaactttttttttttttttttttgagagagagtcttgctctgtcgcccaggctggagtgcagtggcacgatcctggctttcagctcgctgcaacctccgcccccaggtacaagtgattctcctgcctcagcctcccatgtagctgggactataggtgtgtgccaccacacccggctacttttgtatttttagtagagagagggtttccccatgttggccaggtctcgaactcctgacctcgtgatctgtctgcctcggcctcccaaagtgttgggattacaggcatgagccaacgcacccggctggaaacttaaattttttattaatcacttcagagttagttcataatcttgaactgaggtactaataaacaataacttagaatatccgcaagaacctgctgataataagtaggtagaatgttaaaaccacgctgctgaaagatgctttggatatcagacaaaaagaaaggctatagttaagtaccaggcccaagaggaacgtaactacaagataacattccagctgagttatcatggaacactttggcaaagttcttgggataatatatggttatagtgaaacataaaagctatcaactggctgggtgcagtggctgacacctgtaatcccagcactttgggaggccgaggcaggtggatcacctgaagccagaagttcaagaccagcctggccaacatggtgaaaccctgtctctactaaaaatataaaaattagctgggcatggtggcaggtgcctgtaatcccagctacttgggaggctgaggcaggagaatcgctggatcccaggaggcagaggttgcagtgagtcaagattgcaccattgcatccagcctgggcaacaagagtgaaactccatctcaaaaaacaaaaaagctatcaacaaggctgttcaggccttaagttatacttacatgtcatcattctttaaaacttgctcaatgagacaatctgtttcattctgtcttagctgtttaaataaattgcttaagttttaaacttaaggaagagaggccaaatctatcataatgttctcttgtcagttaaaaagttacataaagtacttatgaccaattctattactaatagaatcctttaacagtaaacaaatgaaaccaaagacatcaagcgagagtaaatatcacaggtttatcataagaaataggcaaattatcccattcattgtgagttaagccctaaaacgaggttactattggtagcaatacattccccctgggaagggtttttcatataatgaggagtgatgaaggttatagaacctctacacacacagaaatatttatatatagagagaaaatagagtgtgtacattcaatgggaaagggaagatatttaggagaagtcttgtaaaacaaaaaaacaaacacctgaaagaagttttggacaaaaagagaggtgatggaaaaaataataattaaaagaaaacatcaagatgatagaaaaagcaaactggaaatggcttgtcaatagtttggtatcactagagcagaggagctcccctgtgatgtgagggaaaccagctcactccaaagttccataataggcacaatccatccattcataaaaagagaaaagaaggaaaatgatgtatttagtaaaaataagccaacactgttagacattaaaagttcttttctaatgtatctcctataataaccctgttgctaccatgactattttgaaatcaaaacatactttttacagggagagtagctgactttcttcccttgacaaatattaggatttatccttccagtttatattttgtcacaaatatttattaggtagttaatttgtattggcactgttaaaggcccaagggcagaaagacggatattcacaatctatggaagagagagacaattaaagtagttgtaagatctataataaagcaatggggggaaaggccatagaaggaactaaaaatagaaattaacattcaccagggaccagaagaggagggaaagatgtcacaaaggggatgacattttagctgctgcgtagaattgcacctgggaagaaaaggccaagagaaataaaataatgcaaataaaggtaagaagactaggaaatgtcaggatattttaaggaataacagcataattacaggccgggctgagggctgaagtgagaaaaggggtagtggcagcagattgtgacaatccctaggtgtcactcttgagaatttagacttcgtttgctattggtagtacattcccactaagaagggtttgtagaacctagatgcttctgagctagaatgcaaaccccaagcaaggatctttgtttgctattgttttgtatgtttattttttgttgttgttttctctcatttataactaaagtatccccaaattaatgccagtcacataagcacatagtagttgctcaataaatatttgtggactgaattttgggttgagttaaaagacacagtaagacctgattttagagaataaagtataatgagagaaaggatttgcattcttgtgagttcctttaacctttttttattcctctaaaagaaagcctaagttaagagaagaaaacccaatgtgtaagtaattacttaagagtcgtgatgttaataattaaggacttcataaggttattgtaacaatgttcacaaaacataaaaacaagggaaagctacatttctgtataaataaagagtaacaaatattaaacactattactttctagttgaataatctttgaaaatgtgtttgtgtgtgtgtgtgtgtgtgtgtgtgtgtgtgtcaccatttgcagggaaagtggatgataatacataactttttttaaaaaacttacatttttctgtaattgctgttctcatatctgaactggaagctttatttttcaaattctgtgccaatgtaaaaacataatccagctgaggatggcgctgttctaagtcagcctttgtaatctgttaagtagaaatgattattcggataggttaataagccatatgagaagaataataagcaaaacagttgtgctgacatcaaagttgtcgttgttttcctcctctatggcatagtgaagcatcagcaacgtggcagaaaatgagtgcatgatttaaagtcaaggatcctgcattcaaatctcagttcttccatttagcacctgagtcaccaggcaaggagctttacctctctgtgtttttgttttcacaaaaaagaaataataaaatactgacagctcaattacatccagtctgaggacattaaacaaagaaaatcccttcaaaagctgaaaaatgccctgaaaacattagcagttattgctgctgatgatgacttgcatatctgttctgtgtcaggtacgaacacaaactaatgtcatagggttgggggtgacacagaaaagtgctaagaggaataactataaattaaatcctcttagacacgaaaaactgctgctgtagatggtttgtctctcagtgctaataaatatgggagaaatggtaacaacatcaggaaaatcatgtgttttcagtacagaactaatgacagtcatagagactagaaagcaatttacaaaaaatacaaatagtggcaaatgactttttcccagtccttcctctttacaaattcacccgttttgtagattccagctactcctttggtgtcaaatattacttctaaatggattgctcacaactttcaatcctaaatcccagggcacatggtaatgaatactgatcacttccttctaaatggcataaggactccccaccacaacacgtctgaaactaaatcactcaaaccctcattcacactcaatttcttctattccttatttctgctaattgcaacagcatcatcttagtcatttcagaaagggctctttgccttgatttatgcatttcttgcctccaatccatcctagtcttctactaaagcagagcacggttatcatgagttcataaacacaattttaaaaagaaaaagaaatgggaaggaagatgtttaccaattgcttacagactaaaaatccaaagggctttgcacagcctgcaggctccttcacaaagggaatttgagctgcttttcctgccttgtttcacactgtatttcttaattgcacaaatgttggccctactgtcctttgtgcctcctgtaccacatgactttattcactctgttccctataccaggaatgtcaccactttgtcccagatgccaaaatcccacacagtttgctttccatcactggagaagtgatccccttcctcatcctggctcccccaacaggttgcctgtacttctcctgaggcttttattagactcttgccttgctacagtaatttgtcaactcatatgcactcagtgcctctgcctcggtgtggacttatttgtaatgtggggataaaaacagtacctatctcacaagactattaaagaattgaatgagataacgtgtacaatacttagaaaaatgaccagcacacatgaagcacttaataaaatttagcaagagctgttattattatttcattgtagtttcccaatttctacctagaatattcttgtcagtatccttgtaccactcacagcccagaacttagcacacactaaatagggaaaaagaatttttacaaatgaatattagatggtacatgtatagtagtaaagttataggagatattcacttttaaaatcagaaattaatctcattatgaaatataagttgcaaaggcactttaggagattatcctacatcacacaacaggcatgaaatgctaacgccagcttatatttatactaatgtgcctagctttacggtatcagttttagattttaaaaatgcactgggtctttagtttaagtcagtaaacctgatcatatcacaacagtataaatgcaagaaaagctctatgctttgtagttagccctgaatggttgtttgacagatacagaattttttaaacctcattctctcatagtttaggataaacaaaagggattcaaacagatctggtctacctctgggttgtggcgtttccatgacaagcttttacactatgcacctactttcattcgggaaacggtcttattgatctcttctacatccccaacagtgacaatgttggacttcagcatctggtcgattaataccagccagtcggctagttctgttatagttttatcaagatcagcaggaattgaaatttccgaagtacgatgagactgaacaggaatatctgacgcagatgatactagcaccaccttttggacattaggatgagctgaaatgaaaaatgtagcaaaagagaaattaatcaacaggatgttttaattatggtggtgtcatggtgacacgtgtatgtgtatttaaataaaatttagtttaagtaaaaaaaattctaagaggttattttttcatactgaaatggctatggtattacctgtaatatccatatgtctttggtagctatcaagccaacaaaacagttttgcaacattctataacataatcagcactgacactgagaaaaattaaaagtacaaatgtgggagaactggaagtattattttattttggcaagatgattttaattataaagccaacttattcataattttttatttttttcatttaactttataatgtgagcatattttattcttagtaaacacaattatgaatacctatgtaataacctatacccatattcacttttatttaacccttggatatttagattgctcctgaaattttattttaattttttaaaaaacttgcaaagaatatcttttcatgtagagtattttgcacatttctgatctctatcttagcatagatttcccaagtagaattactgagtcagaaaatacaaaaaaaagtatgtatttaatattcattgccaaattgattggttttgatacaataagtagttgaattagtaattaaaactatctgtaacctacttcaggtatgatatattagatgaggcttaaataattttctaaaatgtatagccaatctgtaaattcagcacaatcctaataaaaatcccaacaggcttgaatgtaacaaaatcattaattcaaatttctggttataaaattaatattgaagagaaaaggacaaaaaacagtcaaattattttttgatagaggaatatgccctcccagatattaagttatattatttagctaataattattaactcagtatattatagactgagacatttaaagagaccaacagaagagaagagtcacaatgtgtaggtggcagagaaatctgaccttggcagagactgaattacagatcaatgaagaagaatttactgttcaattaagtgagtcaccacggctgcagcagggaaatgatgggactgattttaacctcacatacaccatagaaaaattaattcttagtggattaaggacctaaatatgaaaaacaaaattgttagttaaaaataaggaatacttttattacttcagaggactgaagtagctctcaaacaaaacacaaaaaagggaagctattaataaaccattaatggttaagaattccaaagagcaccataagtaaagattttaaaagcctttgaaagatgaaaggagatggtatttgcaatgcccattgcagacaaagaactgatagccaaaatactttttctaaaacttaaaaaatcatctaaagacaatccacaaaagaggaaataaaaaaggcaataaacataaaaatgtgaaataaatgtctgacctcttctataactgagatagtacaaattaaaatgaaataccctacatccacaggaccaccatcagaaaagtgacatctgagaagctctaggttaagatgcctacactattatcatcagcacattatttgcctttttaggctcagtctctcccacgtgtacagtgtgttttatctaagtctacataacgtgacatcacaagagaccaaatgcagaagcagaaataagaatacagctgtgttctattaaactagacatttaagagatttcaaaaaatataaaactgcagcttttccaggattttgtttgttttagaaaacagagttgtttgtttgtttgtttgtttgtttgttttttctttgagataggggctcactctgtcacccaggctgggaagcagaggcacgaacacagctcattgcagcctcaacctcctgagttcaagtgatcctcccaccactgcctcctgattagttggaactacaggcctgcatcaccaagcctggctaattttttttatttttaattttttgtagagacagggtctccctatgttacccaggctggtctcaaactcctgggctcaagtgatcctcctgcctcagcctcccaaactgctgggattatagacatgattcactgtgcccagcatcttatgctaatgttacaaaaacatgctatttttgttaacatataatggctttattattatttttaaacaacttaataaatgaattaatggaaaatttttctagttaggtaaatacggataactatcactcacaaaagcaaaagctatttgagggtcctcaataatttttacaagtgtaaaggggtcctgagagcaaagtgttgaggtgctggtaatgctgtagaacaataagaacccattacacacagccagtgtcagtgtaaactgggccaagtaatccagacagcaccctaatggcagctagtgaagtagaaggcacccatatgctaaacccagtgattccatcactagatatacaccctacagaatatctcacacatccttctgccccatcttcactttaactttttttgtagataaaaaaaattcattgttttaattcatcaaatacctattaagaacctattatgtgtaaggggctattctagacgctgcaggcatgagagtgtgcaagacaaagtttgggctggagtgcaatggtacggtcttgggtcactgcaacctccacctcctgggttcaggcgattctcctgcctcagcttcccaagtagctgggattacaggcgcccgccaccacgcccagctaatttttgtatttttagtagaaacagagtttcaccatgttggccaggctggtctcgaactcctgacctcaggtgatccacccgccttggcctcccaaagcactgggattacaggcatgagccaccgtgccctgccagagcttgcattctatcaggaaaatggatgtgtgttatgaagtaaaatcaatacaagaagacagagacagggtgtatctgagatattgtgggcaagaaagggctattctagaaagggatatctgaaggagaactaaaggaagtgagtatgtgaaacatgaaaatatctaagagaagaacatttggggaagacaagaagaaggaacaccaagcacaaagaccagaaatgattacgttcttggcatgtttgaaacagcaagaagaccagtgtatttgaaacagaatgaacaaagggaaaagtagtaagaaatgtgattaaagagacaggcagatatgcatggtgttctggactaaggccagactttggaactcatttatgtggatggaagtgattaaaagactgtgaacaaagaaacgacacaatcaaactcgtttaaaagaatcactctatctgctatcagaggaataggtcatggagaagtactgaggcaagaataaaatcaggattatgagttaggagcatattccaataatctagatagaaagataagggtgttcaagaccacggaagtaggtggaatggaacatggaaatgatgctacttgctgatggattgaatattaattccagagaagagttgaggttgactacaagtttattggcctaaggactgggtgaatcatctaaaaaaaaatgtctacagttctgggactggtaagcataggtagaaaagagaatttagaggattgtagtatatccaatgttatgtaatactgtacatcagtttaaatgagtagactagagctacatgcttcaaaaggtatggcaataaggatgatctagtagctatcagagaaagaggatacgtaagcagcccagagaatatgggatcctatgcataagtggaggagctggtcttaggaaaagagataataaccctttcactgaataggaaggaagtgtgtaaagtatatgggtacagccgcaggtagcttgatggattctctggtgggaaaacgaaaaaggttttttttttcttttgaaaatgagatgaggtcactagttgagaaatgagtaccaaggagtactcagaagaaagtacggtaggactgtctcttagcgctgagtgcttatttgaaatgaatagtcatagctctgaaatgagtacagtcggcaaggtgttggcaaggatgaacctcaaaaacattatgctaagtaaaagaagcatcgtatgactccatttatatgaaatatccagaatagagaaatccatggaaacagaatgcagatcggtggttgccaggggctgggagtaggagggaatgggaagaaactgcttaatgagtaagaggttttagtttggagtgatagaaatattttggaactagatagaaatagtggttgtacaacattgtgaatgcattaaatgtcaccaaattgttcactttaaaatggttaattttattttctaaataaaatgttaaaaagaaggaactgaattaaaacactgcgtaggaggagagagacatactaagattagcttcaggtctcaggcctatcccaaggacgaatatcctgttaaaaatgagccatccacctaatggaagttgtagctttgctgttagctttttatacttctaaatatgtattcaaattttccctgctcctttaccatatagaggttttaaaaagtaagataacccatgacgattttataaaatgcatcaaattctttccctatgattatggagttgagcctgtatttgcaaagcagcagtacccaaatgtcaactcaagtgttctgaatattaatcaagaaacttgatcaggccccaggtactttttgtgcaaatttccagaaatacaagtaataaaaaacacaaacttggtcctcaattagcttgcaatctcgaaaaatgaaaaaaaatatattgtctgtcatcacttttttcaaaacttgaggggaggaggaggaagagaaggaaaagaaaagaaaaataagaggaataagagaaataaaaagaaccctcccaaaaaaaagaggtagaagaggtagaggtggaggacgagagaagaggtagaaagtagaaggtggacatggaagtcaaggaggaggagaaggacaagggagaagaaaaaagcggggaggagcaataaaaagaatcagcagaagcagctgtcagggagtgagtggacagttagagttggtcacatttgcggttttgccaggtgactcaacagaggaagagcagggcatgatggttcagaaaacttgcaaggcagtggcaacagtggctatggggcaggagcctgcgatctaatctggataaagagagaaggaaatagtgagaaaacattcttctttctccacatccaagtgagaagtatttgtctcctaggttggagaatgcttctaaatatccatcccccacctgcttcccaggatatctaagccttttgttctcagtcatgatcagggtctaattacatatgttaaccaagctcatgttaacacaacaagttatagctgatttcctgaaaagctgcctggacccagaaaactagtccccagtttttgcacctagcctctcatcttcccttcggcaggacctgtggatgcccaggtagcactggagtccagagaaaggccagccttatctgccgcgagaacaaatgccttacccacactgggcagccaaatgtgtcttgggtttaaagaagatgttctttccaaatcattgaaagtagattaaataaagaaaatggcacgacgtttctaagtctttctaattcatgtatgaggctcatatcacaaaattttacatactgattttttaaaaaactttgttaaagataaacatatcttaccagcaatccttgtctgtgaaacagaactgggctcctggatgcattccttcagggtggtaggcacctctctgcaaatctaccgcatcaggacaaacagaaagagaagaatactacgtaaataaagatgactgtagttcaaaagaagaggtgttattctgaatggcagctctgctacttttcttcccctaacgacctaaacttctggctctaccttcactctccattgcaatcttgtttgagcccctaactccactgacattgctatcaaaaacaccaaccagtccttagctgtcctgacccctgtgcaccagttaatgccgtccactccccctcccttgaattctgttattactctgcaattctggctttcctcctacctctctggctggctctcctgaatttccttcaccaactccttttcctctgcccatccatcaaataccaatatccttcagggcagctgtgttgctcttcttgcccttcaccctgggctctccctgagtcctggtttccaaagatttcaggaatcaaatggagttttgagaggctaaagactgcccaaaacatatcttcagtccagccctctctgtgaactagatattcagatatgtccacatctgaattccttatccctatcttccctgacacccgtttcataaactcttctgaagattctaactcatctttctatatcaattcttaggatcacttcatctatctccgtagtgaagctatagcaatatttcaaaaacatgactttcctctgcttaaaacccatcaatagctgcccactaccctcaaagtggtagattgtttgcaacatggagctcaaattccttgtgatgcacagtgagtcctccaggatctcatctctgagaacatccctcagccttccattctacagtgggctacttcctggacctatatacactgtgctcattctctgtctcttctagacactttcatttgccacttctctctacactgcactttccctcattcttcacccgaccaatacttattcatccttcgtaaattaaccagaatgtgatcttttcaacaaaaccttccacagctacccctcaaagccaagcaggtgctccacctttatgtacccatcactacctggatgttataattggttgtctgctggtctcatccatgataagctctttgagttagaaggaatgccacactctttaatgcattcctatctcttaaaatgatacctggcagaaagtgagactccaataaaaacctattgagtgaatgaatgactgtatgaatgaatgaaataaaccatgttagaatttcccaaattatgtttgttgagattttctgcacaatgagcattgttggtcttagacattcataattcaccaaagtgaattatattaaaatttacatgaaattctgcaataaccaaagctctagctttgtctgacatagtgcacccaaattaacaactgtgcccttttctgcagaatacccactgataccctttgtgttaaataaatatgtgtgctccgactgaatatggacaacctttctggcaagtgacacaggacctaacatgtctggaaaggagtgtaggggagagagagcagtggatattgtaggagagatcacaggacgccaggccatgagaagcctcataagccaaaaaagcattttggctttcaccctgagcaagatagaaaaccattggtggactttgctcagataagtcacttgatctgaattatgttttaaccaatcatattggctgctttgtctagaacagaataacaaagggcaaaggaagaagcaggggagatgagtggggcagcctttgtagtcatcaagacaagagatgatggcaggcttgaaacaagttagtggcaatgggggttgtaagaagcagtcaaatgtatgatattttttgacctaagaaaagtcgaaagaattgtagaggaaatatctatgtgccctctgacatctacaactgtcaaacttctgctacatttgccttatcacacatagccatctggctatccaataaaccatccatccagtagatacgtattttgaaggaaaagctgctaatggtgactgaggtatagtttttggtttgggggttttctttgtttctttttgtgatagaattcatataccataggattgactccaatatttctgacttaagtaataataagatgaaacttccattgactaaggtgggagatgtatattaaggcacagaagggagagggatatcaaaagctcgattgtgtatgttagtttgaggtgcctattagacatttaaggagagatgttgagcaggtagttgcatacacaagtttagagtatggagaaaggtccagaccagagatacacatgtgtgaatcacagtgactcaacaggcagtgattcccaatcagagagaccagatcaataaagcacctgcatcattagctataggataatggctaccatttaaagaggatgagagagaaaatgactgatatggagtccatccaaaccaaggacagagacatatccattcaatgtcctatacagacgtcatactctgaaatggtgtgtaccaggtcaaacaaaaaagatatctatgactttatctacttttaaccgtttcaatggcaaaaaaaaaataatggtaggagggaaagatattagttgtatttgtagtcacatgccattacatttcactggaacctagtaaatatatatttaatgaaaaaaatcattgaaaataaacatacatgtgtgaaaagtcatgtgcaaaatcaggatgctattttctttatttatttcttttttttttttttgagacagggtctccctgtctcacccaggctggggtccagtggtgtgactgcagctcactgcaacctccacctcccaggtataggcaattctcgtgcctcggcctcccaagtagctgcgattacaggcgtgtgccactacgcctggcaaatttttctatctttagtagagatggggtttcactgtgttggccaggctggtctcaaactcctggactcatgtgattccccccatctcggcctctcaaagtgttgggattacaggtatgagccaacacacccggctcagaatgctattttaaggtcttcattttcagaatatcatcactggaattttcttactaattccaacatatattcattatttaatgtagtatataatgtataaatcccctaggccaaagagttctgtataaaataaaaagtattcttctagaatatatgcctctgtctatgacagataaaaaatataaacattagtaagctttagtaaaatttgccccatttggacatacttgaaagtaaagcagttacatgatcccacatctctgacaacaaaatcaataaatatgagaaatgtgtgatagtaactttacacacaccttattccatgtcatatttacagtccttaagctttctgaaattttatccctttcaggtaaactcagacttttatctgaaagcatctccaattcagttctattcagccatttgagtttttcagcatgtacttccatttcttgagttaagtcctggagaagttaaaagataggtgtggttagaaggtagtcagataagggaaaattcaagaactgtattagaaacctttttggtattattacaaatgtaactttctaatttgttaagtgaaaaaataaacttataagaagcttaagctcatgctaacaaatgataactaggaagggagtgagcacatgccttctgtgtgtatttttgcactcctgtgcacaaacgggctctctggtactcactgtctcttaaccgggtcatatattatttttacactgctaatttaacattctgttcttatctcctccttgctactccatcctaatatactgttccaccttttctaactctcctcaaattgtttacaaaagagacattcccaaaaaaaccactgaaatttttaggtaaaaaaggaagcttgttagatattgtcacattttaaaaagaaaacttaatatatgttccacaaaatatttttcatcattattcaatgtttctttctcaaaatgcttcaatcatactcctttatagacaaaatctctgaattagtaagtaacctttcacacacacttatgcttgtacatgtatgaatacacactcataatttcttttttttttttttttttgagacggagtctcgctctgtcagccaggctggagtgcagtggcacgatctcggctcactgcaacctctgcctcctgggttcatgccattctcctgcttcagcctcccgagtagctgagactacatgcgcctgccaccacggccagctaatttttttttgtatttttatagagatggggtttcaccatgttagccagatggtctcgatctcatgaccttgtgatccacccgcctcggcctcccaaagtgctgggattacaggcgtgagccaccacacccagcccacaatttctttttttaaaaaaaaatgtgagcacattatgctgagtgttctgcaacaagtattttaattcttaacacaaaaaataaatatttatgaatacaaaatttatggatatttggatatatttatacatctatatatgtatgaatttttatagattatatacatatacaactataaacaatacttgttagttgcaaaccaacaaagaaaatctgattaatacaaccatgacactaaacctattgcaagctgcattttgttcctcagcaagtcactctgataattactgattatctataaagttgagttttgcagctttatagacaataatcagtaattttcttccaaatctaaaaacaaaaaacgatatttcatagccctattgtattttaaaatgataaggtcagtttacaatatcctaaaaacctttggtctaatactgacaccataatagtttgttctttttacataagtgaagtttaagctctgcaagaccaaaattataactgctctttaaaaaataaaagatattcctctttcaggttcaccacatttaccaaaaagtacaaagtttcttttcccttttcttcttgagacacgcagtatgtgactctgaagtataatgttcgggcaccaaaaggcatatagacagaaataaacaacttactcttaattcttgcaggttttctcccaattcggtggttgatctcttttgcatagcatgctcagcctttgttaaccaacagataatctcatctagctgatgcctgtacttcatcacctgcttactttctccttttagcctaaaagaatatattatttaaaaatattgaggaaaaactgtccaattaagcagaaccttacatatttgctttgaatatcctgactaaatatttcccaaaataaataatttctaataattattttaatatatattttaagtgaaacaatgtatatattctacaatataaagattgcttaataatagaccaagaagcttttttccttagttaaattcaaaaacattgaaactaaagaatattatcttccctcatcataaaaagttatgtagaaattgaatacaaaagccttttttacagttagataccactccgcaacataatggaaattttttaaaacatgaaaaatgtctttatctaaaataatagggaaaaagcataattctctttgagtgtttcacgaatattgaaaggaatcattatatgacatgttatcacattaggtggtaactattactctgctttattcatagaacagaaagaataagaacaaagcaaggtatcaagaatgggagaatcttacaagtattagggaagacaagaaacatgtgaatttggcttgtttattaaaataactattatatttgaatagagcactgttacaaaaagagatatagaaaaaaacaaagcaaaaattttaaatgatgcaaggaaaacagtcaaatgaatataaaaaaggaactgcctcaattagatctttatagtgttataagaataacatttataagaatataaaccatctgtcagaagagaggaatatgattagaactcatatgacaaataagattatgtgttttttaaaaggatttgaaagctattaaaagcctggtggtatctttatttttatagctgctataattaactgctggtttaaaaactgaatgcaatttttaaataaattgtattgtatcattcctaataagaatttatgtttttgcagctaggagttttcatttttaatcacaaaagttctcacataatcgtgcaatacatgtaataaaatattagataatacttctatatttaataaacagtcaatatttgatgtataatgtttaaaaaaatgaaaatcactacaaaatcataatttttaagtatccatcaagaaagaatgctcctttaagattaaaaataaataaatacagcaacagcactaattactaagactaaaacaagtaatctaccctccatagtgaaaagtatttaacttaaatgacaactttggaaacacccaaaatactattataggcctttgtttctaaaaaagagttgaaatttcacgtccaatgtttcaagatcatgactaatttagtactttcaaaacagaactatgaagaaaactagcattataaagtgatttcaataagatatatttgagtcacccaatattttcatctgcaaattagctaaatataatctacattttaaatattatccccaagagtaaaaacaaattataaattcatgttctaacagaagaaacaattgctcactaaggaataacccactgggcatggtggctcacggctgtaatcccagcactttgagagactgaggcaggaggatcacttgagcctaggagttcgagaccagcctggacaacatggcaagaccttatttttacaaacaatttaaaaatcagctgggtgtggtagcacacacttgcagccccaactactcagaagactagggtgagaggattgcttgagcccaggggctcaaggatgcagtgagctacgattgcaccattgcactccagcctgggtatcagaacaagaccttgtctccaaaaaagggaagaaataactctgcaggttgctgaactatgcaaatacttaactacaggcactcaatacaaaaacaaattgaactgtgtgataattctcaattactttgttaacaacatatatacaatctacccaaaatggtcccaatttaatatagactaccaacctaaggtgaagtttagcgttaatttacaaagacaaatattgttttagtcaaaatataagctgttggggaagagattcattattcttttcacttccaaaaaatgagtaaaaacacgtattagcttcaccttattagttttaggagctgtaattaccacactccacagatatctacctttagaagaatttctgcatttattgttaaaaccctcccagcaggtacatgtttttccttaaaaaggtataagagaggataggctcagtggctcatgcctgtaattccagaactttgagaggccaaggccagcagatcaacttgaggccaggaattccagaccagcctggccaacatggtgaaatgccatctctactaaaaatatgaaaattagccaggcatggtgacaggcacctgtcatctcagctactgaggaggctgaggcacgagaattgcttgagccggggaggcagaggttgcagtgagctgagatcacgccactgcactctagcctgggtgacagagcgagactctgtctcaaaaaaccaataaaggtctaggagataaatcatttcaagctaagaccctccatgcaaactgaatagcatgacatataagatcttatgggacctcattttccaatccttcccctggtcattgaaccctcctctcctttcaatcctttgcagatctctcacacgacgatgctatttatgcctcccacctctgctgttttacttcttctgcctagaaggccctccctagaagaaatttatagaaaattgctataaatgctttaaaactcagcttcggcatgcttcctctgtgacacttaaattccacagcgcatcatatctgcctctgtgacactttatctttttaatgatgttttctttcatcattttcttcttcttagtctttgagttcctaatcatacttgtatcttcagtgctaaacatagagctcaataaatatcgatcaagtcattaatcaatcattggcaaaattcagcaatatgcttagagaataagttctaagataacttgctttcataagaaatagatactttaagtgtttactatgaatagtcaaggcatgcacattttccaaacactattgcatttaatcctcatgacagtcctctgtggtgatatcatagttctcatttccagaggaagacactttggccagagagttctgtgctctttccaagttcgtacagcataatattgagagcataagacagtatgatcacttactttctatgagatcttggacaagttacttaacctcgcctctcttagcctcagtttctaaagctgtacaaggcttaacagtcccctaagaggtgagtcatgactcctaaacaaggcaatgtgtgcaaggtgccagatactctctctgccatgtggtaatctctcaaccaaaacgtactaattattatttgtctcttaccaaaacacacaaaataatagattttttaaatgaaaagcaactgtaggtcacatgatacttgaatattttaggttgcataataatactggacctgataaagtattagattggcctttcacaaaatgatagcttatcactaaaataatacttcatcaacagagttaaaattaacagaaaaaaaaatcgtggagtttttaaccctaaactaccaacaagaaacaaacaaacaaaaaagatcattaatgacggaatatatgaaacaaagtagaaatcattcataaatcttgactgtctcagaaaataatgtcaaataattttaaatatggaaagtgtctatagtgttgggcattatattccaattgcaaaacaaatttgcaactggaagatgcccaaataaaatctgagtcactgtaacataatctgacataaaaattaataatactatattatattatattatattacatagatgaagaactttattattggcaaagcatgaatagaacacaacatttgacaccaaaataacttagtgagacgtattactaaggtaggctcaatcaggaaataagcaaagggaaggtctgatcttgaacccagaccttcaaacctgaaacctggagtttcagttatttcaactactttaaattcccatcataatcaccatatcataataagcagttgtaaataaaaggaataaaggtgtttggtttttacatatgtagcatttgagtagaaaagtgagactttatggacagcctaaaaatacaggaagggagaacgtgggcagtggaggtcttaaatgtcagtaaaattcctattataatgtcaaacaataaaagaactcattagattgcatcttaaaagattctatccaaaatatgttcactcctgtgcctgcaaacaatcatagctaaatcaccttggctgcctatccttcacttctgcaacaattgcatcccagcgttggtttaaacctgccagtttttctttcaagaagcttccatctgcctgggagagtttctgcacaatcccatccccagttcggtttagtgctgcaaaactgggctggtggctgctgatgcccacctcaagttcctgtaacagagcacaactcaagattagtttcactaataagtaaatgattctgatgcaatgaatccacccaagtattgtggtatcaatttaagtgtgaaagaaacaaactcctggaaagatattttatgttagaaaaaaaaggcattttaaaacaatttaattacatttcaatgaacatgctaaatgaaatttattttgaaatctaacccaccttcatgaatgtcatcaggcaaaatacaaggaaatagggcagcttaataactaaaatgaataacagctgtttacattaaagcataagcatcaatcatgtttgatgaaaatgaattgctcatcttctttcaagcaagtgcttgaaggcattgctttaaaaaattatataccccaataaatccttatatccttgtgtcctaccacatacaagtaaacctaaatgcacattttactaagatattgcttcactggttgatatggtttggttgtgtccccacccaaatctcatcttgaattgtacctcccataatccccacatgccaagggagggacccagtgggaggtaactgaatcacaggggtggttaccctcgtgttgttctagtgagagtgatctgatggttttataagggacttttcccccactttgctcagcacttctctctcctgccgccatatgaagaaggacatgtttctttccccttccaccatgactggacgtttcctgtggcctcctcagccatgctgaactatgagtcaattaaacctctttcctttataaattacccagtctcaggtatgtctttattagcagcatgagaacagactaatacactggtctacaaatgtttaagtaacagattgaatgaatattttcaagtcaaatttaaacacttatctgtaactccaaaaataagaaaaatgcattaacacatttatttatttatttatttatttattgacacagtattgctctgtcacccaggctggagtgcagtggcacgatcttggctcactgcaacctctgcctcccaggttcaagcaattctcctgcctcagcctcctgagtagctgggactgcaggtgcgttccaccatgcccggctaattttttgtatttttagtagagatgggttttcaccatgttagccaggatggtctcgatctcctgacctcataatccgcccacctcagcctcccaaaatgctgggattacaagtgtgaggcaccgcgcccggccacattaacacatttataagaaaaacaaatgaattatctttaaattgtcatgtccttctaaataaaatacatttaaaaaacttaataaaagagaaaatatttttatcaatggtagaattgaaattgcgtgtgctttctaccattatttttaaagacctattgttatcagaactaactttgtgttatattttcccaagactgaattagacttacatgagcagctgccctgctgtcgctccagaataatttactttatgataattatcaatgatacaaagaaaaatgagatgcctaagtgtttaagtacaaaaaacagaggtgaggcatgcaaatattttttctgttcttggtatagtcttaggcataacagtttacaaattttattctaaatataaaattgtttaaataaaattgtttttcacattagccaccaaggagtatttttatttaaatttctttgaaatcctgattgaaaattgtgattgaccaatttcttaaacttttataactggtaacaagaattggaacaaaaattacaaattgtccattgacttctgaaaaattaatatattttgtccctacttctgaaatctgtcttaacaggcatacactaaccatatgtgcagtccccctcctctaacagaaagcactcacctgctgatgtatcctggctttctctaagtccaggctgccacctggagcacaggtatcaaccagtaattcttcagcctctgttatccactgtgtgaggtcattaaggtcacaatggaactgtctccattcttccattgccctgtcaaaacaactagaggacaatacacaaaataaaataggtttccaaattttccaggactgcctaaagccatttttctaaaaaagaaaatcaaatttcatttaaacagaaagacctcaaacaactgaattcacagcctattgctccacaaaaccaattttcgtagtgggatacaggtaataattcctcctagagatatatgcatcataacaagggcaaagcaatctgctcacaccaccagctaccaaatcctctctctcatacacacacacatgcacactcacgtatacacacatgcacactcacatacacactcacaaacacactcacacacacactcgagcagctttttaactaaaaagatgcagccttttctggcttgaaaaatcaggatcgattagttgtaggcatgttaacgcatccaactttatacatttaacatttaaatactgtgaaatataaaatatgattcattattttcttggggaaaaatatgttgttttactaccagaacacttagttcccggcaagaataaagcacaaaaggccaaaacacttcaaaatgcccgtatacccctctatctatatgttatatactgaattatgtccaatcaaaattcttatgttgaagccctaaccccacagtgtgactgtacttagagatagagctttccaggacacaaataaggttaaatgaggtcataagtgtggggctctagtctgaaaggactggtgtccttataataggtggaagagtcaccacagagctctctcatgtgaggacacagcaagaaggtggccatctgcaagccagtaagagagacctcactagacaccaaatctactggcaccttgatcttgaacttccagcctccagaactgtgggaaagtaaatgtctgttgtttaagctacccagtctatgttatcttataacggctgcctgagcagattaatgtacttcgggtaatgactggtcctgagggtcccatttacctaaatacagcaaagtatgaaattgcatgcagagcccgttatgcaataagacagagggctattgagatttctgtttaaaccaaactcttttaaagatggcaaagtaaaacccagtgcttgttatattcaggatacatgaaataagcataaaaaggaaaagctttattggaccaggatcctaaataattttttctcctatctttttgtttaagagtaatggagctgagttttagaagtgatctctgagatcttaacaatattaataaaatatatattttttaaataaaatggctcctaatatcaataacccctaaataatgtgtatatcgtctttctccatgaaaattacttttaacattttgctaatactgcccacagtaaagcaattttctattgagcatggaaaaagaaaagcacttaaaaaaaaggcactatgaggtgatattgacactcattatcatttgcaaaaattcacaataactacacaacaatcacaatttccaaattcgagatgctataagactgttccaaagatctaaagactttgaaaatacaaacattaaacttagaatgtatcatcagtgacagagagaaaaaaaaatggtggataggaggaaggtctaacttgcagctcccactcagacaaacagcagcatgtgcagacacatagtggacttttgttccaagaactaccgcaggaacataccaggaaaactgagagaatctacagaccctttgaaggaggtggaatgctgctgcatgctgcatgggagagccgaggaactggagatcagcttgcgttctcagctgggagacttgtcacctggggcaagttctcaaccctgctcaccagctgcctggaaataaacccaatgctgttgggccagtgggggtgtgggggtggcggaaggggttcctgataggactaagactggccttttgggccgtgggctgcatggaaactgagtgaggcctgcaactgcacgctttccctcacttccctggcaacctgtgtgatgcagcagaggcagccataatccccctgggaacataactccactggcctgggaaccacacccccatcccccatagcagccacaacaagccatgcacaaggagagtctgactcagcacctaaccctgcccaacctgatggtctttctctactcgccccagtagccaaagacaaagaagataatttcttaggagctctatggccctgcctgccgcctaatcctctctatgctactgcagctgatgctctcttgtaagcaccatctcctggctgggggccaaccaacagaaaaccagcgaacttaaccaaaatacaaccaaggactctcacagaggccgcttcactcccctgttacttccaccagagcaggtgctggtatccacagctgagagacctgaagacagatcacatcacatcacaggactctttgcagacacttcccagtacccgctcagcacccagtagctgtgctggatggctagcttcagaagataaataataatcactgcagttcagctctcaggaagccccatccctaggggaaggaggagagcactacatcaaggaagcatttcatgggacaaaagaatcaggacagcagccactgattcccagatcttccctctgacatgctctacccaaatgagaagaaaccagaaaaacaattatggtaatatgacaaaacaaggttctttaaaatacccaaaaagatcacactaggctgggggcagtggctcatgcctgtaatcccagcaacttgggaggccaaggcaggcagataacctgaggtcagcagttcaagaccagcctggccaacatggggaaaccctgtctccactaaaaatacaaaaataagctggtgtggtgatgcgtgtctggaatcccagctactcaggaggctgaggcaggagaatcactcaaacctgggaggcggaggttgcagtgggctgagattgtgccattgcaactccagcctgggcaacagagtaagactccatctcaaaaaaaaaaaaaaaaaaaaatcacactagcttaccagcaatggatccaaaccaggacaaaatctctgaattgccagaaaaagaattcagaaggtcgattattaaaccaatcaaggacacaccagtgaaaggtgaagtccaacttaaagaaatcaaaacaatgacacagcatatgaaggaaaaaatctcgagtgaaataaacagcataaataaaacaacttttggaaatcaaggacacactcagagagatgcaaaatgcactggaaagtctcagcaataaattcgaacaagtagaagaaacctcagagctcaaagacaaggcttttgaattaacccaatctgacaaagaaaaagaaaaaagaattttaaaaaatgaacaaagcctccatgaagtttgggaatatgttaaaagaccaaagaataatttgtgttcccaagtaaaagagaaatccaaaagtatctaaaacatatttgcaggaataattgaggaaaacctcccggctttgctagagatctagatatccaaatacaaaaatctcaaagaacacctggaaaactcatcgcaaaaagatcattgcctaggcacatggtcatcaggttacgtaaagtcaataagaaggaaagaatattgacagttgtgaggcaaaagcatcaggtaacctataaagaagaatctatcacattaacagaagatttctcagcagaaaccttataagctagaagagattggggtcctatcttcagcctccttaaacaaaacaattacaagccaggaattttgtatccagtgaaactaagcttcataaatgaaggaaagatagtctttttcaaacaaatactgagagaatttgctgctattaagccagcactacaagaattgctaaaaggagctctaagtcttgaaacaaatcctagaaatacaacaaaatagaatcttcttgaagcataaatcttggccaggtgtggtggctcacgtctgtaatcccagcactttcggaggctgaggcaggtggatcacctgaggtcaggagtttgaggtcagcctggctaacacagtgaaaccccacctgtactaaaaaatacaaaaaaaattagccaggcatggtggtgggcacctgtagccccagctacatgggaggctgaggcagagaactgcttgaacctgagaggcagaggttgcagtaagccgagatcatgccactgcactccagcctgggtgacagaagaagacctgtcaacaacaacaacaataaagcatagatctcaaagaacctattaacaataacaaaatgaaaaaaaaaaaaaaaccaaggtattgaggcaacaaatatcatgataaatagaatagtacctcatatctcaataataacattcaatgtaaatggcctaaatgcttcatttaaaagatacggaatagaagaatggataaaaattcaccaaccaagtaactgctgtcttcaagagactcacccgacacataaaaactcacataaacttaaggcaaaggggtgcaaaataacagtccatccaaatggacaccaaaagcaagcaggagtagctattcttatatcagacaaaataaattttaaagcaacagcagttaaaaaagacaaagaaggacattatataatgataaaaagactagtccaacaggaaattatatcctaaatatatatgcacctaacattggagctcccaagtttgtaaaacaattactactagacctaagaaatgaaataaacagcaacacattaacagtggtggacttcaatactccactgatagcactagacaagtcacccagacagaaagtcgacaaagaaacaatggaattaaactataccctagaacaaatggacttaacagatacttacggaacattctatgcaacaactgcagaatatatattctattcatgaacacatggaatattctccaagatagaccatgtgataagccacaaaacaagtctcaacaaatttaagaaaactaaaattacatcaagtactctctcagaccacagtggaatgaaattggaaatcaagtctgaagggaaccctcaaaaccatgcaaatatatggaaacgaaataacctgctcctgaatgatcattgggtcatcaatgaaatcaagatggaaatttaaaaattctttgaactgaacgataatagtgacgcaacctatcaaaacttttgggatatggcaaaagcggtactaagaggaatgtgcatagcattaaatgcctacatcaaagagtctaaaagagcacaaatagacaatctaaagtcacacctcaaggaactagataaacaagaacaaaccaaacccaagcccagcagaagaaaaaaaaataaccaagatcagagcagagctaaatgaaaatgaaacaaataaacaaaaatacaaaaaaaaatgaaacaaaaagctggttctctaaaaaaataaataaaatttacagactattggtgagattaaccaagaaaagagagaggatccaaatcagttcaatcagaaacaaaatgggtgatattacaactgatgccatagaaatacaaaagatcaaggctattatgaacatttttacatgcataaactagaaaacctagaggatatggataaattcctggaaatatacaaccctcctaaattaaaccaggaagaaatagaaactctaaacagaccaataacaagcagcaagattaaaatcatgattaaaaaattaccagcaaaaaaaagcccaggacccgatgggttcagagctgaattctatcagacattcaaagaagaattggtaccaatcctactgacactatccaaaagatagagaaagagggaatcctccctaaatcattccatgaagccagtattaccctaataccaaaaccaggaaaggacataacaaaaaagaaaactacagaccaaatccctgatatagatgcaaaaatcctcaacaaaatactagctaactgaatccaatagtatatcaaaaagacaataaaccatgatcaagtgggtttcatactagggatgcagggatggtttaacatacacaagtcaataaatgtgatacaccacataaacagaattaaaacaaaaatcacatgatcacctcaacagactcagaaaaagcctctgacaaaatctagcatccctttatgattaaaattctcagcaaaattggcatagaaggaacataccttcaggtaataaaagccatctatgacttttagcccatagccaacattatactgaatgaggaaaaattgaaagcattccccctgagaactggaacaagaaaaggatgcccactttcaccacttgcattcaacatagtaccggaagtcctagacagagcaatcagacaagagaaagaaataaagggcatccgaattggttaaaaggaactcaaactgttactgtttgctggtaacatgatcatatacctagaaaaccctaaagactcatccaaaaagctcctagaactggtaaataaattcagcaaagtttcaggatacaaaattgacgtacaaaaattagtagcactaaaaatttaaaaatgaaaataaaattgagatgtaatctatcactattaaactggcaaagtttttttaaataataaaaaaaaaacctgtcaatgttagtaagggctcaaaaagaaggatatttttacaaatactgttggcaggggtatagtaaccaatttcatgatataatacaggggtttaaaatgtcattatttttaaagaaatttgtcttcatctaatgatcaagcctaatgaaatataagtatggataaagatgtatgtaaaagaatgttctccaaaggtacaaagagaaaatttgtaaaatccaaacaaaggaatataccaaaggccactaaaagctatcttttcaaggattagtcacattgaaatatgtaggctaaaatagaaaaaaagagaaggaacatgatgcctagtttttgtgcgtatgtctctcaagttacccaatgtattattctgtgctccctttcctcttatacagcgctttccactgggttatttcataacttatttgcctttccatcacatccacagctactggcaaaaatcttgcctgttttcatttctacctattaatagtcctggtcaaaatctagtaagaaggctcaaaagcattcatttaaacagaaggctataaaaaagagtttggtactatatatggattctaattatctgtagctgcctctgttcttcactcacattaatcatcaagtgtgctgagaaagtgaacattaatgaaaaatttctttagtttttttaaagagaatggacactatttagacactaaaaattagaagtgcttccatatcattaagatattatgttataaatggtcatctatacatgatcacattcctcctttaaggaactatactcatcacaatttattaaacagggcataaggccgggtgcagtggctcacacctgtaatcccagcattttgggaggccaaggcaaggcggactgcctgaggtccggagttcaataccagcctggccaacatggtgaaaccccatctctactaaaaatacaaaaattagccaggcgtggtggtgtgcgcctgtaatcccagctacttgggaagctgaggcaggagaattgcttgaacctgggaggcaaatgttgcagtgagctgagatcatgccactgcaccccagcctgggtgacagagcaagactccttcttaaaagaaaaaaaaataatagggcatcctacaaggatatgaaacatgttctcattaatctcagtgtccacatgatcttcttcacgcccatgaacttgcaggcatttttttaaattaaatattaatttcatttacacataccctttccgatcactgtacattctattaattctgtcccattttgcattcagctgagtaagtgtatctctgatctgaatggcttcaggtccagaggcttcaaggatgacatctggctgtttttcatgaatgactgcaatctgctctccaagtttgtccagttggtctttgatattctaaaaatatattgtcatagattaacaaaatccagcaaagtaacaaaaaaaggaatcacagatgaccagatatttatattgtagaacactcatttgaaataataatgagacataatcattgttaatcatgaaaactgaaaactttttttttttaaatgatactctgttttaaccaaagtgtgtggaatatgctacataatatactcaaggcaggaaaaaaagtcctcacaatagtagcatttgtacagaacacatgaaaggcttcagtaacattctctataggtaatgaggcatttgaagctggaaatagtgatattttcaaatatctaataatgttagtttaaatgagaggaatgcactatcaaatccatattatcagtgaatttattgtgattttacatataaatgcaatcaagttacatgaaaatgccttgctagaatttaagtttaattaacttacaatcaagatgccattccatacctcaactggccaattttaaaccattatagattgcctgataaatgctgacaattaacatcaactgacaatctagtttataagacaggaaggtggtctatgtctctgtttaattttaaacaaggctctgatgttgcaaataatttataactgtgcacatttaacaatccatacccactttttaaaaattcaaaatttaatatattttctttgacaatataggaaagctttactagtcatacatattattaatcccctggcacaaattgtaaaagatatagaccatctaagtaggcacaagaacaaatttcttcctctacttctacattaactgtggccattcaaacacagtgcccagaggtctaccttcagagagtcttcctgaaaagagaagtcttcgtaaatagcagtgttgagctctggaacattaagcgataattcaacatcatccatgcaaagtaaaattttgttaatttcaaccagataatctgtaggaagaagtgatgatctaattccagaagcaagttgacccattttcctctgttgaatagggattgcctacaaaaacagcaaaaaaaaaaatatatatatatatatatatctcttaaaatacccccacaatgaataataacaagactattgtgtgaaggaatgcaatatcatgaaccaaatttttaaaacttagttttaatattttatattataaacctaccttgcaacagaaaaccttaacaatctgtatcctaattttcatctgcagcatgatattaaacagtataagtatgttattaatttgacaggctttaagatctatgccatctaaactcagttagcaaacaaaaaacaacaattcctttcttgagttgttgaaagaatgagaatatcctgccaatcacaaagttttgtatgaaataaaacattttgatacattatttcactcttttaaaaatatcacaattttaaaattggacctcattgctaaaaatataagcaagttaaacatgtttccataacacaacatgaaatgcacaaagggttttgattaaagtaatatccaggtaattcagtatgtaatcttaatctctgagaataatattatagagcaggaatatcctacattagaaaatagatcatgaagtgtcatatttagacagacttgaggctctatggactactcatctgccctaatatagattttctggatcctcttctcagagctttctttttcatttttatttttttgggggggtgcaggacagagtgttgctctgcctcccaggctggagtgcagtgctgtgatctcggctcactgcaccgtctgcctcccaggttcaagcgattcttctgcctcagcctcctgagtagctgggattacaagcatgcaccatcatgcccagctaacttttatatatttagtagagatggggtttcaccatgttggccaggctggcctcgaactcttaacctcaagtgatcagctgacctcagcctcccaaagtgctgggattacaggcatgagccaccatgcccggccctcttctcagagctttctaaacaataaagtgctctctgggatggaccgccagtccttcaggagttcaaaccctttactcctagatggccacaatttaataagtgctacgtattaccacttgcaaagggccaaactgcagctgctcatgaattaaggtaccttccttgacactttcacttctcctatgttgaacttctaaaaaatgataatcatctgtaaattcaagatgataggtaaaacgatcacaaatgcatgttaattcagttagtgatcttgaaaatggttacaatccaatctctaaaggaatccaagactcatgactaaaatcattgagtggataacatggtgttgaacctagaggactgcattattgcctcctagaatttgttaaactactgcgtccatcatttgagggtagttctggatagccaggttagaagcaggtctatacatttcttgactttaacaacagaactaattacacttgtctccaagattaattttattatcctaatgccgcaagtttaaattttagtcagaaagcatttctagatatttacccatatgtctaaggaaacaaattctgtgttttaagcaaatataaaagaatgctgaaataaataacatatctacccagaaaccagttatgaataaaaagatgctaagtattttttaagaaaagaaaaaatcaaaaataattcttttggattttcatttcaaataagccagtgtttttattttggaagatcagaaaactaggctcaattgttctccctcttaactttaaggaaaagaaaatagcccaatgaaagtatttctaggttgagtaatcatgtcgaaaaagtaaaagaggaaagtgggacccgttttccttcttggcttcccatccattaaccaagattttgctgaaaggtcatctgttttccaaaagaccaaaaaactccagacatccaactactttattatgcttgtagggacatttacctttgtagtactttcctcatttagcaccactagataatacatgccacatttgttttttaatctgctccattaggtaaatgttgggagccacttttatacctcagctactactgcaagactggaattcctgtgctgcttcttcagttacataacggattgtcattctgcaagaccacgtgtacctgaagctttagaataaactagggaggttagtaggtatcataaagatccaagtttaaaaaattcccattcattaagactgcctctttttcttttcagactataggacaatccaggatttttctgagccttcccactcttgcagaagcagcaaggccgttcaagacttaaacatgtgctttctgtattcccaaaatagatttttttcccccaagagagtgatcaatcaaaatgccctaggactaaaaaaatgtcctcgagatctgaccgagactttacttctggacaattttatttttaaagaattctccaaggacacagaaacacaaatatactagaggtcagtacttaaatgagacagtgttacatgacgtagctcacatcatatagcaaagattaaagagatttttaagtgagtgttttattaaatttctaagttttgtttttaccaaaccataggaaaaacctggaactaaacagaattgaatattcatcaactttctggaggatgaaaactttttagatcccaaaacagaaacccctgaaaaatcactaagggaaaacatagtcacctgtggctaaacaaaaattttaaatggttatatcttaaagataaaataattagaagataaatatcaataagataatattttatagcaattatggcaagtggttaatatctttataaagtgctcatacataatttaaaaacagtaatactctagtaaacaaattggaaaaggtcacttaacatatatttcaggtaagacaatgagtcctgtaaactagtgcttctcaatcctaattgtacattaaaatcatctacaaatgttttgtgttttgtttttgtaaatgcccacacctaggtcctgagagattctgatttacctgtttcaggaattagatttgggcactgtagtttttttaaagctcccccacagtaattctcatgttcacacttaagaatcatataagtttgaaaactatagatttgaagtttgtaacatagttcgcctaccaatgttagtaaagccagaatgaaattagcttgtatagtatatattagtacttttaacaaacaaatttatttatgtattaaaagcttaaaacttatttctattttgtgccagtaataatttctgatttcggacccaaagatgaaaaagatattgcctgaacttggagaagcattagggaagaaagatactttaaaaagtcacaataaagcagagaactataatataatctgacagaagttagaaataaaaatggagctgagttttaaaagataacgcatttttcagctaacctaaaaagacaaaactcactctagggaatcggaataaaattaataagttcccagatgtgctaaggcacatgatgtgtttaggaaaatgtaaagaaaaaccagcatagctgtactacatgggaagtgacagcacatcaaagacataaggagccaggggtcagactgaagactttgtatgtcgttatattgacagaccttgcatttaaagctttttctgtattttgcaatattttcctaaacagtttcttcgatgaaggaatgacatgatcagccatgactttggggagaataactgtgaggaagagacaaaggacatgctagagtgagaaaaaacagacataagaatatgtccatgggatataatatcatgggagaaaatcattagtctaaattatggaaaggatagtgaagtaaaataagctaaggcactttctgatggtcataaaacaagcagctggtagagcaatatctaacttcacgttcaaacctgtatgttgcttcaagcagtctcaacagttttaatgcctactcagtgtgatgtgagaagatatgtgaggaacaagaaatagttaagaaggatgttgaggcttcagccttgagagaatggctagtttttaaagtatagtcatgcattgcttaataacagggacatgttctgagaaatgtgtctctaggttatttcattgtcatacaaacatcatagagtgcccttacacaaacctagatggtacagcctcctgcacacttaggctgtgtggtatagtcaattgctcctaggctaaaactttacagcacgttattgtactgaatactataggcaattctgaaacacagttggaagtatttatgtatctaaacatatctaaacatagaaaaggtacagtaaaaatacagtaccataatcgatctacttaatttccaaagtcatcaaataaaaatcgttctagaaggaactaccaaagaacggaccccagggaacaacagcacacttaaaatgcagctagaaagattgccgtttaaaaaagagctggagctggatatggtggcccacacacctgtagtcctagcaacttgggagactgacataggaggatcacttgagcctaggagttcaagatcagcctgggcaacatagagataccccatctttaaaaaaaaaaaagaaaaatataaagaaataaaaagggagctggtagtgaatctttactagaatataaatcatattacatcactttcacaaactgagttatttttaaactagaaattttttttgacatagacaagaccttcacaaataaaatatggaattggaggaagccacttctgaaatagatagatctcttttaggtttgataacataatcagaaatccaaaagagatggccaataataaggttttacatttccattttgagttctgcaccatccaaaaatatgaacacatctagtaacacacactagaaaggaggagatgatattccaactggtgtgttttaaagcatctgtgatgcagcatcacacatctgaatggcaagagttaagtaaggtatttaaatgcaacagagactctccaatcataataccttaattttgttgtatctagtatgcaaaagtaataattgcaaacggatcttttcttttttattatcttccataggttgatgtaacatttcttctcctctttgtagaacttcctcaatctgggcactctcctcatccatctaaatttttaaaaggaaaaaaaaaatgactcaaaagaaaaatgcataaggtcacttcctatcaactcctaaggaggaaaactaacctacttagtatagtatacgtcaagatatgttaacctgaacgatcaaaaaatttatgttttttttaaatatattttatatttgaagataaaatgtctcaaagagagtttagcaaacattagataatactaaggattatgtctagttcagaaactgagtctattttctttttaagcacatgaatcatgtgactcttacattgacacacatcaaaaaatcacatttgaatctgtttcatcatgtttgacagattatatgggcaaacatcttgatgtaaaaatgaaattaatagagaagaaaaatgagaccaccatggttttgaaatctccttgaaccaaccttttcatcttcatcactggattccaagtgtttttccacaaattttaacatattttctatgtcattttctaatttttccaagtcagagaaaggcacaccagtttcaaatgtttcagtggtgaccaaacattggtataatggttcctgagcaattagcaactgtagaaggaaaagaattctctgaaaatagatttttaatttgactttccatcattaatcagagagatggggtgtcaagagagaaactaacacttttttaactgacttttctattcagctcagctaacttttgtttcattcatttatatggcaatgattttaccaattcagacttctctgaatgacccgttttctccaaactctagccagggatgtgacgtagtattgcaattcattgtggctgcccagagtgttgtggcgtggatttggagaccacatgcgagcatagcaggaaactatggccatgatccagaaactatccttaccatggccacagaaaggaagaacagccacccagcccccagggcagggacacctcacagaatgtctcccagttaagtttcctcagtagaattccccttggattttcatacacaaacgtcaaagaagtgcatatttctcaatgtcatcttttcagataacatctacgtagaaaaattttatatttgtttaaataaaactcaataaaacaattttaataaaactaaatgcagataaataccatctggggttggctaagtgtgggaaaactagcactctcataaaggtcctatttattaccctgttaattaaatgtctaaagctctttattaaatttataaaatcaggtagtactttcctacattaggattaaactgtgaaattatctgtaacttttagatttgtcgtcatataaaacaaaaaaaaaaacaagttctgtggtgtgtgcaatgtgaagacatatatagagtgtgaccataaaataaagggtttaatattcatccctagcttgggaattagtttcatcatttcataaccaattctaacctttgactgagtctttgaaaccttttctcaaataggttattttcttcaatactaattgcttgttttctctccttcatatgcacaatcacaaataaatacggacaaatgctccattcaaagaaaaagtgattaaaaacattttaatttaaaaattgttggccgggtgcagcagctcacacctgtaattccagcactttgggaggccaaggcgggcagatcacttgaggtcagcagctcaagaccagcctggccaagatggtgaaaccctatctctcctaaaaaaaacacaaaaattagctgggtgtggtggcagttgccggaaatcccagctacttgggtggctgaggcaggagaatagcttgcacccagaaggcggaggttgcagtgagctcatgccactgcactccagcctcggtgacagagagagaaaacaataaaattaaaataataaaacaaaattgttgatgtatgtactgtatgactatcatttagatacatacccataggaaaaatggtttactctaaaagcataattactcactttggcacttttgatatgttgagacaccttttcaaagttcctattcagctcagctaactttggttctacaagctccctgcttgagcttccacgggcattcatcaaaataagggcttgatcgcggacattttcaacctggaggttggcatcatccagctcagatactaaacgctaattataagaaaacacaaaattatctcatgggaaaaatcaaacccaaacatgagtgtgatgcttatacagaaggaaaggtagtttaaataaatatctgggatccccagtaagagatttcagcataatcaaccaggtgagagctgttcacataggactcattggagaacacagaggtaagtaattctcattggaaaatacagaagtaagactcgctggagaatacaaaagtatgtaagactcattggagagtacagaagtaagacagactcattggagaatacaaaagtaagtaagactcactggagaatacagaagtaagcagcactcaatggagaatacaaaagtcagcaatcagcaagactcattggcatcttatgtgaataggtcttactccggttgattgtgctgaaatctcttacaagtctttcaatttcaagttcgtctcttattttgtctcttattgtctcagtttctcccatcaaaataaatgttaatgaatctaatgcttgggaggaatgagagctaagtaacttagagcattccagaagagaaaacatgacaacaaaacatgccactcccaaaagcgttactgatgtctgtgtttgctaccttcacaatttcttcctgtttacttgttggtttcttttcaatttcatccaatagagcttcagcttgataaagccaggtacttatgtgagccacgttcccatcaaatatttctagctggttctgatggttctacaaaggaattaataaaatgcttacataaccatatgaaatatttaagatgataatcttaaaagagatttaaaagaccttcaaagagcaaactgtaccatgaatttaaaggagagctttcaccttcctgcagagctcttcttcagtgaataactcatcttattcctaaaaatgcacatctatggtgcttaacactttttaaatttatttgatttagacctcagcacaataaaaagttgaagtagaataaaaggtgaaagtttctttttcaatttcaatgcaagttcatctcttattccttattcttatattacaactgatctgatttgccctcttcaatctttttttcttttttcttttgagatggagtcttgctctgtcaccagcctggagtagagtggcacaatctcagctcactgcaacctccacctcccaggttcaagtgattctcctgcctcagtctcccgagtagctgggactgcaggcttgcaccaccatacccagctaatttttgtatttttagtagagacggggtttcaccatgttggccaggaagtcttgatctcttgaccttgtgatccaccttcctcagcctcccaaagtgctgggattacaggtgtgcgccaccacacctggcccatatttttaaaaaactcatttaaggaataattttttaaaatgatgaaaatatgaattgaaaaagattctgtatgctctgctcaaaggacagtgcctttgtatccttacctcagtatcaccagcccttaatattacatctggcacagaccacagcaagatgtactgaagcaggacatgaaatgtgcttgacagaacagatttgaaaacagaagcaagagttaagcagattatgactgggaaaaacagttaatctaaggcaagaagttagagtgtgaccaaaaagggtaacgagacttatgatgaaattaacctttagcaattatattttgtgggataaaagaaactggaaaatgcttagacagtaaaagtttttacaaagaaagaaatcattaatctataatatgaaacatagttgaaaaaagaaaatgtaggctgggtgtggtggctcacgcctgtaatccagtactttgggaggccctgatgggaggatcacttgacctcaggaattcaagaccagcctggacaacatggtgaaaccccctctctacaaaaaataaaaaaattagccgggtgtggtggcgcatgcctgtagtcccagctactctcaaggctgaggtggaaggatcacctgagcctggggaggtcgaggttgcataccactgcactccagcatgggtgacagactgacacccagcctcagaaaaaaaaaaaaagtgaacaaataaacaatataaaaataaaacaaacttgcccttgtacccctgaacttaaaataaacatttttaaaaaaagaaaatgtgaactaataaatgatatgagaaaatatcaacagtgatctggattctaagtaggaagaactgatgagtgccagacttgtttacccctattaagcaggtaaatcaaatgttctaacagcactagaaagatactgcttgaatggagagtttgaaaggtgtagactgaagaatacagaaataagggccataagaatgtgaaataaagctagtaattaaaaattaatatataaaatatttaatgagcatattctatgtgccaagaatctcatattcactattatattcaatatttaacaactctgttaggtatatacttttgttctcattctgtatatatggaaatttaagcttagtaacattaagtaacttagctaaagttaaacagataataagtcatggactgtggatataaatctgttagagatcaagagcaaagcccatgctcttcactgccctacacatcctgaggaatttaaataaatattcaaacacatgataatgtattttttatgtctctatccattacctagtaattctataaatttgataaaagtcctatctcaggtatttcagaattaaaaaaaattataaatgacaatgccttcctcagcaggggagggtggggtggccatatattcacaattagtatcataggaacataaaaccatataaaaattaaatggtaactatttccatgagatgcaaatttacagagcagtggcataaccaaagactaacacatatacaatatttaataattataatcatagcaaaatctaaaattggttgttttgcatatagttatttaagagcactacatgtttaaggctcataatcaatcattgcaaaactgtatgagatagatataataatgtccattttacaaattaaacaactgaggtttagagaatgtttaagtaactttaccagtgttaccaagctagtaatgaaaatttttacataggccgtcagatgctagagcctgtgctcttaaccagtatgccattattcaaacactatgaagattttatataaaaatagcttctgatagtacgaaaatcaaatacaatatgaaatcattaaaatgaaacaaataaggtgcatttactaaaatatgaaagtacctcattccatgcagatcatgaatatttagaaacactgtaaattctttctagttattacctttccaaagaaaaaataaaacctagtctaatgaaattaattcacaagcaaaacatcactgtgacacacagtaaacaggatttgaaatttaatcaaagttgtattcatttaaaaaataactagaagagaggagaagatttcatcatttactttttcctgagacataccatcaaggtattgcaccaatcttcagtccaggtacgaactcggctccacccagcgttaaggacgcagagcctctcttctaaaataggctcactgccctcaatcaagttttgcagggcagcactactctctgtgatggtatttaaatcagcttttctcttttccagatccttcagaacattctagaaaataaaaacaccaagacctacttgatgcttcagaatattataaaagtatatacaaccttaaattattaaaaacttttctgccacatatacaaagtagtccatgactccctatataatttacaatgtcaaagtttacaaaattcccaaacttattaacatagtgagaattcttaagttccaaatggaaaacaaaatgtgtaattcaacaaataccagtgagtgtaacacactcagctgtgggaaagcaattatttcatttatttaaatataaatccatttattacatatgaatgccaattaccttcatcatcactctaaatgtaaaggctcaatttcattttcagtaactacaagctggcaaagcagaaggatcctagaactcacaacttaaaaaaattcacaatgaatttatctcctagattaccagaggaaactatcgatgtgtactataggtacttgcaaggataacatcttacagctgggtgatttcacatataatatactgaataaacattacaaaaaaacatttcatgtaagtaactcacaagagagcagcaagtctaagctttggtcttacaactgtcataagtgcaaagataatactctggatggtatgatgataaagtgatcggcacattcgtaagtttcaccaggcaaagtatatagtcacagaattatagagagagcatgagttccacaattaaaactacaaagctctttcaatcaaaaagcaatatgcatgtatctaccctactgctactattattgaccattttttaaatcaacatttaaaccaatcattttaaggagctcaagtttatatttctacattaaatcacaccttggaaagcataccaattacaaattcacaaatgagtccaggtttaaacactcacttggccatgtcaattactggcatatttatgacagaactgaaatactactttccaatattattctctagcaaggggggagaaaataaaggatacccaatagctatgctctcagcaattattaataagaatctttcatttcttcagtgggcatgtactgattgactagaatagcatttaagaactataaaaaataatgaactacaagtaattacatctaaatagtacacatacttttttacagtaaaaaagattacattgaaaatagttatatttaagttatggaataaaaacagtattcagaaatgaaaatattatttatttaagctttgcattgaaaataattttacataatctttaagtgcaaatacattaaaatgtggtgaaatctgcatgttccttaaatctgaaaagacagtgataaaaagatggtggttattaatatatactgatgtttcatttgatttactctaatgaagagaatgtgctgtgaatttgtgacttgtatatatcatctttatcatttcaattctgaaataagattaaatggaaacttaagagcatattgttccaaaagaaacaaatttttcattgctttgagtctttacctaaaaaagctatgagaatcagctgaaaaacaaattgaatttatgagtatatgaacatggatgtttaaaaattgaatatataaaatcaatatcacctatgtaccaacaataagcactctgtaaaaaaaccgaaaagtatatttttacatagcaataaaaatagatatgtaggaataaactcctgtgcatatatgaataatgtttataaagaaaaaaatcaaaacattatgtaggaatgtgaaagaatttaggacaaaaatgagacatatatgttaccgaatagaattaatataacaaagatatcaattctgcactacacaaatgtatgaattcaaggcaattcaaatcaaaatttccaatagaatttaagaatttaacaataaaaattctaaagttcatataagatatataccaaaaatgaagcataaagagagggaacccattaactgcagttaaaatatactataaaacatggctaaacattctaaaaactggtacatttcatggggccagatcagtggagcagaaaacaacgaaaggcaacaggaaaataagaatatatgaacttagcatgtcaaatccatggggacaaggttaattactcaaccaatagcactaagataattggttatccttttggaaagaaggttagagccttacctcacgaaatacaccaaaataaatactggaaagattaatgcattaaaggtaaaaagatgaaactataaaagagctagcagaggaggtggctggcaagatggccaaacaggaacagctccagtctgcagctcccagcaagaccaaaacagaatgcaggtgatttctgcatttccaacagaggtacttggttcatctcactggaactggttagacagtgggtgcagcccacggagggtgtcgcttcaccagggaagcgcaagaggttggggaactccctcccctagccaagggaagccatgagggactgtgccgtgaggtacggtgctatccagccaagatactacacttttctcaaggccttcacaacctacagacccggagattccctcaggtgcctacatcaccagggccctgggtttcaagcactaaactgggcagccgattggggagacaccaagctagctgcaggagttgtttgtttgttttttttcacaccccagtggtgcctggaacaccagcaagacagaaccattcactcccctggaaaggggactgaagccagggagccaagtggtctagctcagcagatcccatccccatggagcccggcaagctaagatccaacggctggaaattctcgctgccaggacagcagtctgaagtcgacctggaatgctggagcttggtggtgagaggggcatccaccattactgaggcttgagtaggcagttttcccctcacagtgtaaacaaagcctccaggaagttcaaactgggcagaacccaccacagctcagaaaagcaactgtagccagactgtctgatctctgaaagaagggtggcagccccagcaaggggcttatagagaaaactcccatctgcctgggacagagcacctgggggaaagggcagctgtgagcaaagcttcagcagacttaaatgttcctgcctgctggctctgaagagagcagcggatctcccagcacagagctcgaactctgctaagggacagattgcctcctcaagtgggtccctgacccctgtgcctcctgactgggagacacctcccagcaggggtcaacagacacctaatataggagagctccagctggtatcttgtgagtgcccctctgaaacgaagcttccagaggaaggagcagggagcaatctttgctattctgcagcttcccctgatgatacccaggcaaacaggtctggggtggacctccagcaaactccagcagacctgcagcagaggggcctgttagaaggaaaactaacaaacaaaaagcaacaacattaacatcaacaaaaagaaggaccatgcaaaaaccccattcgaaggtcaccaacatcaaagatcaaaggtagataaatccacgaagatgaggaaaaaccagcgcaaaaatgctgtaaattccaaaaaccaggatgtctcttctcctccaaagaatcagaactccttgctagcaagggaacaaaaccggatggagaatgagtttgatgaattgacagaagtaggcttcagaaagtgggtaataacaaactcctccaagctaaaggagcaagttctaacccaatgcaaggaagctaagaaccttgaaaaaaaggttacagaaactgctaactagactaaccaatttagagaagaacataaatgacctgatgaagctgaaaacacagcacgaaaacttcatgaggcatacacatgtatcaatagctgaatcgatcaagcggaagaaagcatatcagagattgaagatcaacttaataaaataaagtgtgaagataagattagagaaaaaataatgaaaatgaacaaacaaagcctccaagaaataagagactatgtgaaaagaccaaacctacatttgattggtgtacccaaaagtgacaagaagaatggaacaaagttggaaaacacacttcaagatattatgcaagagaactccccgaacctagcaagacaggccaacattcaacttcaggaaatacagagaatgccacaaagatactcctcctcaagaagagcaaccccaagacacataatcgtcagattcaccaaggttgaaatgaaggaaaaaatgttaagggcagccagagagaaaggtcaggttacccacaaagagaagcccatcagactaatgcagatctctttgcagaaaacctacaagccagaagagaatgggggctaatattcaacattcttaaagaaaagaattttcaacccagaatttcatatccagctgaactaagcttcataagcgaaggagaaataaaatcctttacagacaagcaaatgctgagatattctgtcaccatgaggcctgccttacaagaactcccaaaggaagcactaaatacggaaatgaaaaaccagttccagccactgcaaaaacataccaaaatataaagaccatggacactatgaagaaactgcatcaactaatgggcaaaataaccagataacatcataatgacaggatcaaattcatacataacaatattaaccttaaatgtaaatgggctaaatgctccaattaaaagacacagactggcaaactggataaacagccaagacccatccgtgtgctgtattcaggggacccatctcttgtgcaaagacacacatagactcaaaataaagggatagaggaatatttaccaaacaaatggaaagcaaaaaaaaaaaaaatgcgggggttgcaatcctagtctctgataaaacagactttaaactaacaaagatcaaaaaagacaaagaagggcataacagaatggtaaagggatcaatgcaacaagaagagctaactatcctaaatatatatgcacccaatacaggaggacccagattcataaagcaagttcttagagacctacaaagagacttagacttccacacaataatagggggatactttaacgcccaactggcaatattagacagatcagtgaggcagaaaattaacaaggatattcaggacttgaactcagctctggaccaagtggacctagtagacatatacagaactctccaccccaaatcaacagaatatacattcttctcagcaccacatagcacttattctaaaattgaccacataattggaagtaaaacactcctcagcaaatgcaaaagaacagaaatcgtaacaaacagtctctcagaccacagtgcaatcaaattagaactcaggattaagaaacgcactcaaaaccgcacaactacaaggaagctgcacaacctgctcctgaatgacttctgggtaaataacgaaattaaggcagaagtaaagaagttctttgaaaccaatgggaacaaagacaaaacataacagaatccctgggacacagctaaagcagtgtttagagggaaattcatagcactaactgcccacatgagaaagcaggaaagatctaaaatcaacaccctaattaaaagaactagagaagcaagagcaaacaaattcaaaagctagcagaagacagaaataaccaagagcagagcagaactaaaggagatagagacacgaaaacccttcaaaaaattcaatgaatccaggagctggttttttgaaaagattaataaaatagataagccactagccagactaataaagaagaaaagagagaagaatcaaatagtcacacacaagaaaaagataaagggggtatcaccaatgatcccacagaaatacaaactaccatcagaagatactataagcacctccacaaaaatgaactagaaaatgtagaagaaatgggtaaattccaggacacatacaccctcataagactaaaccaggaagaagttgaatccctgaatagaccaacaacaagttctgaaattgaggcaataattaatagcctaccaaccaacaaaagcccaggaccagatggattcacagctgaattctaccagagatactaagaggagctggtaccattccttctgaaactattccaaacaatagaaagagagggactcctccctaactcattttatgaggccagcatcatcctgataacaaaacctggcagagacaaaacaaaaaaaagaaaatttcaggccaatatccctgatgaacatcaatgtgataatcctcaataaaatgctggcaaactgaatccagcagcatatcaaaaagtgtatccaccatgatcaagtcggcttcatctctgggatgcaaggctagttcaatgcaaatcaataaatgtaatccatacacaaatcaataaacgtaatccatcacataagcagaaccaatgacacaaaccacgattatctcaatagatgcagaaaaggcctttgataaaattcaataccccttcatgctaaaaacacttaataaactaggtattaactgaacatatctcaaaataataaaagctatttatgacaaacccacagccaatatcatattgaatgggcaaaagctgaaagcattccttttgaaaactggcacaagacaaggatgccctctctcaccactcctattcaatatagtattggaagttctggccagggcaatcaggaaagagaaagaaataaagcgtattcaaataggaagagaagaagtcaaattgtctctgtttgcagatgacataattgtatatttagaaaaccccacagtctcagcccaaaaactccttaaactgataagcaatttcagcaaagtctcaggatacaaaatcaatgtgcaaaaaatcacaagcattcctatacaccaataatagagagccaaatcatgagtgaactcccattcacaattgctgcaaagagaattaaatagctaggaatacaacttacaagggatgtgaaggagctcttcaaggagaactacaaaccactgctcaatgaaataagagaggatacaaacaaatggaaaaacattccatgctcgtggataggaagaatcaatactgtgaaaatggccatactgctcaaagtaatttttagattcaatgctattcccatcaagctaccattgactttcttcacagaattagaaaaaaacactgtaaatttcatatggaaacaaaaagagcccatatagccaagaaaatcctaagcaaaaagaacaaagctggaggcatccagctgacttcaaactacactatcaggctacagtaaccaaaacagcatggtactggtaccaaaacagatatatagaccaatggaacagaacagaggcctcagaaataacaccacacatctataactaactgatctttgacaaacctgacaaaaacaagcaatagggaaaggattccctatttaataaatggtgttgggaaaacaggctagccatatgcagaaaactgaaagtggaccccttccttacaccttatacaaaaattaactcaagatggattaaagacttaaacgtaagacctaaaaccataaaaaccctagaagaaaacctaggcaataccattcaggacactggcatgggcaaagacttcatgattaaaacaccaaaagcaacggcaacaaaagccaaaattgacaaataagatctataaactaaagagcttctgcagagcaaaagaaagtaccagcatagtgaacaggcaacctagagactgggagaaagtttttgcaatctatccatctgacaaagggctaatatcctgaatctacaaggaaattcaacaaatttacaagaaaaaaacaaacaactccatcaaaaagtaggtgaaggatatgaacaggcacttctcaaaagaagacatttatgtggccaaaaaacatatgaaaaaaagctcatcatcactggtcattacagaaatgcaaatcaaaactacaatgagataccatctcacaccaggtagaatagcgattattaaaaagtcaggaaacaacagatgctggagtggatgtggagaaataggaatgcttttacactgttggtgggagtgtaaattatttcaaccattatggaagaggtgattcctcaaggatctagaaccagaaatatcatttgacccagaaatcccattaccgggtatatactcaaaggattataaatcattctactctaaagacatgcccacgtatatttattgcagcactattcacaatagcaaagacttggaatcaacccaaatgcccatcaatgttagactggataaagaaaatgtggcacatatataccatggaatactatgtagctattaaaaatgtgagttcatgtcctttgcagggacccggatgaagttggaaaccatcattctcagtaaactaacacaggaacagaaaaccaaacaccacatattctcactcataagtgggaattgaacaatgagaacacatggacacagggagggtaacatcacacactgggtcctgttgggggctggggggctaggggaggggtagcattaggagaaatacctaatgtagatgacgggttgatgagtgagacaaatgaccatggcacgtgtatacctatgtaacaaacctgcacgttccgcacatgtatcccataacttaaagtataacaattaaaaaaaaggaaaaaagctagtagaaaaaaaaagtgaataattaaatgaacctggagttgaggtggtctttctaagcactaaaggcagaaataatgaagaaaaagatggattttgttcattaaaaaatattcagaaggatttactttttttcaaaaaaaaaataaaacttaaaaaaacaaaaaaggaagctacagtaataaaaaaatttgtttgcaatcaaacacaactcactaagcattgataatcagaacagataaaaagctccaaattaaaagaccaatttggtgataaaaaatggtcagaattagagtaaaaagcggtatttttaacagcgctatagaagacctataaacttgtcaaaaatgttctaattaaataaccaaaacatgatgtcaagtagaaattctcattcgcatgtggtaggtgcactatttctgaagaacaattgcataatatgtataagacttaaaaatggatatattcctgtcccttgatcaatacttttagggttaagaatttatcctcaggaaataattatgaatgtatgatatggtttaatatattcaccatagcgttatctataataatgaaaatggtaataatttaaatggacatgaatagagaaatgagaaaataaaaaaattaagaatgaaatactatgcatatctctaatatgctatataaaaacaagtataggtaaagaaaaatgccaaagatgtaagtttttaaaagaaggtcaataaatactagttacaacaaaatttatttttaaatatatgcttttgcatgtgcacatcgaaatgtgctcaaaaaaatgaaaaaaaatagcattgtttgattataggtgatttttgctcctgtttttttgtattacactaggcaaatttcattcaaatagcttctattacttatgttactaatttaaaaagtaatgattttcaaagtatactgcacgaggatgataatatgtccttgaaaaacttaaatttaacaacaataaagtttggtgcctttgttttgcattcaaccacaacacaccgatgacttgcaatgctcatttccctcatacattcctttcttcacttcctttacactcacactgctcatggcatgatcacgcttttcatgagcttttttctaaactgagaatagtctttccagtgtctactatcttaactttctcccagctgtcatctccacagagcattcaaagtaagcaggagttgtgtcaccccacaacctctcagcaccttctcctcaaggcccacagcaaacgtgtagagctgtagagggtgtcaaactgatacttgtggctttatataaacatcagtcacagtattgatcatttatattcagcacttcccactagtatactcgcttctttctcaggaaagagatttaggaaaacagaatgccttgttaaaagaaccactcatgttccattcaattctttctctactgcagaagccagaaccagcaaatcaactttctaatctctgtgatttcaaagtacagggttaaagaaaactcttgtattgattttttaaaattctattcctaagttctttacatctgaaagtttgcaatagaaagattacttattggttttaaaatgttattaaagaagaattaaactcagcacaattctttgtaaacactctgtaaatatgtgtcattgattttaaaggtggtgaattaggcttttaagtactatataaaaataatacctataaaggccttgatgatccatgaatgtaatgcttttggaatcaggataaaaatatcttattaaaagagctgttttacaaataaccccattaaaaagtgggcaaataaaatgaacagacacttcaaaaaggacatactagcagccaacaacacacgaaaaaatgctcaacatcactaacattagagaaatgcaaattgaaaccacaatgagataccatctcacaccatttagaatagctattattaaaaagtcaaaaaataacagatgttgacaaggttgcagagaaaaaggaacacttttatactgttggtgggaatgtaaattagttcagcctctgtggaaagcagtttagaaatttctcaaagaacttcaaacagaattctgattactgacccagaaatctgattactgggtatataggcaaaggaaaataaactgttctaccaaaaagacacatgcactcatatgttcatcagcactattcacaagagcaaggacatgtcatcaacctaggtgcccatcaatggtggattggataaagaaaatgtgatacatatacaccatggagtaccatacaaccataaaaaagaatgaaatcatgtcctttgcagcaacatggttgcagctggaggccattatcctaagtgaattaatgcaggaatgggaaaccaattaccacgttctcgcttacaagtgggggctaaacattgggtacgcaaggccataaagaagggaacgataaacactggggactagtagaggggcgagaaacagagggaggcatgagctgaaaaactacctagtgggtactatgctcactacctgggtgatgggatcattcataccccaaacctcagcattacacaatatatccatgtaacaaacctatatgtgtaccccttaatctaaaagtagaaattataaagaaaataaaatataatcattatttttaaaatattttttcttaggacagagaagtggaaaaacaatgcaaaaaagaaaaggctagatttaatataaaatggagggacatggtatccaaccaggtcgcccgaacaaatgccatgttacgctggcatcatgctggtgtttcatctgaactgcaacttactttagcccaggaaatttctgtatccaagtcaccaagcagaccttctgaagtggacttctgtaccaattcagtttcagtagcagaaagccattcagagagagaagcagcctctttcttcattttccgggccaactgtgatgctctttccagatcctgttttccttctgtcacctgagacggagagaggcagggagagactgagactgagatgggaatgaacataaatgagaatgaatcagaatgttaactaaagatccaaactgattcatatataacccccaagacatacataacctttgtcttagcaccttagaatcctctaagcttgcatttctgcaaggaggcaatatgctgtagtggttaagtgccaggcaatcctgggttttcatcttagctctatcattaatttcctaagtgatactggcagaggtatagccctcaaaagattggtatgaggctgggcacagtggctcatgtctataatcccagcactttgggaggccgaggcaggcaaatcttttgagtccaagagtttaagaccagcctgggaaacatgacctcattttctacaaaatgaaagacctcattttgtaaaaaatacaaaaaattagccagtatggtggtgcgtgctcgtagttccagctggtcagtaggctgaggtgggagaatcgcttgagccctggaggctggggctgcagtgagccgtgatcctgccactgcactccagcctgggcaacagagcaagaccccgtctcaaaaaaaaaaaagattgttatgtgtattaagcgagaaaaacacacataaaagggcagaaataaagttgaaaaatcactagtatctattataattttgaacataagatatcttagaatcctctccatgaaggaaaaatacggtattatagtaacttgaggggaaaatagcaccattttcacaattatatgttttataattaaccactttaacttaaaatgcagtacacgactatacaaaccaaaccttattattattttgctctcattgttgttgacagaaaacaaatgaacttaactaacatttaccaagctcttaatacagcttccgtgttgtgctaaggaatcttacacacgtatgcaataaaattcacaaagcctctttctactttatggataatgaaaatgaaacttaaagaggttaaggccaaggccagggtggtacaatctttggattgagccatgccattctggcttctaccaccatcactcccagacattgcccttgctaagttcaataatgaccccaatggcaactgatctaattaatatgtttatgtggacatcatatttaactttcaaaatatccaaaacaggtaactgcactctgtcaaaataccatcttcccctagctttccagacctagtactcaactgtgtccctaccacttcttgctacttacattagtttcttttgcaagctcatcttcctgagatttcttactaaatgatgtaattcttaagacttggttgagggccctcttctttcactatatcctgttcctagacaatctatcatccctgattactttaattatgacctctatgcagatgactcataaaatccacctcttcagtccagatatattctccagacctgaataatcatgtgagtacccgacatttccaattaacattctcaaaggtacttaaaatgtcaacatgtccaatacatacctgtgatttctgcatgcttctacctttttttttttttgagacagagttttcactcttgttgcccaggctggagtgcagtggcacaatcttgactcactgcaacctcagcctcccaggttcaagtgattctcctgcctcagcctcccgagtagctgggattacaggcacatactaccacactcagctaattttttttttttttttttgagtagagacgggtttttgccatgttgaccaggctggtctcaaactcctgacctcaggtgatccaccaccttggcctcccaacgtgcaaagattacaggcataagcgaccgcacccggtcctctatcttttcttacagcacccatctcaatggccacaccatccacatcatcaagccagaaacccaggggtcatccttcatctctcctcctggaccaagtcctgttgatttcacttcctacatatgtctgaaatcaattcactcactccatctccactctccatcctagttcaaggtacgaccatctctcaccaagtgtacaatgacttcgaaaccagtctcctcacatccactccagcctccctccaattcctcttccaaaatgcagtgagtaatcctttaaaagacatatctgagtatgtaatttgcctactaaaacctgtgcagtaactgcttaagacacagattttaatctgtaacacaaactctatgacattggcaggattttgtctaatcctatctccctagcaccatgttcctcacactggctctctctgctctagccacataaatgtaccacactgcctcctgccttagagcttttatatatactgttttatcagtctagaaatctcctcgtttcacccaggttactcctacccagacttcagatctcggcttatgcatcacctcctcagggaagccttcctaacacaagactgggtgaaacccccctttacctatactcttaaagaaccatgtacattcttcataactcttcagactgataatgtgacatcatctcatgtaactactcaatgtttttctctttcactaccctaagttccattagacaacgagataatttatatctttcctcatcactgtctccttgtataattcctgacacagagtaaaatctcgattgagtgaaactttaaatgataaaattaattaatactaaaattatagtcacaattggagaattagtgcaaaaaccagcaataccattccattcataaaatgcccagtcagtgaataaatataataatatttaacgaataaccagctgtataattccaaaaagaagctctaaggtgtgtgttccagacatgtaatacatcaaaatgtatcacatcaacaatctaagcttgcagaagtgagatcaaaatcacccagaaaaagtataaactggtcgttctgatttcaactgaaaacaaaatttcagctatttttctctgggcttatatagaaacttcaatattacctcaactggaagtagttaatatttcctaactgaaggaggatccaaaatactatcaaacatgggttttcaatattacctattaaggtttcacacttccacacattctttgctctcctggtttcagggcaaaaattcattcactcacagtaaatgctcaacaactcctgcatggattcactaaaatgcccaaattagagatatttcttgccaggatttcaaatcctggtagattaatgtgaacttcttgccactggttatttactagagccctgatgttttaacatttctcggtagactgttcaatttagaaatctaaggaccaacaacttgagtttttacagggattattatttcccatttttcctacatgaaatgggaaaacattaggactaaaaacagaatgtttctcacaattaaaattacacttagaaaaatcttacatgttgcgactagaaaaaagccaacaccggctactgctatccattgaaatttggaattattaacatttattttttcccttgtatttctttgaagtactaatgagaggtgacagcatgctggcagtcctcacagccctcgctcgctctcggcgcctcctctgcctgggctcccactttggcagcacttgaggagctcttcagcccaccgctgcactgtgggaacccctttctgggctggccaaggccagagcccactccctcagcttgcagggaggtgtggagggagaggcgcgagcgggaaccggggctgcgcgccacgcttgtgggccagctggagttccgggtgggcttggcgggccccgcactcggagcagcaggctggccctgccggccccaggcaatgagggacttagcaccgggccagcggctgtggagggtgtactgggtcccccagcagtgccagcccaccggcgctgcgctcaatttctcaccgggccttagctgccttcctgcggggcagggctcgggacctgcagcccgccattcctgagcctcccaccccctccatgggctcctgtgcggccggagcctccctgatgagtgccaccccctgctccacggcgcccactcccattgaccacccaagggctgaggagtgcaagcccacggtgcgggactggaaggcagctccacctgcagcccgggtgcgggatccactgggtgaagccagctggactcctgggtctggtggggacgtggagagtctttatgtctagctcagggattgtaaatacaccaatcggcactctgtatctagctcaaggtttgtaaacacaccaatcagcaccctgtgtctagctcagggtttgtgagtgcaccaatccacactctgtatctagctactctggtggggccttagagaacctttatgtctagctaagggattgtaaatacaccaattggcactctgtatctagctcaaggtttgtaaacacaccaatcagcaccctgtgtctagctcagggtttgtgaatgcaccaatcaacactctgtatctagctactctggtggggccttggagaacctttgtgtccacactctgtatctagctaatctggtggggacatggagaacctttgtgtctagctcagggattgtaaacgcaccaatcagcgccctgtcaaaacagaccactcgtctctaccaatcagcaggatgtgggtagggccagataagagaataaaagcaggctgcgcgagccagcagtggcaacccgctcgggtccccttccacactgtggaagctttgttcttttgctctttgcaataaatcttgctactgctcactctttgggtccacactgcttttatgagctgtaacactcactgcaaaggtctgcagcttcactcctgaagccagcgagaccacaagcccactgggaggaacgaacaactccagatgcgctgccttaagagctgtaacactcactgcaaaggtctgcagcgtcactcctgagccaggaagaccatgaacccaccagaaggaagaaactccaagcacatccgaacatcagaaggaacaaactccagatgcgccaccttaagagctgtaacactcaccacgagggtccacagcttcattcttgaagtcagtgagaccaagaacccaccaattccagacacactaagtctaccacaatgaacatatattacttgtagtatccttagaataatttatggaatatcagtagccattgaaagtataaatattagcctgaattaaatattaaaaataaattttttttaaaaacagtgtctcactctgttcctaggctggagtgtagtggtgtgatctcagctcactgcaacctctgcctctcaggttcaagcagctctcccacctcagcctcccaggtagctaggactacagatactcaccaccatggctaatttttttttggaaatttgttttgtttttggaggttttcatttgtatttttttgtagagacaaggtttcatcatgttgcccaggctggtctcaaacccctgggctcaagccattacctgactcagcctcccaaagacctgggattacaggcgtgagccactgtgcctagccaaaaataaatttctatgtaactatgaatcactgtaatattaccacatacatttaaagaaatataacaattattacaataaattgaaaacacgtatgaatctcataattttcaaacatgcattttccaaaaaatgaaatttaaaaatacatgagagagaacgagagagagagagagattgagagagagagagagagagacagagagatgagctgtggggctgctctcctcacctgtgcgcccaggtcattgtaaagaaccttcagggaagtcagctgctcatccatcccttttgggttgtccgtttgctgtttctggacaatatgtcttcctgttttaatcacagtttccacttcaagtttgacttcactcaaagttttatacagtttctttaaaacaaacaaagaaaaagacaaattacacactgtggtgacaacttgccaactggcatcatgtcagaccacagcttacacagattgacagccaagacctaactatggtgatcaaaggccatcatctttctcagatttggtctgaaggtcgagtcaaatgaaatcaagcttgtaataacttcttcaaatctgacaagaaaataaactaatagagtttatgctcattctttcaaaatctcagacaaatgcttatgaaagtacttgataatataaatatttttcctacataaaatgggaaaacattaggactaaaaacagaatgtttatcacaattaaaattacatttttaaaaaatcttgcatgttatgactaaaacaagccaacactggctactgctgtctgttggatttggaattattaacatttatttctatttctcagaagtactaagtctaccacaatgaacatatataatttgtatgataaaaaatacaaaactcgatatatcaagatgtatataactataagtaaacagatttctgatgcaaatcaaaaccacaataagatactatctcacaccagtctgaatgaccattattaaaaagtcaaaaaacaacagatgctggcaaggctgcagagaaaagggaacaccatacactgttggtaggattgtaaatcagttcagcccctagggaaagcagtttggaaatatctcaaagaactaaacatagaattattattcaacccagaaatcctattactgggtatataagtaaaggaggataatcgttctaccaaaaggacacatgcactcccgtgtttatcacaccactacacacaatagcaaagacatgtcatcaatctaggtgcccatcaatgggggaatggataaagaaaacgtggtacaaatacaccacggaacactacacagccataaaaaatgaaatcatgtcctttgcagcagcatgaatgcagctcaaggccattatcctaagtaaattaattcaggaacagaaaaccaaatactaaatgttctcacttataagtgggagttaaacaatgggcacacatgcacataaagatggaaagcaaagacaatgggactccaaaaggagggaaggaggaaaggggcaagagctgaaaaactaccaattgggtactacatttattatttgggtgatgggttcagtcgaagcccaaacctcagcatcatacaatatatccatgtatcaaacgtgcacatgtacttcctgaacctaaaagtcttcaaaaattaaaaataaaaataaatttaaatataaaaaaagaaatcgtagttctgtaggtcaaattcagagctgtcttcttcctagttacctgaaaccaaaaagctttattctaaacagcttctcttgacacctatacatcatcatctcaacatctcataggacgctgtcatgtaacagacccctgaactatgtatgttccatgaagtcaaggacagcactttctctgattaccattatgtcacaataatcaaataaatacttacatacatgcacatatatattaaaatttatcctttgttttgaaaagcacaaagaactgtccctatacctctcctgtcctaaagagtctcatcttaagttctgtgattctcaagcagaacactaattctaagattgtgtccccttagccacattatttttaaatttctattcaattgaattataaagttcaagactaaaaaagtaataaggccttatatatcatttcttctttcctatcttaaggtttaaatttctattgaaatttttattttcctagaaaatggaatttttacgatatccattctaagtatggttcttctagctaattcaaatttatccttgaaaactttgcttattagtcacactctgctgaagccctcctaacttcacatggtgattaagctgtatttcttttgttttggtttttgtcatcatgttatatacatgtctattctagtttccttagctatctctcttatctcttctaatttctttggagggaaagaccacacttcttattttttaacacgttttccatcatcaatccttatgtttagcacactgtagactagtgatcactggacacactaggcatgtacttgctagaccaagccataacagctgctgaaaaagccactggatgtgccaatcacccaaaagcctcaccatacacttgtccaggtgcgtctgtatgacgtcagggtctacgtccttcacatccagaacgtgaagttctgctttcacgccatccagcacacgcttgcagtccagcatgcgctgctcgaagttagctggcttctggaaaagctggaactttgtggacacctctcggagtttcctctgtttgcagaaatgaaaatatgcaattcccatcaggatgattatctctctcatcatgagcataacagatactactaaaaatttgtaccataaagtaccaaaagaaaaaaattcagaaatatgacccaaaataaaaaactcctaatgaatctcagtgagggtacccgatcacctaagtgaactgcatagcccagtgtcaaaaattacaacactcagtgtctcaatctcagaagtaatagatttggataagaaatttagataaagctgacctcactggaattaaaacttcatgttcaaaaagatagttcaggaacctagaactcaaaatgcccttcatcacaagttcagagtgaaagtcaatgtcatatcaaccatgaaagaactaaatgatgctgcatccaattcatgctcggcctgcccacagcatcagccacacgatactgacagaggctctgcattaaagaaaaagtgtatataaagctaacttctaaatctggctcactctcttgtttctcatctcagctatcaaaatcagatttcatatttttccacacatgcaacaatttgtttctgctgccctaggatgcaaccttcaacacatcatcactcccatcccatggtttacatcacaaagaatacaaacggtgcccaagtaatcaattctttctcttttttgaagaaaattcccaacaagttgaaaagtaaaaggaagctcctggccttctttacctgtagcacatccatctgacttcctcctctggcagtcctactctctggggaggtcaggggctgagaacgcatatttcttctcaactcctctagggttagctcatgggctgagatctctgcttggattttctaaaaagagattggaaaggggagaggatgtccttttttttttacttaagtataaaaagagacaatacaaaagttctatatcgttgtgtaatacatgatatcgtattttacataatgttgacctccacagaagctttaataagtttttgtaggccaggtgcggtggcttatgcctgtaatcccaacactttgggaggccgaggcgggtggatcacgacatcaggagttcaagaccagcctggccaagatggtgaaaccccatctctactaaaaatacaaaaattagctgggcacggtggcgggcgcctataatcccagctactcgggaggctgaggcaggagaattgcttgaacctgtggggcagagtttgcagtgagccgagatcgcgccactgcactctagcctgggcaacagagtgagaatccgtctaaaaaataataataatacgtttttgtataataataataatatggcccactgcatggtatgactattgtacatgacgcacctgctaagggctttgcatttgtcgtttctaatgttcacaacttatttataaggaaggaattgtcccaacttcacagctaagaaaactacaatttaaaatatacaggacttttcagccaggcacagtggctcacgcctgtaatcccagcattttgggaggccgaggaaggtggatcacctgaagtcaggagtttgagactagcctggacaatatggcaaaaccccgtctctactaaaaatacaaaaattattgggaggccgaggcaggcagatcacttgaagtcaggagttcaagaccagcctggccaacatggcgaaaccccgtctctactaaaactacaaaaaattagccgggcgtggtggcgcgtgcttgtagtcccagttattcgggaggctgaggcaggagagtcacttgaacccaggaggcggaggttgcagtgagccaagatcgtgccactgcactccagcctgggtgacatagtgggattctgtctcaaataaataaataaaataaaataaaataaaataaaataaactatataagacttttgccagagtctcacatagaaagcaagagaactccaaaacccaaatgctgccctgtaagtaaggtcaatctttcccattgactctcggttttggagagcaggaggggttctcttatagttgaggaggcaattacaaaagctctctttacagctcaaaagccctcaaatgcacggcaatacctgagcttcctgtggaacttggaaagcatctatcctgtcagtcaggtatgtggtgagctgtttgtccagctcccccaagctctcttgcaagacttgaagcatctggtcagtttcccgcagcacctggagttgcttttccaaagaaatctgcttgctctctgcctgcacaaaggagaaattgaatcattagttgcccaacacaaatataaatagcagaatatatatattctggccactaagaaaagaccataaaagctttcatccaagactttagctttctttataaataaataataattactaatgataacagtgaaaatgtcccactaggatcttatgtaccatgcagctgaattactaattattacttctttctatatataatgttgaaatacaaaaatgtaaaggtttcccataagatgcattaaacagaagataaaaatgtgttatttattataattttaaagcatttttaggaatcagcaatgtctgccaattaagaatataaaacataagaaaaatgtctatcaatacacaaacatcagagtctctttttttccaaagcctaaaacaaattctataggtgtacatacatatcaaactactatttacagcacttttgggttaagcttgatgttattcatgggctgaacatcaacagttattatttaatatgtgtttggaagcacctaatattcatacccaaccttcctataaaagaaatgttctttctctaatttgtgatacgaatatgtatgttacaacctggatatgaactaagagactatggctttcacagcagcttatgtgaaatatcatggccctaatatttactaggatagtatgagttgttgttcttatatacagctatcatatgatccttaatgaaaattaaatgtttgtaagtagaagtaatctcaaaaataatttttttaatcatccagttctgtcttagagtgttagatctattcttcctttctgaatatttcaataccctcaatgcccctgttagcattggttaccaactttaaccaacattaaagatttttccaacattaaagctctatgatatggagcttagggccagctccacttcatcaatacctaatcaacacccatgtatgtcccaactcttaccaggtgacttagatcttcatatcggctgttgaaagcctccagtttctcactgattatatcatccaggatccccccatcaatcagagtctggccaagctctcgaatctgggtgcgattatctgccgggtggcgcagaacagattccagagactggaatggagatgggaaaaaaaaataataatgcatttactaaggcaaaaggtatcaaggatccccaaaatgtctatttgttaaacaagtaattatattttctaaaaatctacctaagtaacaggaccaaaagttaagtaaattactaattcacaaaaatatccatcatgggattaaaaaatgcataaaattgagaaattagcacaagtgatatatgatataatttcacaaaaataatttcaactattattaattatgggagggtgaggcaggaggatcacttgagcccaagagttcaaggctgcagtgagctgtcataccactggactccagcctgggcaacagagcgagactatgtctctaaacaataaataaatgaataataaaaagttaaaaataattattaattatatggggaaatgctcatgacacaaagttcaaaggcagagaacagtactatacaagcaaaatgatctcaacttttattaattatattactaaaaataagtagtcattttcctacaatatatgcagaataagaggcattgttttatatacacactttttatatacataaatctaattaaccatatgggctaaatagcattcccagtttacagattggaaaattgaagctcagaaaggttaaattacttgcctacatacacacagtcaaaagaagagctaagattccaacatggctctaaagctttaagactccaaagcctggccaagtgcgatggctcacacctctaatcctagcacattgggaggccgaagcgggtggatcacctgatgtcaggagttcgagcccagcctggccgacatggtaaaaccccatctctactaaaaatacaaaattagctggggtagtggcacacgcctgtgatcccagctactcaggaggctgaggcatgagaattgcttgaactcaggaggtggaggttgcagtgagccaaaatcatgcaattgcactccagcctgggcaacatagcaagattccatctcaaataaaaagataaataagtaaataaaagactccaaagcctttgatccaatatactaccttctagtatgcatacataaaagataataattaggaagaaatctacaaactgttttaaaatgtttatcttagagtttgctttatacttttctttattttccatatttcaagaatatatacgtattcactcttacattaggaaaaaaattaagcttttcatatttttcattcactctgtctctcactctgctatatttgagaagtgacatcttttctctagcagagcatccgtctcctggaatgtaagtgccacattttactcatttctgacctttaatccagttgtccactcagttcccacatggtaccatgacatttttaaaagcctatctacccccttcccttttcttttttgttaagcaaacctaccctctttgcactgtatttcatttaagaaacggttattaagttaacatgtgctacacactgtgctgggaactgaggaataacaaagcatcgggtacatttcttggcctcaaggagttcaaatccaggcttgaagacaagctcctacgacaagatcccatggctcaaccactgtcttaacttctagcatctgaaggtaagagacaggaatcccctataaactgtcagtgctgtgtttagtgagtaaaaataacttgttgatgaaacaagagagcagttgtcctaataacatatggcagagctttgtccagggcctactaaaataaactggaaaaccactagagtgcttcaacatgtctaaaatgtaagatgtcaaacagctaaccacgtcttgaggctgatataatgggtcaccaataatctaaatacacatgattgtataaacacttcaggctatggaagaaaatgcaagtgacattgaaaaccactgaggaagcaaatgcatttgcctgcgtaaagcattacattcctcattgtaatacacgtgtggcctcatcacagcaaagagaaatgccgtggagatcacgggttccaacctccagggcttcgttgacagcatccgtcttctcaggcaggacctctgtgctcttcatccgctcttccaaagtgtttaaccaggtagtttcaagatccaaatagtgaagcagttcaatccaacaagaccagacctcctaaagcatgaaaaattttaaattagacaaaaagccatttcacacatcgtatctctagtactacacattctctttaatcgctaataatttcatttggatgtgagtatacctaggaattcagaactgatggagttgaaacttcaaaaaaataaaataaaatcggccaggcgtggtggctcacgcctgtaatcccagcactttgggaggctgaagcaggcagatcatgaggtcaggagattaagaccatcctggctaacacggtgaaaccctgtctctactaaaaatatatatatatatataaaaatattagccgggtgtggtggcggatgcctgtagtcccagctactctggaggaggcaggagaatggcgtgaacccgggaggcggaggttgcggtgagctgagattgcaccactgcattccagcctgggcaacagagcaagactccatctcaaataaaataaaataaaataatcaacaaaatcatatgagaccagttggtgaagggtggggagcaaagagtgggcaagaggctgcctcactctttaaaataaattccatgatctgatttaaatgtcaaaaatagaactatataattagtaagaaaaacaggagagaaacattatttagtttgttttttaaagaccaagtgcggtggttcacacctgtaatctcagcattttgggaggccaaggcaggtggatcacatgaggtcaggagttcaagaccagcctggccaacatggtgaaaccccatctctactaaaaatacaaaaactagctgggcatggtggcaggcacctgtaatcccagctactcgggaggctgaggcaggagaatcacttgaacctgggaggcagaggttacagtaagcccaggccacgccactgccctccagcctgggtaacaagagtgaaactccatctcaaaaaaaaaaaaaaaaaaaaaaaaaaagtttggtttttgaacaaaatgaaaaaattgctcccaattgtaaatttttaaaaaataatttcatagaaaattgaaatctcctgggccccacccaattccaacttggagctaactgatgtaaaagtttgcaatgtagccttcccaacttttttctaaattcatgaggacatgtcaatataagagagccacattttaccaaaactggagttatactgttcttactgtgttggttttgatcactcattcccctctgaggtttccagagcagggacccaggggttgtgtagtgggtggaaacatttataaatttataatcccttattataagaggaacttatttgagtggtaagtttaggagaaagaactcagctggatgcctcctgggcttgtcgtcttgaatgtactgaatgagtggaggcatcttctggtttacataaatgagtgaaggcacctgccggtccactctccatatgaagtatgcttaccagatcaaggagcagtacatttttctacaaagggccagccagtaaatattttaggttttgggaggacacatttgcttcctatcacagattcttcttggaggggggtatgtgttgtacaacccttgagaaatgtataaactattctcagttaaccaggtatccaaaaccaaactacaagttagatttaaaccctcagccagtccgggtgcagtggctaatgcctttaatcccaggactttggtaggccaaggcaggaggatggcttgagcccaagagttccagaccaacttgggcaacatagcaagacccccatctctacaaaaaaaatttaaaaataattagccaggtgtggcattgcaaggctggagtcatagctactcaggaagcgggggcaggaaggtcacttgagcccaggagtttgaggttacagtgagctgtgatcataccactgcactccagcataggtgacagagcaagaccctgtctcaaacaaaacaaaacaaaatcctcagccataattttccagccactgaattagaataaaagaaaagaggttctagtcccccaatttccacaagcaaaaagcagaccaaaaatctgctcagatgcaagcacaacctcttttcttatgggaaagaaaaaatgactcaaagaagaccacttccaagaagcagacagatcccaaatcaagtagctttcttactaacttgcctcaatgatatatatttatcttagcacaaaattggtttagaacaagaaacgaatgaatttacaaatgaatgaatgatcaaagtaatgaatgaatttaggttaaatattgcagttgccattttttaccatttcaagatttgccacaatacaaatatttgttttacgtcaaattgaatgtaaattaaattgttgtaaattgaaagccttcttaaatcttccaacaagcaataacaaaagtcatactactataaaaacaaacaagcaaaacctcactcttagtttaaaaaaatttcatagactcatctacattttacgtgtaatggccagggagaaaaaaaaaaggtattttatctaagacccagtaaaactgtcacatatttaagttctatttttccttcaggtgactcttgaactttagacaccactcaaaagaaaataattcctctctatgtactcaaccaggcaaaacaaaacaaaagagaggcttgaaatgtgctctgcaatttttggactggaataggccctacagatcatctgttacatgaaaacctggattgcacctataaaaaaagtaaagtttgaatatacaaaatgacttgcccaagaaccttctgataattagggacagattttggtctcctgtttttaacccctctttcatttttatcaaactatttcccaagaactattttttctttataatccagaatttgaaagaaaagagaagttttctccaagatttgaaaatggccaaaacattacagagtttggatctcagaaatacatcactgaaaataataataataataataataataataataacaacaataataataatagcatacctctagcgtgtggcactttcctcgaattctattacaaagaagttggtaattctccagcacaacattcagctcagacgtcaactcctggccaccagagggcaccttggcagctaataacttgatgttgtccttgagaatcttcactctcacctccttctgcaacacatcctcttttgccctctgttccaagaaaggatggatgaacttgaaaaacgtctccctttctcagtaaccaatttcttttctttctttttttttcaagaattaaaccaaagttaaaacatctggatgattctaactgccaaaatagaacattatttaggtaacagtgaatggttctttgtggggttttgtttttgtttttgtttttgagatagagtcttgttcactacaacctctgcctcccagttcaagaaattctcctgcctcagcctcccgagaagctgtgattacaggcacccaccactatgcctacctaattttcatattttttagtcgagatgaggcttcgccatgttggcggggctggtctcaaactcctgacctgaggtgatccacccaccttggcctcccaaagtgctgggattagaggcgtgagccactgcacccagcccagttgagcgtttttgaaataagaatgctaactctgaaatttcactcatgcatccaatgtactcagctcccacaaatgttttcatttcataacagcagtgttaacgtaagttatccaaagtatgtttactgacatgaagtattttcaaagtctgggtccaagatcagaatttaagtgagtgaattttcattatcactggagggctgagcagattacactgtgataaatatattttcacaaaaattgaggtacactatggtagaagtatctttaaaagttctctaaataatttaagctttttaaaaaattatagaacataggcacatgtatccttctgctaattaatagcatttcaatgataaagttagactgagatgatctgatccagaaatagctgtttctcagtgctaagataaacaatctgacattcaggaaaatcaacctatcaggttggtgcaaaagtaattgcagtttatgccattacttttaatggcaataaatacaaataaaacagtctttcactttcccctttacttttctctactacttaatggttttgaacttccttagattgggggaaagtaattaagtgtagtggttttgtaagtcctaatggctgtttgaaagaataaaaataaataaaatgttgcccaatcaaatatttaaatatcatttttctcaaatctcatctatagcaacttttaaaatccacagaactacaatgccaatagtgtaaagaaagacaataaatgagacaattcttaacatggtagcctattttaaaataccttatgtactgagtatttttaaatctttcaaaaagagctacactaaaaaagatgttttagtgaaaaaacaacttccaacaagtctcctgtcatatttactttgattcatgtataataatgtatgaatgtcatataatcccttttttgaaaaaaatcacagatttttgctttagttacacttctaggtaagttaactttgaggtaaaacattagtcactgtgttgcttaagcttacaggaaaaaaaagctttgaaaacaccatctcctttggcttgaacattcaaggacagttgaagctgtgttagaaatttgggaatgatgcccagttcttttattatatataaaaagagagtgttcaagactatcgacagaggagtacaagtttacaggaaatgtatccagtggatccaactaatatgaactccccgatgcattcctaccgctattcctacctgctctaatgaaacgtcagtgttcatatgtgccgtatgtattaactggaagattagtaacaggaaaataagaataaacctcagacaacttgggaggtctcttttgttccccttacaaaaaataactctttgtgaaaatgtttggaaatagtgatgaatgcaattaatgccactggattgtgcacttaaaaattaagctgaccaatgttatatgtatttaccccaattaaaaaaaaatgatcattcttcctcatgcccactaccagaggtttttaagtcattctctgtagcctcccaaaggtctaacttaagagcttgtctcatgggccctcatggactcaactcatgggccaagccaaatatgtggactcctggctttcttcccctgctaaaattagagcagctaccctgttatgtttttttaattcaaaaacctactgtgaaagatgctacatgcacatagtgtttgacagatagacagatgattgatgtgctggttttaaagggaggagggaggcatgaagcctgttggcactggtcgtccccgcctcaccttcatctcttccacagcactctcaagctcttctggtgacttgtactcaaaatcccgctccaaatattcttcctcggcctgggtcatccattcctgcatctctgccaagtctttcttcaggttcgcagctttttcttgactttcagacaacctacttttttgagtagcgatctacaaaggaaaagccattcccccaaataaacaaatgttaatgtgttcaatgtcaagttttagctcttaatatttaaaggcacagtaataactttccacaacgaattgcatgctttaaaattcagataaaatctcatacatctcatgctaacgctgtggaatataagcagtaatgaaaataatcttaagactgggattccacaccacatttggataatactcttatctcgaaatagctattataattttgacaatgcataactgttgactgtaatcccagatgtaggaatctaatctataacagtaaaagcacatatatgaagtaaatttaatgtagcactacttataatggaaaaaagaaaaaagaaagcaaaaacaaaaaatctagaagccagtcagtcttggtggctcacacctgtaatcccagcactttgggaggccacggcagggggatcacctgaggtcaggagtttgagatcagcatggccaacatggcaaaaccccatctctactaaaaatacaaaaactaaccaggcatggtggtgcatgcctgtagtcccagctacttgggaggtagaggcgggagaattgcctgaacctgggtggcagaggttgcagtgagccgagatcgcaccactgcactctaacccagggaacagagcgagactctgtctcaaaaaaaaaaaaaaaaaaaaaacccctagaagcaatcaaaatgtccattttcttctttttaactgcacttcccattaagatttcacttttaaaaagcagggagggagaggctgctattaaagatgtcataagacaccgctctataaaattttggttttgatgtctactatgtttgtatatgccacacagacacaaaaaagttacagtaaaaaatagatagttgtctgattctgattcagtaacttagttaaaaattttggagaagtctagaaatattttcagagcactcctccccataacgacaaactgacttctactgtgagagaaggcgccgttctgcagtcacagtccaacctctacttggcaggttcagcctcatgctcaaattaaacgccacagtagtggccaccctgccagggcctgcttggctgctaggtggatagtaaccaaaggccagcacaggagctggatggttctcacagaagttagagttaagcaagagacagaggctttcccagtccctccctccaaacaggatctccggcataaaaatagacaggaccaaacaagagcttttcttccactgtccccacagggtaaccaaggagctgatgccagcaacactcacaatcccattcccaagcctggctgatcatcaggttaacctggtcagcttttcataaaaatacatgcacacacacagaaagagaaagagagagacagagattcttgggccccatttccagaaaattctctgtatgtgtacttcttgaacactagtcagcaatataattttcacagatccaaaaagaaatgaagaaaataaagacactaccataagcttaacaacaacaaaacaccctcaaaattatctttaattatcctgagaatatatactttctattttttggcattaaaatgttcctttttttcaggatatcatgaatataatagatgaaatagactatctttgtttgttgatttgttttatatgcctgttctttttagcaaaatgaaaatttggcaaaattatgtttgtccaaaactacttcaacatttgtactagtcaatgcaatgcaatagtctggaaatgctctagataattattcacacatgtggttacctccttcctgaggacactttaaatttcccatatatttattcctgtattttgaatcagtaattcacaatgaattatttgtcaccatatgtatgtggatggatggatagatagatagatagatagatagatagatagatagatagagatacaaacttctaattatcaccttccttgatcctcattgccacttccaaaccattttctatttcctcaaaaaccccagttccttaaggcacatgccatcagattatagcacattgagaaaaatttgaatttagctaggataagagatgagagtataacattattagtttcttaagtgtgatcatagtattgtggttttgcagaagaatgccttcatgcttggaaaatcatgctagagtatttaggggtgaagtgtcatgatgttttcaacttactgttcaaaagtaccaaaaaaaaagggtgtgtgcgtgtgtgtgtgtgtgtgtgtgtgtgtgtataaagagaaaggcagagagagagaaagcaaatgtggtaaaacattagcaagtctctgaatggatggatatacagctgttcctttttatcattctttaacttttctttacatttgaacatgttcaaaataagttgggtaaaacaataaacacaaagcaaaatattcagttatgcaaatataaatttttctgatacaaacattagccaaaagcattttattaagaaatacgtactatttacgtgactgtggggtaagcctatatttcatattgacttctatttttcactgctttgtcactcacttcagctatatatagcctcactattattccactaataaaaatcaaagcaattgggaaagaatacctcccagttctactgttcccatatcatttcctcccttccattaccacggagaaaccatatctctagcaacatcttcacttagacggtggatctcatcctcgcataatcacagacttcacttgataaattctcctatctcaatctctttctgcaccatcattttttttctaaagtgaggtcctcttattaatatctctcatttaatatctctcattattaaaaataacaaaaccacctctttggattcccatcaccagcacccacccatttctctgctcccctgaagacagaaatttctcaaagttggttatgcttggtgtcccagctcctcagttcccataccctcctcgaactatccactatgacttttttcccaccagttcattgaccctgctttctcaaggttattaaatgcctccttcttatcaaatttaaagctcgattttctgttttgattggcccctgcaatcctcagcattaggccctgtgaaaagttttctccacctagcatttgggaccccacattccccgttactgatttttcctccttagcttctagcatcaaatttaacccttccagaatggtagtcatcatttcacctacacccacagaagcttctccttcgttattgcagtaaatgacaccacaattcacacaaagtggaagctttgtaaaaatcctgagtcatccttgaccattcactttttcttctatcacacatccaattctttccttaggtctcttctttattttcaaacctaatatttctcatgccctccatcactacttcgttaagcctccctagtgtatgggtccatcctctctctccaagcctgcagtaaccttataagaattctttctgttttcattcctgccttcccagagcaaactattcacatgaaaaccagagagaggccgagtgcaatggcccatgcctgtgatctccacgctttgggaggctgaggcaggaggattgcttgaggtcagcagcatctgaccagactggcatctggtctcaaactgctgacctcaagccatccttttgcctcagcctctaagaaccccatctctacaatttttgttttttttttaagacaggatctggctctttcgcccaggctggagtgcagtggtgcagtctcagctcactgcaacctccatcccctgggctcaagccatcctcccacctcagcctcctaagtagctgggactataggcgcacaccaccatgcccggctaatttttgtattttttatagagataaggttttgccatgttgcccaggctggtctcaaactcctgagctcaggcaatccacccacctcagcctcccaaagtactgggattacaagcatgcaccactgcatctggctcaaaaatatttctaaaattatctaggcatagtggtgaacatctatagttccagctacccaggaggcaggaggactgcttgagcccaggagttcaaggctgcagtaagctaggattgtgccactgcactccagcctgggtgatacaacaagatactgttgctaaaaaaaaggaaacaaaacaaaaagccagagtgaccttaaaagatctatatcacatgtcacttccctgttcaaaaccttccaattgctttctgtgtaatatcatacttgaaataaatcccaagtcctttcctccaaggccatagctaatccatcctctgcctacctctaacctcaaatattcccattctccaactcactaactcctctctgttttattccagctacactgccttcattctttattaaacagaccaagttcattcccaccacagagttttaaagcctgctattctccacgcctgaatgttcttatctgaaccttacaaggctcatctcttactttactcagttctttattcaaacatccccatctcagaaagtccttccctgaccatcctatttgaaataacccacctagccctaactccttgctactcctccatgatattattcattatccatctgcctcactagaatgtaagctccttaagaggagtttcttcttccttgttcaatgctgtacctgcagtgcctagaatgatgcttgacaggtggcaactgattaagaaatatttgctaagtaaataaatggtcccactcaaatgtcttaggggtaaagcaagtgtcataaatgtgtttcaagccagatttaagacaagaatggataagccctgagccaaactggacaatcagcaccctctcttaatttaaaaaatgatgcctttttttttggccccagctcactacccatgctggagttattctagaccatcgtttttcaaactggatgggtcataatacatttagtcagctgagagaagctacagtctacatctcctgaaaaccgtaggtagtaaagttgaaaaactcacctccttgctaagtttctccagttgagtttggtagtcacctagtcttgtctgcacccaagtttttattccagcaactggaccacttcgaagattagtctctatttccttcatgtttttcagagatgattcaattgtttctatttcattaacaaatgcctaaacacataaaagatgcatgttgagttcattactatataagtggatgccataattatagtttgtctgcttatctccctgcaaatattacacaagcagactgcttaagagtcagtacttctaactacttaagaaatattgtgccttaagaaactcatttcacctgggtgcttgatatagccatctgccaaattagactggaaatacttgactctcagaagggaatagccttttaattaatgtagagaagcctgatgatttcaccaaatataaactgcatgcactattactagcaaattcatttcttgttttttgtttttttaacactttaagttctagggtacacgtgcacaacatggagtcattgtatattgcttttcttgtgccacatggtgaggatttaagaaaaacatacttaaatgaatttgatgaacagacacttctcaaattcatttgttaaatatgtttttcttaaatcctcaccatgtggcacaagaaatgcaatatacaatgactcctaatgaaccaaaattgttcttgttctctattctataacctctcaaaattctataaccacgtccagaaataaaaacttgaagaatctgtcattcttttattagctataaagtcataaaagctttatgatgaaagatattttatctagatgtaatgctatgctatattctcacaattttaataatagcagcaaataacatagaaaaagaacaaaatgttatttatgacaagttccccagatcagcagaactcacagagcactggtctaactgcctctgtagacctgcgtcgtctccttgggcagcctgctgtttcattaagaagtctttcacgccatccatccacttctcaatgactgttgaatcggcctaatcgaacatgataacagagggggatattacttcgtgacgttcagcctactacatctcaagatctaccgccactggaacaaaggaactttttaaagctccgatagcatcgctttcatttatgttatttctttttctaaaccttccaaatttgaaaatgattattttcttcattcttgactaaaatcctcaagagatgacaggttagtaaccactctaaaaatttccaaacgctagctctttttgcttaaatgcaagcaatagttatgatttaaaatgcaaattacagggaaaaaatgcatttctaggttttatcagctataaaatattttgctctgatataatttagaacaatttttctctaaagttagtaactcagagcaggaataaacaaatagcacggtagagggaatacaatagatggttctcatttctgcttttggatgcctttttatctgagaactcaagacagtccccgttcagctccaatatttcatccaacatttattaagcacctactatatatataaaatccagctactgtgtatggcgataggggttcaaagacaaatgtgaaagcaaacattttgcaaagagaaagagactttagagagaaggtaacattggaaccaggccttaaagaatgcaaataagggccaggtacggtggctcacgcttgtaatcccagcactttaggaggcccaggctacggatcacgaggtcaagagatcaagaccatcctggccaacaaggtgaaaccccgtctctattaaaaatacaaaaattagctgggggcgtggtggggcacctgtagtcccagctactcggggtggcttaggcaggagaatagcttgaaactgggaagcagaggttgcagtgagccaagatggcaccactacactccagcctggcgacagagcaagactctgtctcaaaaaaaaaaaaaaaatgcaagtaagtagatgcaattttagcttttgagctccaataccaaaatcattgtcatttctttccataggtgggcaactgccatgtttttctctggtcttctactgattacatgttcccaattccttccatgatgtctgtaggacatgatatttaggtattgctcactactctgatcaacacgctctggaaactacatcaatttttaatgtccttaaaatatgccacccagaaccaactattctgatccttataatgtttgaattgatcacaaagatctaactagtttatataaggttatcagagattatctcaaatactttggtgaaatcaagacttgccaagaatgttcatttgtgagcattatttgaactaaatgagagagcatcttcaaatgtgagatgttatcactctgtgtatctaataatctaggcttcctcctccaaaaaaaaaaaaaaagaaaagaaagtagtacttaaaggaaatgagtctgggcaaggcctattattggtatccatgttgattcctggtgaccacgacattctttcctaagcacatataagatctctagtcggttatttatcttacagtttggctaggaactgacatcaaacttactttatatcttctgcttctaaaaactaatgtttcctcttaattaggacattcctccatctccatttttctggtaatttctcacaagattatgacgtaaatgaccctgagatcaagggtaaaaatcccacttgggatgtagatttatgcatctggaggagctctgagtggttttgcttgtggtcctaagttcaggctctaaagcactctcagtaatgactattctatactttgtagttttgaaggccattctctgatgaagatggcaagtaaaaagtgcttatctagctaggtttctctgtgtcttccattaatattataccatcctgtctaagcacttctgcatctcgtttattcttggcacagctttgaaagcctttcagttccattgcacactttccccaagctgcttcctcctctcttctccagcctgtctgacactattcccacaggtccatgctacccttatatattttcagttggttacaggtcacttctgtgtttgctccagcatttcaaggtcttagcatagaaggcttcttgggaagacatgctcaggacgggtagagtggggcatccaaaaaagacagaagtgcaaaaagagagaaagtgtgaatacattcacagagttcataaaatgactttaaaaattctccgtttaacttgtcaccacagattcttgcactgctaatctccattctgcacttttaaagaatgcattactgctgtataactgggaaattcattaactctagtttgaataaggaaaactgatagtctcctcagccaaaattttcaaaatttatatggaagcattatatttcaaggaagttttaaccacaattggctttgacttgagtaagtggccttaactactccagtcactggcatatgaggaagttttatggcctcaacagccttccctcctccctccttcccaccctctctctaatacacgcagacccatcagggcacatgcaattcacatgtatctgttccttctctccctctgacatgagaaaaaaagaaagagaaaagaaacagatccctctccctctccctctccccctccccctccctcgccccctccccctccctctccccctccctctccccctccctcgtctccctctcccctttgcacggtctccctctgatgccgagccaaggctggactgtcctgccgccatctcggctcaatgcaacctccctgcctgattctcctgcctcagcctgccgagtgcctgggatcgcaggtgcgcgccgccacgcctgactggtttttgtattttttggtggagacggggtttcgccgtgttggccgggctggtctccagttcctgaccgagagtgatctgccagcctcggcctcccgaggtaccgggattgcagacggagtctcactcactcagtgctcaatgttgcccaggctggagtgcagtggcgtgatctcggctcgctacaacctccacctcccagccgcctgctttggcctcccaaagtgccgagattgcagcctctgcccggccgccaccccgtctaagaagtgaggagcgtctctgcccggccgcccagtctgggaagtgaggagcgcctcttcccggccgtcatcctgtctaggaagtgaggagcatctctgcctggccgcccatcatctgggatgtggggagcgtctctgccccgccgccctatctgggatgtgaggagcgcctctgcccggccgcgaccccgtctgggaactgaggagcccctccgcccagcagccaccccatctggtaagtgaggagcccctccgcccggcagccaccccatctgggaagtgaggagcgtctccgcccggcagccgccccgtctgggaggtggggggcgcctctgcccggccaccccatctgggaagtggggaacccctctgcccggccgccaccccgtctgggaggtgtacccaacagctcattgagaacgggccatgatgacgatggcagttttgtggaatagaagggggggaagtgtggggaaaagaaggagagatcggattgttgctgtgtttgtgtggaaggaagtggacataggagactccattttgttctgtactaagaaaaattattctgccttgggatgctgttggtctataaccttgcccccaaccccgtgctctctggaacatgtgctgtgtccactaagggttaaatggattaagggcggtgcaagatgtgctttgttaaacagatgcttgaaggcagcatgctcgttaagagtcatcaccactccctaatctcaagtacccagggacacaaacactgcggaaggcggcagggccctctgcctaggaaaaccagagacctttgttcacatgtttatctgctgaccttccctccactattgtcctatgaccctgccaaatccccctctccgagaaacacccaaaaatgatcaataaatactaaaaaaaaaaaggaaagaaacagacagagaagccatgtaggccaatggatcatcccaaaagtgacaaagggaatagaagggaacctgtaaagccacactataatattttcactactaaaaatcctgcatgtaattctaaccacactgtgctctaaaagagacagtgtgcccatataaagaaatgctgaggtctgactaccaagctcagcacctgcctagccatggggccttgagaaactaatttttctttgagccttaataactcattgtgaaactggaatcataacaactatcttgtctggttgttctgaaaaacagagactcccacatagaagaatgcactaaatggtagcgattattatactaagatctacaaaaccaactgctttattatgaccaagattgagaccataaaagagttaccacatccaagttttggtgtttatgtcccatcagaggcaccacaggaatgaacagccaggatgagcatgtgtttgcataagcatgggtttcacttttttaattgctgccaacattaatgcttgttctatcctgtaactgtttcaaagtaactgtttcaaatggctactgcttatatatctggctagacctggccaaatacagctcatgggaaggaattggtacagaaggaaaggcccatcctttagaagtgcctggcagcagcagattcactcggcgtttccacctcgtggcacaccgcgcgggaagggttatcaagtcccaaagatcaatgctacctaccacctgtacctgtatgggtgaaggcagaagacagggagctctactctgccttccactctccctatcttatctcccctttccctgagcaaaatattgtcacaatcaacctgtagcagatgtttcctgtgcttttcaaacataccaaaagtctgctcatctttaagtcaattccaccacaacaaagaggttgattacaaagatcgtcaaagagctcacatgaaaatagtgtttctctgtccatttaaaaattactcagctgatgcacttacaagcttctaatctacaataatgacgatttttttcttcacctccatctgcttacagaacacacgcatgcacacacacacacacacacacacatttctttaagggacttcagttcttacaaaccaaaacgaaatataaaaactgttagtaaatttctaaagcaaatgtcattatttcacatgcaaaaaaaaataaactaagtactaatctggggcagccatttctcatacctatttttactcacaaatattcaaatgaatataaaattacgaatacagtattttttgaaaatcaaaatatcaaatattctagtatggaagggtcaaagtctacatggaccatcactgctcaaaagcaatgatttctaagcatttcagatgggcaacaacctgctatgggatcacggacaaggaacagcaaggtcattaaaacaattcctctgaccctatctcacctcatttcccatcccccatcctgtgacctaaggatggaggtaatttaaagcttggtaaatctggatttaagacagtaagattgcaaggtacacaactacctctggagacttgattacagctaaattcttggcattttcttttgctcctcccccatctgtcggaatgtccacagctttttaagacatagaccagaaaaaaaaaaaaatagtgtgaagccagaattaaaacagtaatttaaggcagccaggttcctattttgtttcactttataatactcaataacctcaaaaacacaaccttgaaaatgtgctctctcacttagtagggaagacaaacaatgacactgctactacacttattaaaaactaataaggttcttaaatctaaggaagggaatatatgaatattcccttcagtaaagtaaaatgtgttcacaaatgagaaaaaaaactcaaacccttatgagataattatatcaattatatgttacctaagaagggttaaatcatccgtactaatattactcttagaaagtattgcatttttaccctaaaatgctttccaaagtactctcaaaacctggttctgcctgttggagctccagcacgcccccctccagattccgggtcagagcaagtccattcatgtgtgcctttgactgttcaacagttgaaggaagaggcatgactacacaggtgtcctgccacttaggataaccaggctttagactgtataaatccactctcactagagaggccggacacatcaattacattcacatctgctaacttgctctatgcctgacagggatccaaccctcaaagagctcatgcctcgtgggaagagagacacacatttctcaccataataaaagacggcctgagatgggtcattgtgaaggtgtaaatgacacacagtcgaatcacagaggagggaacgattatctagctatgggtgtagtgatgagctgggctgaagacagatgagcagacaggaggaggagggatgtgaattcctagcaagtacatgacattttcagagaaaggcaatagtctaggatggtctttggtgacccaccgtattctccccacctgactcagctcacagtggagatgcagggagggcttcagggcaagaaagggacattttgtattaatggcacttggtattaatttgtattaatggtgaagacaaccagatcctttcagaagtacaactctggtattggtgtgaaagatgaattccagagagaagagacaggaagtgggaatcagatttaaagggtaatgaaattttcagggaaagagattgcatgagagcctgaacccagaaggaagggcctggaggaggagcctgaaaaggcaggagcgctggaaaatagaagacagttttgtgtgtgccttggggacatctttcatttcccagttatacatagggcaggagctcttgaataaggaaaaggaagtacgtaatatgaaatactttgcagcccctaaatccaaagatattactactggtgaggagagatatataagcagcctcttaggattttataatatgttatccccatgattcacatgaaaatccagtcagtaaaatcaataatggaaaaaagaaatacccatttcatgtattttcaaatgttttgtcacctggaaggggtatagtagtttgtaaaaagtaacaatgaatattttacctcgtaagtacaggaatggaggttattgctttggcatggcacaaataaaaagaacttaagaatgtatttgggcataacacaatgaataaaaatatgtaggtccaatctcaacatgcacaaaaggaaccagctatggagacaaaggaaatgcaggcaaatgaggaaaaacactgcaatgccaacaaataacagaaaactgaaattcgcacacaactaacagcctcttacaaatattgaaggatagcagaaaaaagcaagcacatggccatgaaaacactttcaaagtttaaatgtgctgtatcaatgaaagatgttattaagtagtgggattcacttccaaactctatctggactatggatttaaatgtccttcacagagttccaatatcatttctttccacagtgtgggggaaaatgattggaattagcaatatttgtcaattgttcttgtctaacttgtatgtacaaggatccactgttaatattagctgcccccaggaaagaaaatggtattggggaagaaaaggaactctaaatgttcactgtaagtatttctgtggtattcaatttcttcacaatgtgtaggcttcaagtactactcatgtaatgaaaaatgcattttaaaaataaacgagttaactattttgttcctacaaaacattattatgaattggcattgaatctaaaacctactgtgcttcatgccttaaagacaaaaataattaaatgcctaaaaaatcatatatcaggtcattgaaaaagggaaaacaatgataatctgcaaataaatatttattataattatctaataatttgagggtgtggaatttaaagttttcccaagtaaatcatgagtagttaagtaaccagcaattcctacaaagcaaaaaaaaggagttttcttttgaatttaagataaaacatgtatttcaatgaagaagttatacaattaagaaatatagacactgtattccttaaccacaatcttgcagttagtacacaagaagcaaataaaaaaagtactggacattacaaatctgctactgtaacaacaaacacttacatatccagacacacacccttgatgttggatatttttaatggaaataaatatttccaagtgaccacttttagtgcctggatttgctacattaatagcaacaacccaccaaagcttaaagctggattactataaccacaggactcttttgtattttgggagaatatttattctctttaagctccatattgaaatagtagcatacatttagctaaccctaagatatacttttaagagtcaaaagaagactaactctgaggttaatctccatttatactttggacttaaatctgaaaacaaagggatgatcttttgaaaagatggggaatgtttcatctggcattgctaaactttggcactagtgacatttggagccagatgattattttgttgtgaggctgtcctgtacatggtgggatgtttagctgcatccctggcctctacccactggaagtcttctcccacagttctgacaacagaaatgtttccagaaattaacaagtatcctctggagggtaaaatcaccccggttgagaatcactgataatacaatgctgggaccataaccaaaaactttagaattatagaaaaggccaatgctcattttgaaagccgggaacaattgcaactcataatacacaacgagaagtgggaccatcgcaaagtaaaatgggccaggcatggtggctcatgtctgtaatcctagcattttgggaggccgaggagggtggatcacctgaggtcaggagtttgagaccagcctggccaacatggtaaaacctcatctctactaaaaataaaaccttagccgggcatagtggcatgtgcctgtagtcccagttaatcaggaggctgaggcaggagaactgcttgaacccgggaggctgaagttgcagtaagccaagattgcaccatggcactccagcctggggcaacagagcaagactccatctcaaaaaaaaaaaagtaaatgagtcaaaaacactaagccacacaaaacacatttctctccataattactggtttatttgaatgagatctccatctagaactgcacttacacctagagaaaaactacctcctgtcactaccatcacacacagctacccacacacacacacaacccctccatctgtatcttctgctgatcattcattggaactacccattagttcctgagtcaaagaacgcccctccaaattcagtggtccactcagagaatctggctggatcccttccacactaatctgtgaggtcttccagctcctcttctaccacgtgttctctgactttgattttcaaaacatacattttcattaatttttgtcttcgctttcaatcttttcactttttgggggcaatattccttatgcaaatttgcttagcatctaaatccaaatctatatatatttagatctagatccaaatatatgtagatataatatttagatgtagatccaaatatatgtagatatatatattgtatctacatatatttggatctacatctaaatatatatagattcggatttagattctctctatataaataaagatgtatatgcatatatacagagacatctccctatatatatagatatatatctacacatatttggatttagcttccaagagaatctatctatctatatatatagatagatagatatacagagatatatccaaatctaaatctcctattgctaatttcatttcattcgttgaaaaatattgattggatgccttctctgtgccaggcattgctctagttatgagtacatcttggcatacatcggtgaataagaaatttaaaaaagacaaagatccctgactgatggggaaaaaaaaaaaaaaagaccaaggtaaggagtcactggaggataggaagccttgcagggagagagtgtgattggttcattctccacccagaactttcctattaaaataccaggtgacctggaaactctgcttctccatctttctcacaggcagaatgttaaaatctgacactgacttctattgacattgactctctccttatacatcctcacatttatcctttcctcttaaactttatcactgctgcatctgtcaacattttcaggtgtagtgaaggatcctgtttctgaattttcatgtccctggaacgatttgccttcccactctgacactgtcaatggcctatctctgacttttgacttcaaatgtcaaaaacctgcaaaaagtagtttcatgtattcagcaatttactactacctgggctatttctaccaccccaaccaagttactactataatctaatcaacagtctgtatttcacacaggccctccatgcctgaaacattattttgaccatttttaagcaattttctcttatcttcaaggtccagtttactctacttttgactttgcttccaggcaaaaggaaataaatgtgctctctagcacattaaaagtacatctttgataagtcccaacttaaatacataataaatggggatctagaaagaatgtaaaatatttaaataataaatacgtgaatcttataagataattactatttaccccgtaataaacttaaactcccagtggcctctggatttacctcaaaagctctgagtgtgagagcaatttcctcaagcaaatgtagatctttggaaaccaagacctttagcttgttccactttccttgcacatcatcaaattcttgcttatataatttttctacatcaggatgaacatttttctccagagcctttgtttcttctgcaagtttatgtaatgcaggtttctgattctcaaggatttcatcaagggtctggaaaaagttttaaaagattaaaaatatgcacaaaaatgtgtctgcacagatatagtaaaatgggctatataaagtcaaaagtcactttaaaatgcattagaaagcatttttatctaaaaagaacagtgggtgggagtgtgaattagttcaaccactgtggaagacagtgtggtgattcctcaaagacctaaaaccagaaatgccatttgacccagcaatctcactgggtatatacccaaaggaatacaaatcattctgttataaagatatatgcacactatgttcattgcagcacaattcacaatagcaaggacaaggaatcaacccaaatgcccatcaatgatagactacttaaagaaaatgtggtacatatcaaccatggaatactatgcagccataaaaaggaacaagatcatgtcctttgcaggtatatggatggagctggaagccattatcctcggcaaactaattcagaaacaacaaaaaaaaataccgcatattctcacttataagtgggagctgaataatgagaacatacggacacatggtggggaaaaacacacactggggtctgttggagggtggggcatggtgggagggaaagcatcaggaagaagagctaatggatgctgggcttaatacgtagtgcagcaaactaccatgacacacgtttacccatttaacaaacctgcacatcctgcacaagtacccctgaacttaaaataaaagttggaaatcaaaaaacaaaacaaaacaaaacatgaaaaactcatgaaaaaaataggcataatcataaaaattaaagctttttcttcatgagttgtgtgtgggcaatacagtgtattctcaaccctaaaaaccaagggaacagcaaacccagtgtgggccaagtgtgcagtgctcaatggctgctctccttttcatctaatagcacagagccataaggctactcaactaaatgacctcggaaacattcctattcgatgcagaaaaaagtatacatcaacacgtcaactgatagtcctcatttcataaagatattttagcagattttatgaacaggttgagaattttaagctaatcacagcagaaggagaaaatatgcttttcttctatgaaaaaatttttaataactgtactttcttttatgtgaggtcaaactaaccctcaaatcataaacacatttttgcaccaatgatgaacaaaactgaccaactttttttttaatctctgaaaaaacatttcaaaatatgtaagaggagatattagaagaagcgctagagttctaacatggaagatatatgttacctttttttcttgcagggccttctccaccttggcaagatcattaaggacattcagagacacctgggccttattttctgaatcatttagcacatctttcagtgttttcaatgtttccagatatgcatgtccaggttggcccttcagttctgtttatttaaaaatatttagtttgaaaaaatcatattaggaaccaatattattacatagaccattatcctaaatgaattccaatacatggcaaaggagaccccatgattaaaatgtaaaagggtctctgttaattaacaacatagatcattccattggcatttctgagagtcagacagtgacttcattcctgcggatgttgacgtttgaaatattaactaacccactataatttttcttcatttcttcatgatgaaatgtctctctgaagatggaacaacaatgtcccttttgttccatataatctcctcttccttaacagctacacaaagaataaaagaaaacaaagatcccttcaaccagtcttgctgtaagctccaccgtgtagacaaacccaggtccagagtggaggagattatatggaaatactgccaccatgctgcccaggtaccctgagaaataatgactgaacagccagctggaacagtgtctacctcagtcactaatgtaaaaatatcacagaagtaacacttgcgtggaaaggaagtgagttctcttgaagcacaaagaggtgaaaccaactagcagcaaaagttaaactgcctactgatccttgtcaaaagtgaaagcacagcttgtaccaataagtggagaaagaggtaccctcaaagacatatttcacataactgaattcaaggaacaaagacatgctgtccagatgcactttcagaagaaaggcaatacgacacatttgcctagcatgcacacatacagacacttccagtcatcacacaatctacaattgctgaagttaggctgggttacatgtggagcatttcacacaatgctcaatgcatttcacaaaataatgcacaatgcaacacagttcctaactcaaatggcagctaggaagtaaatagtgtaacgtaggagggatgagctttcaaaatctttaacagtgaaccttccaaaaccaagtgtattccaaaagtaagaactctaaaatttttctgaatctgacagtggaatatgatttcttttaaaagacagtatgagactgccaaaactttaactattttgaggaaacagaagtaagggatcattcattttgatcctcctagcaatgatattaagtggcctcctcaaccaaaggaagaaattgcacctgtttctcaaaaaaaaaaaaaaaaaaaatctttaaaaatcattatatccaggtcaggtacaatggctgacacctgttatccctggtattttgggaggctaacatctgttattttgcctaacacctgttattttgggaggctgttatatcacctgttataatggcttacacctgttattttgggaggctgaggtgggaagatcacttgagcccaggagttctagaccagcgtgggcaacatagctagaccctggctctactaaaaataaaaaaccagccaggcatggtggtgcatgcctgtagtcccagctactcagtaggctgaggcagaaggaccactgaaacccaggaggtcaagactgcagctatgattgcaccactgctctccagcctgggtgacagagtgagatcctgtagctacaaaaaaaaaaattattattatatcctactgacacaattttagagaatgtgaaacttgcttgtatgtttacaaaaaggtgtgaatctggaaaagaatctgaatacagaagactttaagactttgaacaatacaggcacaaaggaaaatggagaaggttggtgcaaagcaagcaagtgtactcaagttctaaatgttgggagtcatgtttacattaaggcaaactgagacaggagattttaaaattgttgggtttaccattctctagatgttgttgacgatcctctacagcctcttgtacagcttggtagcggcccagaaagctatcgaagccccgctggacaaaatctggggcagaaggctgagacatcagggccgagcagcttgcacgagccatttcaattttggggtgaaggccaagaagatttgtcaattcccgctaaggaagagaaaatacggtcacacaactcactgaagatgaacatcctcacaggaagttaatcagggcagcattaacttaaagttcatgatacgagaagccctccttaactctggaactgcacatagaattcctccactttccagaccgttggctccttacctgacaggaatccttcaagcttggcaaggactgccgggaagattcagaaatggaagtgtgttttacccactcctcctttgtcttgatgaccttttcaagctcatcaagctgcttgaaataagcatttatatcttcctgtagctgaatctttctttctagatcttccaaatgttgagatacattcttccattctgatgaaaccttctccagaacattttttatttcttcagtaggaaggccttctatgcagacatgaaaaacaagcaaacagtctatatattacaaaatgtgtcttgaatttattctgaacattctaacactcagaatagtgaggcaatgtcacacataatgatcactttcttaagtcccttttaatacaacaacaaaaatttataatgatgcacttaaaaataatgatgtttatttcaattccttgaacaaagaagaaagacattttaaaataacgattcaggcacatcagtagaacttcagccactgccttttctagataatatatgtttccatccatgccatgcttctactctgctagtttatcacctgaaccagtgaaataagatcaactaccttgatctgtctaggcccgacttcagaaagaagaccctttgtcctaagaaaaaaagaaagctggctagaaaaactaggaggcagctcaggtcttggtgaccaaagcacagtgtcatataaattaaaaaatgaatggcgaggatgccttatgctgggaagcaacctggtgagtgcaggaatattaagccagcagccaggctctagaagcatcagcaagcccactggagaccttgcacataaataagcaaataccaaaagactgaggcagcaataagatgatctactttagaaacacatcagggaaaacaatgccaccatttttattactgaaatcttatcattttatttgtccgatatttttgaaaagtagagaatgttcctaaaaataataaagtcatatataataataggttttatcatagtccttcccttaatctaaaataccttcaaatcctctaaaatgactatgaaaaagtatgggaaatcttcaaaggaatctttctattcggaggaaaacatgcataccaaaaggatggcttcacatttttattgagtaggaaagcaataaaacaatcctgctttataaacatatatgatcaaaatccaggataatgagagcttgaactaaaaaacaaaggcataaaaacaaaaagtcatgtatgatccacagacaatgcaactttgaaaatttttataatacactgtgtctactgaaaatcataaatgagggcatatcatgctgtcatttgaatgtgtcacctatgtcaattgcagaagttcactgttcaccaccatctctcaggtaagagaatatgagacataagcaaagcattcacaccacaagccatgctgcattacccctgttaatggggagagtatacaaaacaaatcaccattttcctaacaatatgaacaatggagatatgggtcatgcccctgccccatcatttctattctaggcaggcaaaggaatagtaacaccagccacatcatctttatgttggacaattcatactaatcaaggaagaaaattaagtaggtaaataaaatttctgagatggaaaattaccactactcatctagaaaactggaaagaggtgctcacttcaagaacaagggcggttaaaacaacttcagttattttttcactgacaatgtcttacaagccattcattttgcctctttaaaccaattttaaacatctgaatctccctttctctaatcctgagatattgctggttacagtgatgcccggtaatgattcaaacacaatttacatcttataaaaggaaaactgcacattgtctttaaaaatagttgttttactcccagagatccagagtttaaaattttctatttctataaaacacagagttcttagaaggtgactagtcaaaaggcaaaatcaacagaagatcactttattaattgtctaaaagggagaacatagaacacattcctgccactcagtctcacttgactttacacttctcagtctatcactattggaatcaagggaaacgtttacaaaacataggaccttcaccaaacttcctgggcttatatgcttaggcaaccacaatgggcattgattcataaagccacattatccagatgcccaactactctactgtattttactagatgaagagctctaggaacaagataagctaaacgaagaaaaccaagtatatcagctatgaaagtcaaatgaaacacactattttatttattattattattattattattattattattattattattattttgagacagagtcttgctctgtcaccaggctggagtgtagtggtgcaatctcagctcactgcaacctccgactccctggttcaagcgattctcctgcctcagcctcctgagtaactgagattacaggcatgtgccaccatgcccagctaatttttgtatttttagtagagacgaggtttcaccatgttgcccaggatggtgttgatctcctgacctcgtgacccacccacctcggcctcccaaagttctgggattacaggtgtgagccactgcgcccagcctcacgctattttattttctaaaattgtttctatgctctatgagatacctcaaaacttatgtaaaatgcattaggcaggaaagacctatcagaattggctatggtgggctttttgatggaactggtttcagaaaaacagtgacgtgattattcaaatatgggttttactgaagaatttgacatgcctccctaactgaactggaacacacagactttatccagttcagctcccccatttctcagcttcccactgttgtcctaaaaaaaattttttaatagatgcatctttaaaacaaaaaagaattagggtcctctaatgaatgcatttctaattccaccaatgcttgaaaaaacatgataatacaaactataaaaggtttcctatgaaattgggcaagtatacattaggtgacaaaagccccatgtcaactattctccagtgttgcctttggccttttgcaagtagcactttcatgtgaactcaatgtccagaatgtgtctatttaggacccatttatggtagaattttatggaccaaagcctatagtcagctaataaactaatagtcacctgataaactaacagctaagagtcagctaataaactccctcattttccagacaccaaggcaaagaaacaagggttccaagactttcccaaggataagaaactagaaaaggacaggagaatccaagtttgcccattcccccaatcactgttattctcactataacatcacctcgcaccaacttctcatctacatcaagtctcccccatcttcataattctgccacactgctgaaaacctgacagaaatgggagtaaattcagtacacagattcaagaaattatcccatattcacatcagataaagtcagagtcaccaggtacaatgctgaggtagaagtaaaaaatctatgcttgtaaaggaaataaattcaacatccaatgcattataattattgaatgaatctcaagggaagttatcatctgtttgtgtctctggatctcttcaagtaaatactggaaagagtaacctccaagtgggatgcccacaggaaggacaactaagacaatctgctagaatggattttgaaagaaaatattaaatactattctatttaatttatttaaagaaagaaattaacatttattaataataaatggattgataatacatttgcataatttcaaaataaatggacatacactgtccacatggtatacattccatattttgtgtgtatgtgtatatatctatatatgtttgtgtgtgtatatatgtttctgtgtgtttgtgtgtgtgtgtgtatacacatatccagtatacatactaaataaataaacatatttgttaaaggctggaggcaaaataatctaaggtcaaaacaacatgaacagttgttttctggagggaggaaggtgactaacccaaaagagaaatttctggaaagatggaaattttctacagtgatgtgtgtgtgtaggttacacaggtatatctatttgtcaaaacagcacagctaagtcatgtatttcaatgtaagtaaattttacttccaagaaaactgtaaaaatagtaataattgagaggctgaggaacgagtaaaggtatagataattcaagaatggcagaatattgtcaattactaaactaggtaactgatacaaggaagttcattatagtattctatttgcttttatacagttatattttccataacaaaaagtcaaacaataaaaaattaaatgctactgcttttaagattcttgtcaaactaatattcctaattctgtataggtatctgtacaggtgtcaaggagagctacagcagccttccaaagtgcttaccattattagaccaacgtacatggagtgcaagaaatgtctttcaacatttctctagaacaaagagagattcatatgcaaaactgcacatcaagaatattaatctttagcttattctgagtcactgggagctacagcaaaaaaaaaagtcttgggagcatttaaaaatttcatatataagtaacaccttatcaaacttaactataaaaatactgtagtaaataaatataatgcattaaaagttatcaaaaatcaaatacccttaatgaatttaacgtaacttcgtttcccaaatgttgccaagtaaagttttcttttgctaccaccctgcaaacaaattcccaatatataaacccaaaggatacagttttaaaatatactatgctagtgggttttaactgttctgctaatcagggtatccagccccgaccccatataaaatcagaacaactttgcttttatctgcttttttacaatcagcttcagaataaaatttcatttttaaagattctgctgcctaaaaacatttttgaaaaccatttatctagccaaaagaggattcgagtattaaagcaaaatatttaatagggcaaactgtaatattattcgatgccaccatctgaaaaatataggggaaaaaaatcaaggatcttaccttttcccatttgctccacaaggatttgtccagtttggtttaattcatctgctctggggattctttctctctgttctttttctaatgcctgcaaatgaagtcccaacataagaatattgcaaactttcttctcaatataatgttgctgttttaaatgtttaagttgaatggccctcctacattctttttaaatctgaaaaggtaaattcaaacgtaatcatagcaactaaaaagcattggtttcttttgtaagaaaaaaaatgtacctcataattataagctcctattagaaggaaataattaaaattatgttttagatccaggatatctattcacatacataccctgagtacgccatgccataaaaataatggtttgagtcaaaagaattgaatgtgttatgacagaagttgttgaacaaaaattaactaacaagaaaaaaggataggctgggcatggtggctcacacctgtaatcccaacactttggaaggctgaggggggtggatcactagaggtcaggagtttgagaccagtctggccaacatggtgaaaccccaactctactaaaaatacaaaaattagccaagcgtggtggcgtgtgcctataatcccagctgctcaggaggcttaggcatgagaattgcttgaacccgggaggcagaggttgcagggagccgagattgcaccactgcactccagcctgggcaacagagcaaaactcccatctcaaaagaaagaaaacagaaaaaatggatagaaatattttgaggctcagtattatttgtttgggttatattaagtctagggttcaatgcaaacttcaagcacaatcatatttcatacataatttttaaataatgaaaatagtaaatatgctttagaacccaaaccaaagcattttgttccttttttttttttttttctttgaggcaggttgtcactctgtcacccaggctggggtgcagtggcacaatcatggctcactgcagcctcaacctcctgggctcaaaggatcctcctatctcagcctcccgagtagttggagttacaagtgcaagctcacgccccacaaatttttttttttttttactttttgtagagacgggggtctccctatggtgcccaggctggtctcaaactcctgggctcaagcaatcctcctgccttgtgctggaattataagcgtgagccatggcaagcccaacccacattttgttctttatgttgaggaatggctcctaatttcattattttttttatctctatagtttgatactcccaagacaaaattctttccagaactagtaagaatgaagcaagtaaaatcatgtatacacacaaaaacacaactatatgtgcacacaactcggtatttgaattttctctcattcctccatccccaactgatatttatatattattcatatttatatactattcaaatagtatccatcataacacaatcacaacttctgagcaacccatattacttcaaccagacaatccagagaagaatcccaattctaaattgtttacatgtaagtgctatcaaataaattcagctatcctactttgattttcacaaagtttactgtgactaggtagaacaaccttcttatagtcaaagatcaaggaatattagtaagagactctaagaaacaccgtttattttgtctaactaaagatcaatgtaaaagtcaccatcgaactggagaaaaaggcaattatctactttttacaagttgattttttgctacctcttaagatggcaggagactagactatagattctctacccaggtgcccaaatagttaatgcagtaatgtgtaggagacgtatgagcacccaggacaaaaaagctctgcaagttcccatcacactcttcagaaacacacataagcatggaaagcggcagggctaagatcccacaccttttaattgtatttattttttacaactctaaagaaaatatattgaatacactttttgatttaaaatagtttgttgtattccgaaggcaaaacatcttcagcataatgttaatatagagtcataaattattagataccagattaagggtgatctaaactaactaaaaagtagtaccactaactggatcaccataagaagtattcctcactgtacatctcagtgactgacaaagatgaaaaaaaaaaaacgtcctccaaatagggatctgatgacagctagcatgaatggattcaaaattcactacaatgtactaaaagctaccttctgcctacatttattttacaggaggcttttgaattccataatgtctttatgccagcagaaaatccagcatgatgaactattttatgcactaggatatatgtggtttatgttttttaccttcaacttctttttcatttcggaagtgtcttgcatcttcatatactcttttatctctgtggtctgaatggcagttttccatttcaaaatccagttcaacagctctgcacttatagcatcaaacctgtttgaagattcagaggtgaccatttgtcatgtttccttctactgttttacttgactccagaaagagcaactcaaatgctcatcaggaatatgtctttttatcactcccccaaaaacagcaacccagaaatagggtaaccatgcaaaatgagatcatatatttacaactaaaagtatgaaaagagtaataatattatagggttaataaacaattgaagaaaataattaaataatttgttgttgttgttgttgtttcgagatggagtctcgccctgtcacccaggcttgagtgcaatggcacgatctcggctcactgcaacctccgcctccagattcaaaggattctcctgcctcagcctcccgagtagctaggattataggtgcccaccaccacacccagctaatttttgtatttttagtagagacagagtttcaccatgttggccaggctgacctcatgatcggcccgccttggcctcccaaagtgctgtgattacagtcatgacccaccatgcctggccttaaataaaaatttttaaaactttacatattaaaacaattttcacctttataaggaatcacttgtatttttataaatgcttatagataataaaaaccagagttggttagataatcagcaaagaacaagtacagacattactaaagttaacatcttcttttgttcaatatgtaatgattgagccttactaaatgtcaggcactgggctgggctcttgatatgaaagtgaaccagatacaaatctcagctcccaaggagcttctagtctagtaagcaatggaaagtaacaggcaataacaaaagaatttgctaggtgctaattccaggaattcacaggagtggcttctaatccaattggggcatggatggcttcctaaaggagaacaacagcattacactgaggagtttcccttgccaagggaaagcagagaaagggaagatcacattttgcaaactgcaagtattagttaggcgtgtctggaataatgagtactgaactcacaagggagggacaattgacgatgtggccaagaatcacatggaccagctacaagaaggccctgcaggacatattaaggagtttggacttaacccaaaggcagttgagagccaagggagagttctatgcatggaactgacatgattctatttatcctttagtgttcactgaggagaaggcattaaagagagacgagtcgagaacaggctgtgaaagcaacgggagtcacaactaagatagtaacagtgggaaggaagacgaaaggacaggtttgagaggtgttgagaaggttggtcaaaaccacagcaaggaggaacaagaggagtcacgatcactgattgctggccttctacccggcccctttctaagtgttttatgtctattattaactcaaggaatcctcaccagcaccctaaaaagtatacactattattatcccctttagagatgaaggtactgagctcacagaggttttcagtaactgtcccatgtcacaaagctaacaaagggtgaggctgggattcaaaccaagactgtcttcttaactagtaccctccccacagagcttctcgatacattaagcagtggcacaagtcgttattgctgattcttgtgagaaactttgcttaaagtgtttctggtgaactatgaatattttatcttttcatcaaggtagattttccctgtaaaatgtgagggattttgtgatgctctagataaatatctggggtcaaggtattgctcaaacagggatatgttcctcctgtcatcttaacagcagctttctatttaatatttcagagaagagacggccatctaaaaatcgcacgtttccaatgaccttggagactcagtcagcatctgctctcaatatgggcaagagtgatgcaatgatcgcaggtcacaggaacaggtgtctacattctaggaaatgactgtccactgtaccgcgagctggtaaaaaccaccaccacagcagcaccaggggaagagaagtggaaatgagctgccattttttaagcatatattttaaactaggcactgcattaagcagtcatttaaggccctcgattattggggtagtccattttaaggcaaaccaatagtggtttctagagcagacagaagatataaaagggtctggaaaccatgttaataggaatggttaaggatcccctgcactttctgacaataaaaactggggaagctatattcaaagactgaggaggtcactgtcgagttgtgacagtgaaagaaagaataaaaagacagtcatggacaatcatatccttccaaggagaataatgggaaaggaagaaagaaagcttcgatcacaaagttctcccaattgaacacaggataaataaaatcatccaagaaaatttggatgcttagctagtgccaagtagaatattcagaagacaggggcagtgagtggttcagtagttgacttttcataataataatacttattatgtctagatttgcctatgattaatgattagtacaaaataggcaccaagtagaaaatatagtatgtgcaatattggatttgaacaatttctctatctcttctcactttttcttagcttcaatatccacatggatctgtctcttctttgggggaggaggaggaggcagttcctgcttagatttttttgtaattgcttgttctcttacacgaacagtctccaaaaggtccttctgaggaatctgagacatccccagctttgctacagcctgagtcacctgaaataaaagccatccaaaatttcaatgtttataacagcttcattgagatgtaattcacatgctataaaattctttctttgaaatacacaatttaatggttattagcacatttatacagttgtataatcatcctcacagtctgtctccagaacattttatcaccccaaaaagaaatcccatagccataaaccaacactccccattccccactcccaccagtggcaaccatgcatttactttctatctctgtggattttccccttgtggacatttcctatgaatggaatcatagcgtatataatcttgcgattggcttcttatacttagcatagtgttttcaaggttcatctatgttgtagcatgtgtcaatacttcgttcttttgtattatcagataatattgtatgcatacaccacattttgtttatccattcatctgtgtatggatatttgagttgttccactttttggctattataaataatgctgctaagaatatctgtctacaaaccaatgttttatgtttgactaattcattaaaatatttttaagattaataagattacttaagatttaagatgttaagattatttattggctaagtataatcagttactataaattaaattataggatattaagataatctattaaaacttactttagaaaactgaaggtgattttcacatgtcaatttttcatcaggtgtaaggaaacaactttttagtttatttcatacaaattaaaactaacctgaacatttaaattttaaatgtttacttcatggcacaacatatgatccaaatcaaaaagtacctggttggaggaatcttctagtctctgaaccaaagaatcccatctttgagtcagttcctctgagtcactgttgatcttcttagatgccttggaattatcaagtaattgtcccacatcctggccaatctcactcagctgatccaatgtttgacgcttcatttccatgtcttccttcaaaatctagtatttcagatatttattagatgactctttttaacaggactttgtctttctgttccccagccaaaaattttaaacatgtatcttttatagtaaaatgtacatgctttgcagttcactatgctaaaaggtaagactcgtggttccagattgttacagggcagcagtctaatgctaggtaatgagctgtaatctgcattcactaaattctactaaccattagctataaaacattaagatatcataggcttacaacacagatgctgacaaccccatcacttacagccagacgtcgaacactgacacttagttccttttggtctttgaagttgcttgtctggactttatttaaagcctcttctttttcggttaaccaagctttcaacaagcactacaagtaataacaaaagttgaactttatctgcaaaatcatttggtaattcaattaaatcatgcatccaaatttctaacttttattttattagaggcttcacccttacatggggataagaaggccttcaaacacctaagtctgaggcacaaatgacccagaaagatacctttctttaaaatattatccttctcagatttgtaacagaacaatcagacattagcctcatacctagggaactaaacctaattctcaaggagataggtggagggaaaagggaaaatccaactatgcaagtctccaaaggaattacattacaacttcctagaggcagaagtaagctcggagattgtcttgtcccagcccctcattttagaaaggaaggaaagagaagtcaagttacatgtcccagatcacttggatagttaatggcagagctgggtccagggtccacaccccaaaaccagtgttttccatggcatcatgtaggaaatccacactagcattcaaggttcaacagcaattatgattaaaggagggagtctgaagagcacccaaagcccatataaagatttttcaacttcattggacaacaatgtgtgttttctaagcagaggatattcagtcatgtagagagataatcctgaagaagggatggaaaacaaccgtagctacattgtgataatttctcccaaaatgtagcatttagggtggaaacccttttctatttagtagggaggaaaacaacttggttctgtatttgcaacggaatcaattctttctcagcaattttatttatgaattaaatatttaacaactattccttgcctctatatttcaccccccaatggatactgtcctcagtctagtgaggctggtaagatatgcacataaataatgatgccatcagacagaacatgtagacagtacacacacacacacaaaaggtatagttaaaatgtcagatcattatagaacacgatgaaaggtcagtttaaaacctaaagtggtacaagtgactgaaatactagcactctatttttaaactgttttttatcatcaaattaaaattatttccaaatttgcaattactttactggatagaagagtaacacaatggttttctctagcaatcgatgtcttctactgcaattattactattactattatttttattttttgagacagagtctcactctgtcacccagactggagtgcagtggtgccatctcggatcactgcaacctctgcttcctgggttcaagcaattctcctgcctccatagcctcctgagtggctgggattacaggtgcccactgcaggcctggctaattttttgcatttttagtagagacaggtttcaacatgttggtctgacctcaagtgatctgcccgcctcggcctcccaaagtgctgggattacaagcgtgatccaccgcgcccagcctttctactgtcattattgaagtaaaattttaactattctgagactttttggcctaaatacaaggttcacaataaacataaatatttataaagtgaaatgtaaatatttgtaacatgaaatgtaaacatttcataaatcagaatcaggtcccttttgtgattcctaataagaaaaatctgaccacagattgagggcggggggggaagtagtcattaacaatttatatttggacaaattctgcaactatctgccaccatatttagtaagccacaaaacatcacacacttgagttttttcccctgaagagaatatagttgcttcttatagatggaaatgaaatgcatttaaaagaatcaaaatggacactgagagatgtgggaatagagtatttgcttttttttttttttttttgagagggagtctcgctcttgtctcccaggctggagtgcagtggcacagtctcggctcactgcaacctctgcctcctgggttccagcaattctcctgcctcagcctcctgagtagctgggattacaggcacccaccgccacacctggcttatttttatatttttagtggagacggggtttcactatgttggccgggctagtcttgaactcctgacttcaagtgatccacctgcctcagcctcccaaagtgctgggattacaggcgtgagccaccctgcccggccagtatctacttattttttaaaccacaactgtttggcatttggggagaaaagttttgtttatttgtattttgtttcaatggttgcttttctggaaagacagagaacaggcaaagagccaccagtcctattgaaaaattaaggtggcagctttgtacaacagattcatttgctgtgataacacttagtggaaaaaatatgcaattaatccagtgttaaatcaaaggtgtgactaaataatattttctcattaatttcaatacttgttaaaaatcaagaaaaaatctagggaattaaagttcacagtgtgttgagtggattcattactcattatttactgagcacaaattatatgctaggcattgtgttgatacaaattcaaatacatcacccaacacaaatccactaataactatgatgtcaaacaaatcatgaaaatagcatatcttctaagtactaacattccaagtaatgaaaacaggtcaaattaatggagccaaatgacacaatctctgtgaataagcttcatgatcagttataaactggatagaaatttgatctttaaaataattatttatatattttcctttcaaagaaaagtaaacaaggcaactttattctaaagtcacaataaaagatgggttacttttcaccatttattttgccccttatggaaaacagtttcatacctgttcttccaataattcctgccacaatatattgatttcttgtaacctattccagcgttcttcagtccaacggcatactgctgtccagcgctcaccaagtttctagaaaaaggagaaaccatcctttgtcaacacagccttaagagagagttatcacaatccttgaagaaattcatgatttccattgttctttattatagaataacaacttataaaaagtatttttataaaaattgctttaaaataacagactaggcctagaaatgtatgaatcagaaaaactaatttccatagaattgaacaaatgatttcacatagctagaaactaacataatagaactgtatcctctgaatctttgactccaaacctgctctttctatttcattgtggtttttatgagaatatgacatttttacatattattaaaaaataaaacaaacatatctactttttgtgcttcaaatttttcaaatttttagctaaaaaaaccagcatgtctgttatattccttaactctcttttacatgccaagaaaattttcatctgtggtaccaaaattatgaaaaatgtttaacttataaaacctgttttgaataagagaatttttatgagacaataaaaaaatcaaatgatttgttctgtttacattatgtgatccataaaaaaattccccataagttacataaattagcaatagaatcttactagtatcagcaatactaaataaattttattaattataaaaaatcactcttcatgattattttctcccaaaatcattttattacaattttacaaataatgattaacaaatgttaaaatttatttttgtactatatacatgtgaacaagaattatttaattcatattatactattttgatacttaatatgagaataagcttttcatagtacaaagggggagaaaacttaagagccagaagatagatttccagtctcagcatgataactcattgtctatttaaatctcaggaggactacttaacctctctgaatctcagattccttactgctaaatagtcaaggcatgaatacttagctctcaggttataataactaactactgcatacaagtcttagaacctctggctgactttaaatatcacaaaagcaaaaggacctcacgtgatgaaattacagtttggattgcctcacttaatgaggcatcatatttaaataaattggcaacgtcttaccagaaaatccaagtattgttcaaatgaaataccaataaatttatctgttaaagacttgtaaagatacactattgcctttgtgcaaaaagaagcaattttgggaggtttccaaaactgttgttgaaattcacatattaatctaccgaaaacactgagatattgaatcctactaggtgaaattctcaaactttactatgcacatgatttttcttacattgcaaattcactgcatccctccctcacctagatttaggtagtgggtagagcctaggaatctacattttaacaagctcctcaagtgcttctgagaagaagtcagtggatcacttaataagatcagctcctgtgtgatatggtttgcctgtgtctccatccaaatctcatcttgcattataactaccacagttctcacattttttgagaggaacttggtgggaggtaattgaagcatgggggcagatctttcccatgctgttctcattatagtgaataagtctcacgagatctgatggttttacaaaagggagtttccctgcacaagctctctctctttgcctgccaccatgcatgtaaatcgtgacttgctcctccttcccttctgccatgattgtgaggcctccccaacgatgtggaactgtaagtccattaaacctctttttcttcccagtctcaggtatgtttttatcagcagcatgaaaatggactaatatagtaaatcggtaccagtagagtggggtgctgttgaaaagataccctaaaatgtagaagtgactttggaactcggtaacaggcagaggttggaaacatttggagagctcagaagaagacagaaaaatgtgggaaaatttagggtacctgtggaagaaatttctaagcagcaaagcattcaggagatgacttgggtgctgttaaaggcattcagttttataaaggaaacagatcataaaagtttgagaaatttgcagcctgacaatgcaatagaaaagaaaatctcattttctgaggagaaattcaagctggctgcagaaatttgcataagtaacaaagaggcaaaagttaatcaccaagacaatgcggaaaacatctccaggcatgtcagaggtcttcacatcagcccctcccatcacaagcccagaggcctaggaggaaaaaatggttttgtgggctgggctcagggtccccgtgccttgtggctaggtacttggtgccctgcatcccagctgctccagccatgactaaaaggggcaaaggtacagctcaggccatggcaaaggtgcaagccacaagccttggcagcttccatgtggtgttgagcctgcgggtacacagaagtcaagaattgaggtttgggaacatccacctagatttcagaggatgtatggaaacacgtggatgtccaggcagaagtttgctgcagaggtggggctctcatggagaacctctgctagggcagtgcagaagggaaatgtggcccaaacagagtccctactgtggcaccacctagtggagctgtgagaagacggccactgtcctccagaccccagggtggtagatccactgacagcttgcactatgcacctggaaaagccgcagacactcaacactgacccatgaaagcagccaggagggggctatttcccgcaaagccacagaggcagcactgcccaagaccatgggaacctacctcttgcataggcgtgacctggatgtgaaacatgaagtcaaaggagatcattttgaagctttaagatttgactaccccaccgtattccatacttgaatggggactgtagcccttttgttttggccagtttctcccatttggaacagatgtatttactctttgcctgtgcccccattgtagctaggaagtaactaacttgcttttgactttgcaggctcataggcggaagggacttgccttgtctcagatgagactttggactgtggacttttgagttaatgctgaaatgagttaagactttgggggtactgttgggaaagcatgattggttgtgaaatgtgaggacataagatttgggagaggccaggggtggaatgatatggtttgcttgtgtccccatccaagtctcatcttgaattgtaactcccacaattcccacattttaagtgaggaacccagtgggaggtaattgattcatgggcgcaggtctctctcttgctgttcttgtgatagtgagtaagtctcacgaggtctgatggttttaaaaaaaggagtttccctgcacaagctccctctctttgcctgccaccatccatataaaatgtggcttgctcctccttcccttccaccatgattgtgaggtctccccagccacatggaactgtaagtcccttaaacctctttttcttcccagtctcaggtatgtctttatcagcagtgtgaaaacggactaatacactgtgcttccaaatcttgtcattatgcacaaggaagctggggactgcaaccagccccatccattcaccccaagagctgaagtaaaggaatcaatacctgggtactcctgtagcccacacactgtagaaccccaactgagaagtacaatcaaaggtaggtttttctacccttctggataaagaatgagaaaggacatgaagaacaagggcaatatgtaattgggtctcagaccacaggtccctcaggattatccaactttacagcactcttacctgtaactggtcttctaggatagctgtagcactctcaccactgttttcatcaacaatgaccaccatgtgagttagtgaatttactttcacctgttcagcctcaagatcactttgcaaactctagagaaaaaaattaagataaaccattatttctactttcacatttacctatttaaaacgcactcagttgtcaatagtaattaaggacagttaatgaggcatcatatttaaatttccaatcattaccctaactgttctactaatgaaactaatcctattatacatctttacattccattatcaacaaaggcagtttgaggatgcagtgttataacagactgcaaatggagatatcaccacttttattcaagttctggccctccctcagaatttatagcataaaggagttgagtgtccatactaggaattaatacaaaaatgtagaagtggtaaagcaaaaaagtccagagcttaaataaaccaagtcagagatcattttatctagtgtaggacagtataaagagataagtagaatgctacacgatagtcaaaagttactctgattagctacccaataaagcagttaaagaagtatggacaccttagattctctcgccttttccatgggaagagcatagtcattggatacatgtgtatagaaaatttataggctgggcatggtggctcacacctgtaatcccagcactttgggaacccaaggcaggcggatcacttgaggtcaggagttcaagaccagcctggccaacatggtgaaaccctgactttactaaaaatacaaaaaatacaaaaaattagctgggtgtggtggcacacgcctgtagtcccagctacttgggagactgaggtgggagaatcacttgaacccaggaggcagagggtgcagtgagctgagattttgccattgccctccagcctgggtgacagagcaagactccatctcaaaaaaaagaaagaaagaaagaaaatttatttaaatactatcaatagtgttctcaaatgcttctcagagttgtgtttaatgtattcctaaagttttacatattagttacctcaatgtttcactgatcaataaaagtcttcaatttacagagagcatattttattctatctttccttatcttgactatgaaaagtttatctcctagacttgtgaccaaattaaattgcccacccaattttggttcctaacttaatgcctgacgctttcctgaatcatagacgaagaatttgctcttcacccacacaccatgtgaacgccaacatgcttgggttcttagccacttagagggccaaaagaacccttctccagttgtatgaaagctatgtactttcaaaagaaaactgcacatcacatataaaattttaccgtgcccttttatccctggctcagaaaagtctcatctctatcaattccaccctgtgagctgctaaatgaagacaaccctgaagaagtgtcccaacttcatgttaacgatagatgtcatcagcctctgagatgctaagtgctgctctttcatatttgataaggtatcgaagaaatatgagacagatttactttatgttcttctagcagcttttgtagagattttacatcatcatccagggggcaagtttccatcttctgaatgcgctcctctgtgagtgttaaccaggcggagagctgctgcagttgcttcttctgcagttccatcagcacatcgtgcagcctgtccgtggggaacacagcattattcctacaagccttttccctttgcaaagtcaaatatacattctgggcaccggagatacagggcaagggaagacacccttgtctaaacattcaaggtagcatttagtctttaaatatagaagccaggaaagtaaacttttattttgtcctaaatggagttcattaaatgcagacaaagaatgcaaaaagcagcaccctgtattcatatcagaatcattgtttcttcaatcaggaattcctgcttattaaataggtggaagtggcaatgaatgcagtttgctccttaagacacaatacatgaaataaaataaaccatgagaaagctttaaaataaaagtcacaaaatggaaaagtagatcaatactccatagtcctgtcttcacaccaagttaatgtttagctaatcttaacattgcaaataagtaactgcccctatgaaatgtcttttcctttttttggagacagtctcactttgttacccaggctggagtgcagtggctgaatctcagctcactgcaatctctgtctcctgagttcaagcgatcctcatacctcaacctcccaagtagctaggattacaggcatggcccaccatgcccagctaatttttgtatttttagtagagacggagtttcgccatgtcgcccaggctggtctcaaactcctggcctcaagtgatccatccgcgttggcctcccaagtgctgggattacaggcatgagccaccatgcctatcctctttttcctttttgttaaattctgtattccaacttttatcttttggtgtggctaacacatcaaaggggaaacaaagatcatgcagaattccagcaatattacccgtagaaaagagtcttacttttccaaggcaagttctgtaatcatctcgctttcacagacatgcagacatctactagagctcaactgtgcaaagcagcctgtggaattaagtgcatttcttggctttccactcaccgggactgtctgtccatactctccaccctaagagcctcccatctagcattcagcagggtcatctgttcctgaatctcaaattcttcttcgtctgacagagttccttgtgttatcagttggttgcctgcctgcaggacgctgcccacactgctctggtgtgcagtcagttccatcataaaagcctagaaagggacattgttataatttgtgagctactcagtgcaaaaaaaaaaaaggaagactgaacaaattgctaatgcctaacctaaatgtcagtgatgcagaaaaaggtagcctagtagagcgcaaataaaatagacattgaccacattttttaatctctgaaaataggaataaacacctgccataagttaaaagagaaatagctcaaagcaagcaatgatgcatctgataataccagctattttaaagtaaatgctgactatgctactcatagatcatgaacatggaattctaaataaataaaataaaaggctgggtgtggtggctcacacctataatcccagcattttgggaggctgaggcaggtggatcacctaggccaggagttcaagaccagcctggacaacaaggtgaaaccccgtctctaactaaaaacacaaaaaattagccgggcgtggtggcacatgtttgcagtcccagctacttgggaggctgatgcaggagaatcacttgaagccaggaggtagaagttgcagtgagccaagattgtgccactgcactccagcctgggtgacagagtaagactctgttaaaaaaaaaaaaattataaatatatatatatacacacacatatacatatacatatataatatataaatagattatatataaaaatatttatatattttatttatatatatttatttatatattttatttatatataaaataaaatatatatttatttttatttatatatatttatatataaatatatatttatttattatatatataaatatatatataaaataaaataccatactcacccaagaggaactgtttaagagatattaccacttatattattttctatccaaaacaacaaataagatctgtcaattcacataactatacaaaagaaaaatttaaccaaaagaaatctccatatagtgaaattcactatgctgcaatatagtatgtcctcaaaggagcaggaaacttttatgatatgaaaaaatacaggaaccctgggtatgacatttgcttaatcatgcaattaaaaagaataatcatttcctagggaacactcaaatcttaaagatttggtgtattggttcactcgtttgcttttgaaatataacaatgcacttcagaactgagcagtactatgcaatgattttcatcagtggctctccaaaacacacaaggagactaaaatctaaaatctaattctgaggcacagtttaatcacccataccaattttgtgacaaagcactatttaaatatcacagttcctgaaataaaccattgacctttccaaagaacagaattcagtagataacaaataggagagtagagtccctgattaaggctcaggtcccgtgggggacacaccctgctaagaaactacagatatttacttcatgggttgcaaactggtctttgacttcttcaacatcatcagaaatatcatcctgctcctggaaagtgtcctcagcagaaagcaaccaggtcagcacttcctccaacgcaatctgatagctgtccagatccatgtcaacctcagtgacagtgctgggagtttcagctcggggactctcatgctcctcctcaggcgctgtactctgtaaaaacaaagccaagaaaaacccacactaatcatcaaagcaagaggtgttcagcaaactcacactgtatggcgaacccaaagtacccaccactctgtcttaggcactaatccaattctcaggagccaaatgggcactgccatgaatgagttagaagcattgagtaagtgcactagggtagcaaagagtataaaagcagcatgcactcatgaattctgtactcaaggagattctaatatagttagggacagagaacccacatgaatcacttctgaacagaaattgaagaacagctattagaaaagtaaatgccatggtcccaacaaggcatgatatttgagttcaacaaaggctaaaacaggaaagtttcgtagaggagctggaacgtgttaggccttttctgtaatttaaagaaaaagaaaggtgagaattctgccttgacccttaggtaaattgcttttgctgaactgcattttagcattgcattttagacactaaaagacagccacacaggctgctgtactgattgtatttttcttaggcagttgccctctggtttatctgatggccttttagggctcatggaataaatttctatcaacctctttctaaataactgagtatttccatatatactttaagagcttataaccaaattgactctccctagttcttttgttccctttcagagcaagatttcttgaagacttgcctacattctgtctctactttatcaactctcatgcatgatttttaagtacaatatttcaaatgtacagaaacgtatagagaacaatacaaaaaatgctcaagtatttaacagctatggtttgttaacattccctttaacttcaacttgctatttgccccatgactcaactgaaaaggcttttaccaatgtcatcaataaccttcccattgccaaacggacctttctagcatcatcttcagggtgaccatataattaaccaacaaactagagtatttttgatgataactgtgctcaaacaacaaatccaaaccagaactgtcccaagtaagcccggagagctggccacccacgttccttgcttcagaccttggtagcactcctcaaggctgagcaacttgagctttcagaagcttgtttccctgcttctgtgacactgccctggtttcctgctggttcaacagcagctgctgactcataagtaatgaatctcctcaaaattaagttctaggctcttttttctccccactgtatactgtgtctgagtaatctcatctactcctattggatttaaagaacatctagaaccacctaggagtctggattccaaactctcatatcccactattttcacatctctacttcagcgcctcctaggcatattaaaccatgtccatattcaaaacctttactttcttccaaagcttgttcctcctcagacttctccaactcagtagatggctcctccctgcaactaggtactccagctacaaacctgggagccagccccagcttctctctccttcatcttccacatttaatacataagtaattctgaccttccttcaaaacttcgctccctctccctccccctccccctcccctctttccacggtctccctctgatgccgagccgaagctggactgtactgctgccatctcggctcactgcaacctccctgcctgattctcctgcctcagcctgccgagtgcctgcaattgcaggtgcgcgccaccacgcctgactggttttcgtatttttttggtggagacggggtttcgctgtgttggccgggctggtctccagctcctgaccgcgagtgatccgccagcctcggcctcccgaggtgccgggattgcagacggagtctagttcactcagcgctcaatggtgcccaggctggagtgcagtggcgtgatctcggctcgctacaacctccacatcccagccgcctgccttggcctcccaaagtgccgagactgcagcctctgcccggctgccaccccgtctgggaagtgaggagcgtctctgcctggccgcccatcgtctgggatgtgaggagcccctctgcctggctgcccagtctggaaagtgaggagcgtctctgcccggccgccatcccatctaggaagtgaggagcacctcttcccggccgccatcccatctaggaagtgaggagcatctctgcccgactgcccatcttctgagatgtggggagcgcctctgccccgccaccccatctgggatgtgaggagtgcctctgcccggccgcgaccccgtctgggaggtgaggagcgtctctgcccggccgccccgtctgagaagtgaggagaccctctgcctggcaaccgccccatctgagaagggaggagcccctccgcccggcagccgccccatctgagaagtgaggagcccctctgcccggcagccaccccgtctgggaagtgaggagaccctctgcctggcaaccgccccgtctgagaagtgaggagcccctccgcccggcagccaccccgtctgggaagtgaggagcgtctccgcccggcagccaccccgtccgggagggaggtgggggtcagcccccgccaggccagccgccccgtccgggagggaggtggggggttcagccccccacccggccagccgccccgtccgggaggtgaggggcgcctctgcctggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaaggagacatgggagacttttcattttgttctgtactaagaaaaattcttctgccttgggatcctgttgatctgtgaccttgcccccaaccctgtgctctctgaaacatgtgctgtgtccactcagggttaaatggattaagggcggtgcaagatgtgctttgttaaacagatgctagaaggcagcatgctcgttaagagtcatcaccactccctaatctcaaggacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaatatatattaaaaaaaaaaaagacttatctcaaatccatccagacctttccatttccacaaccacacacatccatcttctgaactggaatacctgctaacaagtgtctttactttcctgttttcccccacccaacactctcaccttcacaatccacagtccatttctcacacagcagccagaatgatctttcaaaaatgtaatgccatcataagacgtacctgctgaaaacctttcactggctttcccaatgctcttaagatacaatttaaaattcttaacacagtttacaaaaatactgtgatagtaagaaaccaagatagagtgacagaaagagagagagagacagagagttgtattttgatagattaatcagaaaagacttctctgaaaaggctccatttaaactgaggaaaaatgtgcaggctgccatataatggtgggtgcagaagcatttaacagaggggaacctgcatgaacaagagtcttgggggaaaagtccactctaactgcagggcagagtagcagaggtaggccacagcttgtaaactataggagaaaatgaagtctttaaatagcattaggagatatacctaatgctaaaggacgagttaatgggtgcagcacaccacccgtggcacatgtatacatatgtaacaaaccttcatgttgtgcacatgtaccctaaaacttaaagtataatactaaaaaaataaaataaaaatgagtatgaaggctgcaataaaatgaaaacacacacaaaagacattttggaggaaggcttgaagaatccaggaaactgaatatatgagttaagaaatgaaccaatcagcacagagtcgaaacagtggataattaaaagacagatggtgccaaagacagagaaagaaaaatgagttaagttatggacaaaaaatcctaaaactgtagagctaaaataacccctggagatcatttagctccaaacctctatactataatgagaatttctaagaaccaggaaagttagtgaccagccaaaggtcactgagataggcaccagcatccatgaggtcgagaaggaaggcactatctaaacacaaatgttcagacggtattaattcgaacacatgaggaaactttcaactgacggatatttaaagagaaatgcaggaattattcattgaccaccagcgtatgtttgtagaaagaacagggcagaagaagtctgactattaggagagtagcagatggcaagctatgtcagagagatgattaaaacttgatcacattttagttttcaattaacgtaattcagcctctaagacactaatgaaagcttgcaaatgaagaggtgttaatacacttgcacttaatcaaatagcaaatgttttctgaagttcttatcatgccacgctgagccctaaacagaagtgattattttatctacacatcatgaaaagtaaatgaagtctccttcctttttaagagagaaggcccttaactataagaactaaataaaatatctcctccttctaacaaaatgcaataaggaaatgaatctaaaaccctgtaacaaactcagaagatcatctgagccaactaaaaaggtgcatcattaatgtagaataataactatacttttagaggcaaatacttcctagcatttttttcaattatagtaagttaggaattttcctcagcatcatttgatattcactacaaaagagagccctgggttcacaatcaggcctcatttctcaatcctttcttttcagtaaatttttttctttttctataaatcacactatttttgaaacgggggaaataaaaggatgggtacatattacccaaagaaaatttaaaagaataagtaaattctctgaatctcagaggatggaaaaaaaagatgctatgtcaattcaagactagtatcataatatgggaattaaataatattttttaaagaaatctgttaaatgagaatgccaaaacaaatcaagaagaaaaatgataataatgatagctgttgcttgttgagtgtttattaatgtcattttagatactttgaattcattatctttatgaagttggtggttttaaccacattttgcagacaaaactgtgattgagagtttaagtaacaacccaaaacaagtagcaacaggatgaatttaaggtccatccagagaagctttctttctctctgaaatgtagttcttataattttgaaatctacatgtatgtcttggttgcttggtcactagaatgttgaaccaagtgacttctaaggtccaattcttaagattctctcatcttatgaattacaaggactggctagactaaaacagaatgagattaaatatggattgattcaaacagtagaactaaggaagaaaataaattatgattttatttctctctttaaaaattcatttatatcctgatgaatgaaatcatcgtaatcccttcatgaaaagctcaccaagtagtttaccatacattactcctcctaaaggaaagggaaaataaggcttacattttgatagcccttgtgagatatataatggaaaaaaaatcttttctcaatggcaaaaaaagaaagacaattagtacttagaaaaaaaactaggctgatatgagaaaaaccatctttagcacatgacagaaataaaagctggcaaccagatgatgtgaaaacatagattcccagcatgtcatgcagcagcatgagcaacagcccagttttgctgggtgaaataaagtattttccttcttaataaagtccattgagttatggtgttctattacacacatgtgacagaatgctaactgctaagctgaacttcttatgcaaatgtaagctgagaaaccaagatgttctcagtcaagaaaaaaaccctctaaaagtgtttttatctagtacctaggagaaaacaaatacggcaagccaaacatcttaataaaatgttacctgtacctgtatattaattgcctcttcttcacattcttttttatatttccttgggagtgtctctacctcacggatggcgtctatggtgacttgctgaggtagcacctcaaacaaagatgttaaatacataattatggatttcttgtcaggaagctgaacggcaacatctaaaagtggaagaatataagaaccagcttaaattaggtgtccaaaatatgtgaattgctcaatattagatataaaataactctccttagtacccataaacaatacctaatatataatctttgcaataccagtaaattgccacttcataatatatgagacaaaggcaaaagggattacttatttttgttcagtatctcattttttaaagtcttccctaaaagcctccccaaaatggtcaaagataagctaccatatgttaccatttaagataaagatacagactttattcatactatgaaaataagtctagaattcaatcctgcaacatttataactaaagtctttacatcacatgcaagatgctcacataaaaatgcattttattggactaaccagatactgaatttatctaataattacattttcttaaaactttaactcttacttaatttagattaactattgtccagtgctgtagttaaatttctacctaaaagatcccacaaactgctaagtacaaaagtattaataagtgtcagtaataaaatgactcgcacctatactccaaaaaggaaaaggttcttcaagtctcataattcatttttaaaaggacaaagaaacactgcttttcaagaatgcaaaactgtaaagcaaaatcaaggtggaaattaaatactggacaataccttcaggatctaacagcttttcaattcccaaataagtttgagccttgctgaaggcatgttcaagtctctcaattggtgacattttgacaactttatcccagctgaagagatcaggtctgaaaaccatgcaaataaaatgcaatgaagatgaaatatgtggaaacaaagtaggcattgttataatctaatacattttagttttagattatttttatttgtgaggtttttttgagtttatttttatatcccaaaggcttgtcaaatacatacttgaaattaattcacaaatatgaaaataacagataatactttccaagggtcttgtattagctaaataggactgctattttctgtggtaaccattaagactagaagtagtatataatgtttcccaaagagtagaagaagaaaagggggtaaagggaaacctaccgatacaaaaagagataagaaagtaaaaaaaaaaaaaaccacagaaaaaataagaaaaatgagcagctcacactatgcggtaaaaatgaacctaaatatataaataatcataatcaatgttaatggactaaattcttcaattaaaagatcaagattagcagaacacaaaatctagctctaatctgttctcaggatattcctaaaacaaaagccttggaagagtttccctccaatcccctgcttccatgctactactatattgtctaggactgtatttcatttctatcttgattttcttttaatctcacaaattggacattattgttgctttgacttatccaaaagttaatcattttctttattctgtgtctgttcttgcatgttagacccacccaccttctgggatgcacttcccccacttccctccctgaattcatctcccattactccccccactcaggtcactgcagccactgccctctccgatgccaagtgcctcctctgctcttgtctgatgtattttccttcagtgtgtgtacatttctatatactacacaactttattattgtcttgtctccctctgttggaacataagctccacgagaactaagatttttgcctgttttgttctctgctgtataccctgtgtctagcacataaaaggcaccccacacgtatttgttgaatcaattaattaataaatggaatggtatattggctaaaattctacagtttcttgataaaatcccttaaccaactaaaaacctagggcaacctcctttaacctcataaaaagtgtaccaaaaaagctacaaaaactatcattcttatggtaaaacactaaaagcactccttttattatcaacaacaaaaattctgcccactatcaccaattcaaatcaacattgcattgaaggacaaggcacaatagagaacaaaaaagaaaacagaagaaataaaaggatcataattctaggacattctaatccctcctcctccaagaaacctacaatctagagacaaacttactaaaatttgtaagaactgattaagtttccagatataagacgtagaaaagtctattgcacttttatataccagcaaaaaaacatagaggaagtgaaatttgagaaaagtaatcatttacaacaataaaatataacaaattttgcctttggcatttaaatccctgatccatgtagaaattattattttttttttagtgtggtgaagtaaagatccaatacatttatttatatatgggtaatcaattgtccaaatcatctattaatctgcaatgtcagctcaagcgtatatcagattttcctgtgtaatggagcaatttctgagttcttaattttattaggttgaaccatatgaaaacaccattcttatatagcaaaaacactcacatgtcggcaatttcatatggttcagcttatattggtgtgtatattgatagtactgcatagtcttaattaatatagcttcatagttttggtttctttttggaaagtatttcagcctgattcttcctcagaagtctactggctattcttgggcctcgtcttttatataattagaatctgttcacaagtttcattaaagacaatttggctatttttaattgggaatgcattgaatttacagagttttactttcagtttgagaagaaaagctaacacaattttttgtatacattatcagttagtgctgaatgagtggggttgaactttgtgaattatttcatattttttaaattcataaatatgcaggagaaactatggaccttgtattgcagcatttaagtcctaaggaaataaaaacctgatgggtagttttcttccatgatatttcttttcttaaggttttggtagaacatgtgcagaaaggagagcagtggcactggagaaggggcttcagggagtagtggtggcagcaaagggacagagaggagacatgaatttgtaaagcccacttctagatagagtaatgtctcacttatgtcggtggaggacagcattaaaggcgagtccatctgtccagctggtggtgaagttgaggacgttgacttggctgtagggcctggtggtctgacgcacccagctgagcaggatcttctcactgttcgtctgctgcaggtccgacatgacatccttcatgacatctttcacctatgtaagagaaaccaggcctgtccataactaatacttcagtaatttacttcaacttacttcaatgaagtccttgaaaaagcaatattgcactaattaaccattatggatcaggtaactggcattcattttacttcagatttttctgtagacactagagcaatacattttaacagtgattattttgggggactagaatttgaggtgatttttacctcacttttatacattactgtgttttctatatcttaagcaatacttgtactatgtttggttacaatgaacataactttcacagtcatagaaagtcatatttaactctatgtgtttacaaagaccttttcaattaaattttattttctacaaaaatgagaaaggaaaaacttttgagtgactacaaaataaagtatctttcctgactgcaatcacgattatactctagaactaacattttatagtattattctaaattagtaaatatgttttaagaaagtgctcaaagaatgacatagatctatctaagggacacaggagccaatttaaggggctcacactggccaaatctaggatgacttgaacactgaaatgagtactagtaaaagatcataaacctatgcaaatgtccatgaatctatactgatacataaatgaataaatgaatggagagagagataagatagagaaacaagaaacaaggggaagctcttctttacaagtagaacaccaactaatgtagaaggattaatgaaattagaaaatcattatctatcaagcatcataataatagctggtccaggcaaaaattatgaacgggtgctaaaagtttgataaaaactaaatatttatacagtctcaaagtatatccccacccgatacttttaataacaaagggtagtcaatttacagggaagaaacttggtaaataccaccttagccaaacaatcaaagttaacactgccagaaaaagaacagatatcacctatccccgatatgatgcactaagaagaactcacgtcacttttgtgacgtccctgccaaaagtgaacaacctgaacttaatcataaggaaagctcagccaagcccaagcccactgagagagacattctacaaaataactagccagcactcttcaaaaatatcaatatcatgaaatacaaagactcaaaaacttccagattaaagaggactaaagagacatgaaaaataaatgtaatgcatgatctcagattttcttttgctactaaggatattattgggacaactgacaaaatcttaagatctgtagattacataattgtattatttcaatgttattttcttgattttaataattatatactaagttttcatatttaataatcaataattggcattttaaatatcaatattttacatctcatattattataccaatatgctattgtgtttacataagagagttcttgtttttaggagaatgccatggcgttagaaaatacacactaaatattttaggcagactgagagagagtacaaatgaaatatagacaactggtaacatttaggaaatgtgagtgaaaggtacttgggaattctttgaactattcctgcaacttttctagatgtgaaattatgtccctttttaaaatttaacataagaaaggtaggtacttttttccctatgccaggaaaatagggcattttgtcagcctcttccattgaaaattgttatgagttgaattatgttctctaaaattaatatgttgaagtcctaaccctcagtacttcagagaggggctctatttggaaataaggtcattgcagatgtcactagttagaatgaggtcatacaggagtaatgtgggccctaaatccaatatgactgatgtccttacaaaaagaggaaatttgacagatatgcacacagggagaacaccacgtcaacactggagctatgttatcacaggccaaggaactgcaaaaattgcagacaaaccaccagaatttgggggcaaggcctggatcagagtctccctcagagccctcaggaaaaaccaaccctgctgatgccttgatcttggacttctggcctccagaactgggagacaacaaatttctgttgttcaagccaagcagcttgtggtacttggttacggcagccttaagaaactaaaagacaaacaacacattttccatctctattaaaaagtgattggaaatttccccacctgccagtgcaaaatgatgctccaaagtaaccccaaagtcagtttgtgatttccatccacaatgtcagttccccctatattcactaattccacctattaagacaaaacaaaaaacaaaaacaaaaacgcttttaagacaatttcttcacagaactccaggtttttattttagcacatttggacagcagtataagtgagagataagagaaatttcattttagagaatcaggtaagcttaaatctcaaaaatgtattatttatactacagatcaatacagccatcagaaaaagcacatgactgtttcttcactcacagaaaaagttcagtatttctcataagaaaaaatgtttgcaagaatcagtggatgccaatgcatcaagcagttggtgagtttcacaataaataatgctgatggcagcacagacccccagaactcacattacacacttacattgttctgatgtaaaacctgcagcactctgttgacgttatttaaggcatgtacccttgtggaaccacgttcctttggctggaaaataaaacaaaaaagcaagtaaaactgattgtccctccatatgcctgactaacactagcactgagatacacacagaagtgaagctcagcgtacagggcccctcagaggcaggagatctggctgaggtctcaggttaccaccctggaagctggtgttcacagtatgaaaatccctcaactaacaacatcttaagataccagttccctaacttgcatgcacgttgaaatctcctaggcagcttcataaaaacaccaatacctctgtccaaccccacccccaaagagtgtggcttaatgggtctagggtgtggtctggacttgggatttttaaaagattgcctgtagttctaatgtgcagacaagtttggaaaccagtgctctatgaacaaagcttcctttctcttaattggtctggctgcagaaggattttagagaaattgtgtcctctttattctgcacagatgtgaacagagcaaggaggattcagaggcaccatcccaggctccaggtagcattgcaagagccctcggaaggcagggaattcccatctggggaaagataacctatgcagcttctttctacttcactggccagaaccttatctgagagaggaatcagcctgtctaacagttgtctacccactacctggagggcaaagagagagaatgacatcccacacttctgcaagaaagaaattcatcttcaggagtgcatctctctgtactgtgatagtaattctacctctagagttaacatttgtacccatacatgcatcctctttattggcagttttatctgcatgagtttggagtaccccacacataaaataatagagttgtatttaaaaaataaatcaacaaaatataatcctgaaaatctgaataaaaaatagatgtcatagtttttaacaacttttttttttttttgagacggagtctcactctgttgcccaggctggagtgcagtggcgcaatctcggctcactgcaacctccacctcctgtgttcaagcaattctcctggcctcagcctcctgagtacctgggattacaggcacatgccgccacacccagctaattttttgtattttagtagagatggggtttcaccatgttgctcaggctggtctcgaactgctgagctcaggcaatccgcccaccttggcttcccaaagtgctaggattacaggcgtgagctaccgcgcccagccttaacaactgttttaaaaaatatttaactcttaaatgtgtttgtctccagactctactgttcaaaacattgtgtcctctctataaatccattcttttttgtaattctctcatcctgggctgtctcagagcaataaacatttaaggtaattttatcttcaataaaaacagagccctcagaagagccaaaatgttgttgtatcaaagcactcattaaaatgctttgttaaaaatgttccgaatttcagcctttacatttgaacgtaaagtaaaatggatactttcactttaatgggtacccacactgggtcatcaagtatcagcaatgaccggagactccgttgtttacaaagatgacttgctcaccagtgatgttcctgtgaggccttctagaagatccaatagcttccttccatctttgaggtctgtgaacatatcattgatgggtggtttcccactctgtaaaagaaaaacacaaataaaatatggggtatgccaacagcagaaactccatatatacctgggcaaataaatgagtggcttcattttttgctcaattaaaatgttgtggatgatctgcagactatccaaatttgtcttttgggggtttttatttatttatttattttaattaattaattttttttttagacagagtctcactctgtcgcccaggctggagtgcagtggagtgatctcagctcactgcaacctccgcctccagggttcacgccattctcctgcctcagcctcccgagtagctgggactacaggcgcccgccaccacgcccagctaattttttatatttttagtagagatggggtttcaccatgttagccaggatggtctcgatctcctgacctcatgatccgcccacctcggcctcccaaagtgctgggattacaggcgtgagccactgcacccggcccaaatttgtcttttatagaaagaacaagtacaaatacagaaatttttaaatcccataaagaatattttaagctgaaataaattgcatttttccttacaaagaaagcaaatcaagctgttgggcatcgtggttcatgcctgtaattccagcacttgggaggccgaggcaagctcagaagtttgagaccagcctggccaatatggtgaaacctcatctctagtaaaaatacaaaaattagccgggcatggcggtaggcacctgcaatcccaactactcgggaggctgaggcaggagagttgcttgaacccaggaggtgaaggttgcagtgagccaagatcgtgccactgcactccagcctgggcaacatggcaagactccatctcaaaaaacaaaaacactacaaagtctggacataatttcacacaaatatacagtaaagtggaagaaagaacaataaacgacaaaataataggccttgagtatggcatatgttcctgagaaagcaatgataacgagacgcattaaaaatgtaaatgagcctacaacatccgggtgcagaggccaactaaaagtataaggactgtcacttcatcactgcgtctcacatcacagtgtgacaatgtcttccagcctttccattatgggagtacgtgatttggtcatcaatttcagggctgaggtgttcagtctgtatttctggttattaatttcttaacacttaaggcactttgggcttaacaattaaatactttttgtgcttaaaactagtaccagtccaagattttaactgacaaagcttatagaatttctaaactctttttcctgataaatagcatcaactcccacagataatcctgctctagtgtctgatgccagaaaatcccactccattcactgtaagtttggtagatccttgcctgtctgtgatacaatgaattattatgcaatggggtgatcaccgcatagaaaatcaggaagcctcggctttaagtccagtttgacctttaactacctggtgaacctggctcagctacctaaccttttaaatcaaaagtcactgtaaagatcaaataatagaatattataagaaaatgccctgagaactacagaatacaatgtaatatttaataaatgttgtattatcttgtatcgaattactgccttatataataaaatctccacagagatgaacagtcccacttcctgtcaataatagatattttttaaccaatacttcttttatcttcttcatttctcactttaaaaaatatatacatatcattcatatgaagcaaaactttactctgagtttgaaatggaggagggggaagaaggagccattctgaagtttcctaaaatttggcattattccttccttccttccctcgtgattccttatctgtttttattgtgtgtgtgtgtgtgtgtgtgtgtctgtgtctgtgtgcgcacaagtgtgtgtacctgaagagacctgaattacaaagatgaataaagattccatatttctgcacactcaacagcttaccattcagtggaagtgatactcttttttagaaaataacaattacagtgcgatgtgtaaggtctggaatagaaaagtgtgccagtgctatagaagcacagaggagagagagaccccaagaccactgcaagccagggagtgggcaaaggcttcagacaggagctgacccttgaactagactttatttagttttttacaaggcataatttaattatcttttaaaacattcagattcagggagttcatatgcaggtttgttacatgggtatgttgtgtgacactgaggtttgggtctcgaatgaccccattgcccaagtagtgaacacagtacccagtaggtagtttttcaacccttgttcccctccctctatctgtttttaaacaggtattaggtatagccaactcataatttttagcatgtgcctttttcatcattcatatacttcagatgagggaaagtgcagtaaattttcaccacagaatcagtaaagaatacactgttacttattcatatctgaaacaaagctgcttttctgttcccagctgcctttttcacaggcagcgatagattcagggacaaagagattttctccatcaatcaaaataacacagagatgtgcaagatgcaggggccactttccagaggcagaacttcaggaagccgggtaaggggtaatttccccttgaggggaaagtcccctgaggacttgctacccactgtcagtaaaagcaatgggcagaagtggccttcgtcacctgcctacgtctaatccccctcccccacccaaccagaagtacaattctgcaaaatagccaacaaataaccgaattcactttcaggtcttaggcatagcaaaaatatattatataggtaaagcgcatgggagaaacaaatggggttatataggcatagaaaggatcttagaaaatactgatgatggcaagggcagctaatataacacctgggcagcctgaaacccttctcaaatccactctccactttccaaaaaatagtataatataaaacaactggctgggcacggtggctcatgtctgtaatctcagcactttgggaggccgaggcgagaggatcacttgagcaggaattcgagaccagcctggccaatgtggcaaaaccccatctctactaaaaatacaaaaattggctgggtgtggtggtgcacacctgtaatcccagctacttgggagactgaggcaggaaaattgcttgaacccagaggagatggagactgcatgccactgcactacaacctaggcaacacagcaagactctgtctcaaaaaaacaaacaaacaaacaaacaacaacaacaaaaacagcattatataaaagaaatacaggcctggcacgatggctcacgcctgtaatcccagcactttaggaggccgaggcgggcggaccacgaggtcaggagatcgagaccatcctggctaacacagtgaaatcccgtctctactaaaaatacaaaaaaaaaaaaaaaattagccgggcgtggtggcgggcgcctgtagtcccagctactcgggaggctgaggcaggagaatggcatgaacctgggaggcagagcttgcagtgagccaagatcacgccactgcactccagcctgggtgacagagcgagactccatctcaaaaaaaaaaaaagaaatataaatatttattcatattataaataattatggatgtccattaatgacctcatctgtaaacaagaagcctcttattggccatagaattttgggcaagttacttggcctttctgcatctatttgtttacctgttaaactaagatgacagatgttcattaaatggttgatgtgactatatcacaagcataactttagtgttttctattggcagaaaagtgtaataaaatatcaacaatatctgaaaggactgagacaacaactaagcacttcttcatctcaagcaggaaggcaaaagcaggccctgaacatgagaacatggtagtgtcaattcacagagaaagatctcacaagtctcaggtttcattaatatgtcatatgatgacctgcaggaacatatctcattcaaaaacaattaactaccttttgttgtaaagtgaaagcagccatagagaatacataaacaaataaaccaattggaatgactatcttccaatgaaactttatttatagacactaaaatttgaatttcacataattcccacatgtcacaaaatattactcttcttttgatttttttgcaaccacctaaagctgtaaaaaccattctcagctcataggccatacggaaacaggcagtagaaatatgaaatgttcttagacataatgatagcaagcatttactatgtatcatatgttctaagagacttataaagatttagttgtattatttagatgtattatttatttccttataatagtatttcgagaaaaacagcatcatcttcttcattctacaggcgaagaaactgatgtggaggtgacttaacaaatgagaggcagaaccaggatctgataccacaaaatctggctctaaatctatgttttcaacatctgtgctatactgctactaaaattatgaagacacaggactaggacagatagggaagaaaatatttcatcactggactgggatatgtagggaaaaaaatatttaatcactggagtgggtgggatatatttagtggccccccaaagagagcaacaagatatatactacattttgatgaattcaaaatgcagactatttttttttctagtacaccactttaaagcgtgtctggtgctttggtatcacaagctgtaaacttgggatccactctgtgaaacagcttggaaatgtcagaagtcatctatgaataaaaataaaaactgattcatcctgacagttaacctcttatttcaattttgaaatctttgcaaagactcatttgcagagacttctctgacaaagagaatacagttgaataatgcatttggacaaatatttagtgaatacctcctttgtgcttggccctgcagaaatgccaagttcaggtcattctccttattctcaagagagtttccatagttttccaataaatacaaaatggtataaatgaacagtcttgaacttgaagggtatataagccttgggtcacatttaactttaaaaaaagtaaacaaccacatgacacaactctagatgacagatactacagccctggcgtggccagctttggctgtccccaagtctcatctccctctaccatcaccattttgacaagtgagaccagcactcatgcttgcggctgggacactactgctgctggattttaaaatgttagagcacaaaggcgaacggtcagcacaatgcaaggggagaagccaggggggtctagcggggagcaagggctgcaaacaactgcagtgatgacacatgtgagggaagcaaacctgatgagccccaggcacatctggagaatcagctggctctgcaggctcaagtggcagctcctgctcagttctagctaagggtggccatatgggaattcaggttcactgtgggcagaacttctcatttttaaaaagaaggtggaaatctgaatttatatgtataacctcctggtaactgtaatttcctaaaacactgtgctaaacaaatagatcttgtctacaggcacaccaggtcatagggtgaccgatgagcaatttctgcatagagcatgaccacatataggtgaaatataggattaatcaaagaggaatgccttaaggaactggtcaactctggagaaaggccacacacaaatatgcacacacccacacacacacacacacacatacacacacacacatccacggactacagaatatgattaattgcaaatacatcacatatcaagaaataatgactcttgctcaggccaaaaacaaaggagtcattcctgattcatttcctttcacttcttctccacctctaacctacccaccagccctgtccttccacttccaaaaacacatcccaaacatgaccacttcttaccatggtcattgtgtcaactctagcccaaaccgccattatctattgcctgaactccagctccagccaactgatctctttgcttctacgtaagagccagaataattccaattttaatgtgcagaccacattgtgtcaatttccctgatttaccctaatgggcatccattacaggcaaatccaatccaaactccaaataaaaatcttgtgagatctggtcccaccctctctctgatctgatactgtattattcttaccctacttcaatactctcaaagcacaattattaatatttctaccacagatcatgtttttcagcaatagtagtagtaatagaaaaaaatctacaaaaaattgaataagaaagtaagatttagaaagtgcagtttggatttcttaaaagagtgaaattctaattctttgtatcaataacaaatcagatgcagaattgggccttggattttccagtagagagatagatcagtgcctactttctgtcatacagtatgcgaaaatcaaggctggtgaaagcagctcttgacttcacggcactcagattccaaatacagtcatgagtcacttaaggacagggatacattcagagaaatgcatccttaggtgatttcatcattgtgcaaacatcatagagtatatttacacaaaccgagatggaatagcctacaatatacctaggctagatggtatagcatatcactcctaggctacaaacctatagagcatgctactgtactgaataatgcaggcaactgtaacacatggtaagtatttatgtatctaaacacagaaaaggtacagtcaaaatatgatataaaagattttaggctggatacagtggctcatgcctgtaatcccagcactttgggaggccaaggcgggtggatcacctgaggttgggagttggagaccatcctggctaacgtggtgaaacccatctctcctaaaacataaaaattagctggttgtggtggtgcacacttgtaatcccagctacgcaggaggctgaggcaggagaatcgcttgaacctgggaggcggaggttgcagtgaaccaagactgcgccactgcactccagcctgggcaacagagagatacgctgtctcaaacgaaaaaaaaaaaaaagatatagtacacctgtataggacacttaacatgaatggtgcgtacaggactagaaattgctctgggtgagtggtaaatgaatgtgaaggcctaggacattactgtatactactgttgaccttataaacactgtacacttaggctacactaaatttatttttaaaatatttttctttcttcaataataaaccttagattactttataaatttttcaatttctttaattttttgacttttataataacagcttaaaacacaaacacatcacacatctgtgcaagaatattctgtttcattttgtccttattctacaaggctttttcaatttttaaaactgtatttttttagttttcaaacttttttgtcaaaaactaagacacaaacatacacattagcctaggcctacacagggtgaggatcaataatatcactgtcttccacctccagatcttgtcccactggaaggtcttcaggggcaataacatacatggagctgtcatctcctatgataccgatgccttcttctgggacacctcctgaaggaactgcctgaggctgttttgtagttaactttttttttttttaatgagtaggagtaccctctaaaataatggaccagacacagtggctcacacctgcaatcccagcactttgggaggccaaggcgggcagatcatgagatcaggagttcgagaccagcctgccaatatggtgaaatcccgtctctactaaaaatacaaaaattagccagtcgtggtggcacatgcctgtaatcccagctactcaggaagctgaggcagaagaatcgcttgaacaggggaggtagaggttgcagtgagccataattgtatctctgcacttcagcctgggcaacagagcaagactccatatcaaaataaataaattaattaaataatgataaatttataataaatacataagccagtaacacagttgttggttatcactaccaagtattatgtactgtacataagtgtatgtgctagacatttctacaactgaaagcacagtaggtttgtttacaacagcatcaccacaaatacctgatgacacagtttggctgtgtccccacccaactctcgaattgtagctcctataattcccacgtgtcatgggaggtgcccagtgggagataagtgaatcatgggggtgggtctttcctgtgctgttctcatgatagtgaacaagtctcatgagatcttatggttagttccctgcacatgctctctctcttgcctgacgccatgcaagacgtgactttgctcctcctttgcttctcaccatggcctcccagccatgtggaactgtgggtcaattaaacctctttcctttataaattacccagtctggagtatgtctttagtagcagcataagaacagactaatacactcgagtaaatggcattgtgctatgcccttataacagttacagcatcactaagctatgggaatttttcagcttcattatcatcttctgggaccacgatcatatatgtggtccatcaatgagtaaaacatccttatgtgacacatgactgtagatttaaacaaaaaacagtactaacataatatggcaaacacgttaaggtgaatttgcaaatctagcttggtgctgccaaaattgtacaaagaaacagatacagcagggagacagaatctgtcctatgacttacctaaacccattatcagcaatcaagttataactgcatataataaaaacagttggaagataacagattttaaatgctttcaaaagtaacatgtctgatgagtgtcatcttacaaacgaataacaaatttgagcccttcgacactgattattctattatttatttacaccctattttcaaaacaggatttgagacactctagttaattcaattaccagtcccattgtttactgtgtgtgtgtgtgtgtgtgtgtgtgtgtatggtgtgtgtatatatatatatatacacacacacacacacaaacatatatagtgtatataccataatatattcacactctcctcagattaatttgagattaatctgatgcccctgatagttcaaaatgatgcccaagcatctgataacattgtaaattttatggtctctctctctccctcctcatctgttttttgcaagaagttggttaatttaaaaattcaaaaagaaataatttaatgcaacatttctaaaccttttcaaattagaatctttaactcatgaaccccaatttcaacactgacacaaatgtagcatcttttacattcttgtaatttttcaatttcttaataatcaataatgcatcagtaagcactatgtacatcatcttagttaatgataatatatttatatgataatacatttttaaaccattatacaacaaaatgctacactttttctcttggtagtggaattaaaagtagtttgaacaattttctttggatttattgatttatctaatttttacaaagtttatgtattactgcataaaacaaataatagatgttttaaaaagaatgctgtctctagtcaagattaagcaaaatgataaaattaggttcatctcaattataaaatgtgtagttgaatcaacgaaatgaagactgtatgatatgtagtatttacttttatgattcaactctgtggtaaaagaacaaacacagcattgctttccacagagaagactgaaagtaaaatgagggcactgcaataatgcctaatgagttccttccacacctcgacaacagaaaaccagcaaaatgtgctccagtcacttaaacaattagtgactgcagatctctcagccgtcctctttaagaattctgggtggtcagcataagttgctaagaattgaaaaagattccatttagaagcttgcttggaaggagggagggagagaagaagaggaagagagaaagacaagagaaacagatggtgctggtcatcacagagtatgcctcattaactacagagcaatgatttacagtgtttactgtaaatgtgcagagaacactccgaatcagtaaatgtgcacctaccttcagaactataaaatactgtaaaacacatgccaaaccaagtaatatctttcagggaatcacaagtcatacagacatgtaacagaatgtttacctcgattttggtaagttaccggtatagtgatgataaaatctgggatgataagaaaccactgtggggctcagatacctggcggccagaggcaggggccactagcatactccacggacaatcaggtgagggctggaggctgaataagctctgactccaaattagcaagtaaaaaagaaaatgggctaaggacatgaatggacaattctcaaaagcagatatacaaatgggcaacaagaatatgaaaaaatgctcaacataactaatgatcagggaaatgcaaatcaaaaccacaatgccataccacttcactcctgcatgaatggctgtaatcaaaaaatcaaaaaccaatagatgttggcgaggatgcagtgaaaagggaacgctgctggaaatgtaaactagtacaaccactatggaatacagtgtggagattccttaaagaactaaaagtagaactaccatttgatccagcaatcccattactgggtatcaacccagaggaaaagaagtcattatacaaaaaagatgcttgcacactcatgtttatagcagcacaattcacaattgcaaaaacatggaaccagcccaaatgcccatcagaggtaggcatttggaaaaggagccattataccaaaaagatgcttgcacatgcatgtttatagcagcacaatttgcaattacaaaaatatggaaccagcccaaatgcccatcgatcaatgagtgaataaagaaattgtggtgtgtatatacacacacacacacacacacacacatatacacaccatggaatactattcagccatcaaaaaggaatgaaataatggtatctgcagcaacctggatgaaactggagaccattattctaagtgaagtaactcaggaatgggcaaccaaacatcatatgttctgactcataagtgggagctaagctgtgaggatccaaaggtataagaatgatacaatggactttggggacctgggcggggggtgcaggtgggagtgggggtgagggataaaattttacaaatcgggtacagtgtatactgctcgggtgatgggtgcatcaaaacctcaccaaatcaccgttaaagaacttactcatgtaaccaaacaccacctgttccccccaaaacctatggaaataaaacaacataaataaataaataaaaagctctgactctttatgcataccaggcaaggtctgtaggcaaactcaggaaacaatatagcttattccatgtatacacaactggcaatacagtagaaatgtttgaagaaggcagtccttcaaaagataggcttccatgagactagggtgaggcactggtaatagcactgattatgatagtgtaaaggtaaataaaatcaaagttcctttgttcaatatatataaaggagaggcaggtacactgctccttcccttcccttagggtgtctccttaaaacaaaatagacccaatttttttggtcaggaaatagataaatccagtctccagtttttcaagctaagttaaacacaggagttgttgagaaggtggacaagagactatcacaacaaggcacatctagttgtctctcacagagacaagtgttcattgttctttctcccactttactgaatatttgtgtgaaattctgtccagactttgacgtctttagccaactgcctgcatgcacttaaccatacatgcacacttaattgtaaattgtgttttctctgtattctatgttggtaaccagaggtaccagtgttggcagggttttttatttctccaacaaataataacaaaaataaatgtcagcttccccctaagtgtgactcccctcatggctggtggatggttacctgtggcaattgcagctaaaagcttcccaggccagatacagctggaaatgggtccagtgtctccttgctctgtgtaataggtagagattctctcccctcaaccactacctctcagcaatcccctcttgataccttacttcccaccctggcataagcccacccttccctgcaccaccagagcccatctctgaagctagagatggtggggccacaagaggctgaatgggaaagcacaaggaaggtggtcctgctcactccttcctaagtgaagggtgaaaagtcatttcctcccagttgatcaatttctaaactgatcgtcaattacaaagactaccaaatttgcttcacaattatgaataccaataggctgaatcaaaaccctgtattaagtactcatcaaagcatagcatattaaataatacttgacagttttaattttaatcatttgtttttagttttaaccaaggtgaagttcattttacaaacaattttgagacaaaaatcaaattttaaaaattcaaattgaatgaaaacaaaacaaacagcaacaacaacaaagcttgcataagtatagccaaagtatctggaagctggtgtttaagaatatggagtacattttattgttttctttttagaggtattagtgaatagacacaaattcacatttctttttaaggaaccacttgaatgtgtatggctcctaaaacaatcagttgagttgccatatgcatactcatgaaataaaccaatggcagacccaatgtgtaactcttcaagctcaagcctctactatagatgggatttatcttcacacaggaagcctgtcagcctctttacagtactaaagagaagactgaatatctagaggtggaaaagggtttgggctccttttattgcacctcctgtacaaatctccctccacatcttttcccacccttattttagtgattattaacttccaacatgaaaaaagtaggaaaacaatctaaaagcaatgtctcactgtctcctaaaggaaaacatcttaatagctctccatattggaatccataaaaaatgcttcatggctttcctctcttacgttctgtcaatttgaatttcaaggttggaattgtaacttacatgaaaacttggctcatctgtgtcttagaaaagagaaaagcagggatttgcacaaactcaagttcagcatttttaattttgcatattttctacctaacctttatttgtgaagcctctttagagaaccatctcaccaaatggataaaagaacttctgcaatttgtatgttttcagctctgccagatgagcagctctgaaagtcagccaaagaaaatgcaggctcaaagtcagagcaaatttcccaaagcaaagcaatgaggcctttgctgcctcccttgggagaccggccggctaacaagccagaggctctgaaatttagaaggggcaaaacactcaagtcatacacaccatacaatggaagaacgcgggcttaatgagccagtgctttttcccttttctgtttacgtgtggcacggatccacagatcaggactatcacagattcgaggtatatgatagggtttttattttgcattcctaagtaattatcatctcctatacacttctcagcaatgcctcaatatttcttcacgatataaggaaggtaataatgatcgattgcgtcttatggctatggaaatgtagaccaggtgatctgaaaaaattgactaataatttgcctgaggtcataaataaatgagcaggatatccagaaataagtgtttaatttcctaatttttagctttttttagataatcactttttctgagctcttcataacttttaaaaatccaagagccataatttactctacactatgacttctcaggatcctgaattccaaagcactgtatactccatgatatgttcacaaggatttgcagcaaaaagaatacatattttgagtgagcactgtcttggttactgtatattcatttacagttacaaattaaaagatggttttagactgatattattctcaagttctttaccaaatcccttatcaagaaaagaattgttctggctttaagttttaagtcttatttttcttcacagtgaatttaatagttagaccctatgtgaagaattgtattgggtaaataaaacaataatatgcattaagtccaagtggttatttaacaatcactgcagcacaactccaagaaatcaggtaaatagggaaagtttggatagctggatttgtttatttttgtcaataatgcagcaaaagtcctgatgcattgtattcatatccaggacttagcacaattcatgccatgttgcactcagtcctaaactctactcctgtctctccaatgcaaccatccccaagtggcttatgaacatatagaattaggcatattcaatgtatgtctatgtcattgtcattcatttatttattaagcctacaaatagtttactggatacctactaaatgccaaaagatatgccaataagcaaatagaaagtccctgcacccacagagtttatgtctaacctaggaaaaaaggctggcaactatttaaattacagtatggtaagtgcttcaaatcataacactttgagagtatacagcttatctaccctagtctgggagctcagaaaagagatccttcaggaagcaacatttaagctcagacaagcaggaaggggtaggagctggccaggaagagatagagaaaggactgtgtgcaaaggccagggagggcccaccgggatggtaagcaaaggccgtgtggctggagcaaaatgagggagcgagaggaaagtaaaataaaattaggagtaaattgggaggcagctatttagagctttaagaaccaagtaagaccaaaacatcacactatataccaaaaattatacaatttcaatttttaattgtgttttttaaaaaaaggaaaatgggcacccaacgaaagagcttacagaagagaaaaaggtattcaggtttaccctttagaagcaccgtagatactctcttgaaaatggaaggggaggccgggcgtggtggctcacgcctgtaatcccagcactttgggaggtcgaggcaggcggatcacttgaggtcaggagtttgaaaccagcctagccaacatggtgaaaccccatctctactaaaaatacaaaaattagctgggcatggtgacatgcgcccataatcccagctactagggaggctgaggcaggagaatcgctgcaacctgggaggcagaggctgcaggctgcaatgagccaagattgcaccactgcactccagactgggcaacagagctagactgtgtctcaaaaaaaaaaaaaaaaaaaaagaaaagaaaaaaaaaggaaagggagatggagaaggtggagcatggaatggaagaaccaattagcagattatcacagtggtccatgtattcaaggataattttccaacaaggtaaagtcataactctcaaaccaatgtgataataatgtctgtcaaagatttatttaactcattaattaatgagggacccagtaagctgttacaaccagttcaggggaaaatttttaaaaacacatgttttacacaagaaaaatgaaaactgaaatagatttgcaatagatgcaaaaactggtctatccaaggagtaataattaactgctttacaaataattttcatttttatggataagaatcatttgcatacctattttccacaacttacctagtcgtaaagtagctcaaaagtaattaaaggcagagataattcagatgcctgagctaacaggacacccactagttttttgcccattgtaaagtctctcaccattttttctaatacaaataacaatgccttggaaaagagacgtgtcactctacatagagtaagtggacaattttgaatatatgtaggtattggaattaacaaggctcgatgtttgattgacttttgatggggaggaggccacaaaggaaatatctagacaaatgtctgttttaaaacaaattcctaaatggcagaaggtgccatcagtgtctgtttggatttctcagcacagaggtcctgttgctctgtttaggaacccacactgtagggaagtagtggacccactgaaaaattatattgtaaaacccaccacaatgtaccaaaggacatggatttttaaaaatgaaaaaaaaaattcgttcccttcaacgggatttatttttttttcttgttctatcctcgcattacctagtaataccaggcatgaatacggtctttccccagctcagcaagagttaagccacatgggagtctatggaaatctcccagtctagaaatgtgttactccctctttcactatccccaattggaagcaatccaacttatggtcttaagacagccagaagaaagaaaaaataatgtggatgtttagtgtcactgccatgagcttcccatctccaaatattcataatttctcagataaattccttctaggttttgatttcttgctagatgaaaataaaagttttcagagtcatcccacgtttggtagtttttctccaaacaccatctccaaacactaacacagaagctgagcttagaaactaccatctccaaacactaatagagaagcttttagctaaaactaactataacttttactaaaaatgataaaaattaccaagtcttttccagtatcttggtaagaaatacaaatattccagggcaaacaatttacatgggacttaaagccccatttaattgcaaaataatagacattataaatgcacaaatttaaatatcaagttcatttaataaactagtctggtactaccagattttgttttctttgaggtctttttaaaggtgtcaatgacccaccataaatattgagaaatttcttttcaattattctgtctcagttgtcatctctcttcctctacaaaccctttccatgtcctattttactacctatttctctccattttcataaataggtaaaaagtaatttacccagtttcaaatgctctctaaacttaggtctaccaagtttaatgctttcaaaacaatcttcaaaattagttctaaggcaattcttccccaaagactaaattaagctgctaaaaactgcttcacttgttctatctaaacaattactgtgttatcctcgtgaataaccaggaaaaataatcttacttttatgagcaatcataagaccactggaataaaacacctcatatccagactcccagttgctaaaactacattctctggaaaatggtcacatgcagatgaatagttcaaaagtttttattcatgtcaagcccgagatgcacatatgttacctgtgtctctggaataaaacaaactaaaatttaccaaaacacacctgcatgtgatttggaataatcctacacatataactgccaattatgcaagcacctttatgttctaattctctgtatttttaaccctctgtcaaagttggttttcatgttccttacatactcacaggcaagataaaatacccctcaagataaactcgcaaagcccaaaaagcagtgaaatcaaataaccaactataaatattgggacgtggagcattttttaaactatgctgctactcaaagtaaccttaagatatcctcatttttcctcaagaaataccaatgtttgtctctctgacctttacaacttttgaaaagcaaccaaaaattttgaaaagcaactcttcattaaaatagcttttatactatttaaaagaccacaacagtgtttctctgagaaacttctatttttcatcttgttgtagaagagtcctaaacaatctgttatcctgaaaactctcctcctacctcaggcttagtgcacaaaattccaacaccaataactaatagataatcatattagaacagatttgaaaatagcactgacaattcctctcttcagcatgctctgcccctatgaaaaaatattgctcaaagcattgattatgttctaaatggttagaaatgctaagagtagatctttggggtgggggaggaattaaggaagtacacaagaaaaaacaacccacaaggcagataaatattattagccacatccacaagaataaaaatccataaatatttctgacagggtagaaagactgcctgaattataacatttggttttaaccaggcaaaatgaaatcatcatcctcttaaccaagagaactcaaaaattttcccaatgatatattcttttccaagatgtacccaggattcacagaatcgaaagcagctaactgctgccttagatatctggagaaggccaggtaaaagtcaatagcgtcccataaactatgtgcatgagaatttccgtttaaacatattttaggacagaataaaggaacaacaaatgtatctgcatactcagaagacttcggctaggtgacatttcctggggaaaattcactgcacttccaaccaaactccttcaatcagaatgcggcatctgaaccatcgaagtttttgaaagtctcagttacctttgaaaatcgagcatttatccatttggtaaaggttttcttctgtacgtcattgtgttcatctgtggaatggaaaaagaaagagaaggaaaaagtatgagagtctgtacctttagtaaagcaccaaataaggttatctctatcctggagagtttaaaatagtcctattagtcgagctccttgagcacaatgaggcggagctaatgcagaatgtgatgactgcccggtacacttatggagcccaacactgcctacaacagagggaggctcgggcacctttcccaagggaccaggttgtctcaccctaaaccccggagtcctgccatcagtgaccaaatccaggtttatcggatcaaatcagagccctactttccagctagtacccgtagcactttctgctacattttgtgcaagtaaaatttcagcataatcaaaatgtcagcatgctaaaaacaaaaattaaagttatccaataaaaactcaggaattcgtgacttcctccctcttcatactggtcctacaccctctagaatgacagtataaggtttatggtcaatcttgtaacccattttcctgtagtaagattggcatgaggttttaatgatcttgatctatacgaacttttacaggtagaaaaatcagaagaatttaaaaccattatccgttttggttttgattacaaattcattttctgagccataaaaaaaagaaaagttactttaaaagactgaccaccctgaacttttgaaatatgggtagaaggatttggttacatacaaggagtccatgtggctaacaaaaagagaaaaggactttctctttagaaccaaatagacggtgtcccaatccatttattgtgtgaccttgggtcattataacatcgcttttcctcacagttctcatctgtaaaatggggataaataatacctagcttgcaagagtattgtaaaggttagtgaatataaatgaaaagcacttgacgaagagctggtgttcagctcgttgttataatgattacagtaaaagtgtaagcaaggtagataaataaatattcattggacctcttcaaatcatactcttccatcactccacgattttctattaaagccagtaaaagagtcattgttggcttaaatcctacaaaacagcattttcacaatctctatcagttgttcagaaagctgtccaaggcgtatctgcgacagtgcagaaaggtgtggctccatccatatgtgtgtcctgcctcctttgccaccttttatactgctgggctgcctcccacatcagagcagcaaaataataatggaggaagcccaggtgtgcttggccctccagtgtcagttccacattaaatacagacctgctcacgaacctctgctaggatcattagaggttcgcctaccacttcacccagtttgtggtcttcggtccttacccccttgtggaaggagagtttgtaattaaaaggtcattcccagaataaatatagcagcagcttcagaaaaaaaaaaatgcacttttacaaatccataaaggtaattggagaccaactccaagacactaagggagcaagtggtatagaaaacaaaactgctgtttaagaaactccttgatattaatggtgctcagaggtgaccttccttcaagaaaggacagcaaagacagcaacgatccctatttcaagctttatattatctgatcaaggccacataagccatttattaaccaagagaacttgcttacacagtgaatgaccctttaccatcttcatatcaaagagggacacagtagagattatactcagaatataaggctaccaccacacatcaacctgaaggggggatataccagcctcaccaaaatgaatttaatattaaaaatcagtgtttagggcatttggaaaatccaattatttgtcccactaccttaaaaaggatttattttcataaatcttgttatatgcagtttcatttaatcccatgaataaaaaaatatagaaaggtcataaataagtattaaattatcttaatttgataacattcacacaacttaagaatttggggccataaaaatggaaaaaattctaagagagaaatcttactacattttacattttcttaacctgtttccggagcatttaactttcttatttcaaaaacatattaaaatatctaatactatgtaggtttctccccagatataaagtgggcaaagaaatgagcactattaccctatcaatgataataatctttccattttatcacatatgaaatgaaataaaatttatggattcccattcttatgtttgtaaaaatgagtaagataatatttcaacaatagtctttattttatgggtcaagtcaatgtcagaatataagtctaagtaacagacaaattatttgcctgtaaacgatacattttctaacatccaaatgtttcaaaaatacttcaaagtttataaacacacttccgcattcattctcttgatacagttaaaaatggggaaaagggagtacatatttcaaagactagtttgcattttccttttttcagacacacacacacatacaaacacacatacttcttattttctactagacaggaattcagtaaaagaacaagaatttgcctgtggcttttcaattatgagattgaaatgtaacaaatttcacacacttactaacctccacatcacaacaattaaggtaaacaatcttggcccagatctcgggcacgtaaaaatagcagacgagtaacaggacaactaaaactccgtcatgctattctgatcagccattttgtctgcctagaaatttatacagaacttccacagtctgaaattatttcaatcttcattatcaagccaattcgttattttaacttctccaaaacaaaaatgtgtaagaatgcaacaaacatactataacttgattataaatatatatgtataatattaagtgaatgaatataatttacactgcatatacaccttctctaaatgtattctttcaagctcccaaattcaaaccctgttttccttaggcttggatttttgaaaaccattttgtttctaaaagcctttgctggcttagcaaatcttatccattaatgacctttctccattagagggatgaacacgagactgaattagaagaagaaaaatgtgttaaatcccttaaggctgctttcccaaattcttcctctaaatattttgctcttcttaaaatgcttttgacatgctcacacagatccaaaggccttcactgctgcctagcctgggattttatttctgtgataggtaaaagaagtatagcaagacacatcaacaaaactgcttgataaatcttcaaggaaactggtttcaaaatgttttcacttcaccagctcaaatgggtatggaaaattgttttagcagaacgtagcaacatatatcaatttaaatcctaaactggaaatgtggcagagaaattaggagttgtttcccctatgaaagcacacaaatcacctctaaaactctactgttattagagagaaagcattatcctctagtacaccatttgaagcaatttaagagtgtccagttggctgacactaacataacatgagttccctaaagtgcagcttattattcaggaaagtagcacctagacctttagccaagaaagaaatctcttattggatgattttaaacttggattgattttattaaggcctctttcacaaatgcaaaacttaacacaccctagaaagccaatctctcgttagcaaagattattattttggaagtaacaaaagcatttcagatcatattctcatttcttctttttgtgggccctacatgtgaatcactcccaatataattctgccactcacacttagttatgccattatgctctcttgtttcatcacacccaatcacacccaaacactaattcatttattcaaacaatatttattaaaatgtcaaatgggaataataaatattatataataatctgtaaaatattataaatatgtatgtagacaaagaaacaaagccaacaggatacagactgctctcaaacagaaatgtttaacctccctgagtttctttcaaaatccgacatcctcagaggaccttaaaaaagccaaaattaaaaatgtagttttcagaattgtcaaaactacctaagtgtacaagaagtttagataattaacatttcaaatgatatttttgtgagtttgccacatttaaaccttgacgttattaaagctaaaaaccgcatttaaaacagagtttcacttcactctgtaaaaagctaaatacaagttgattttttttttttaacgatatgttttgctttagtttacaatgaactagttgcttggggaatgaatccgatgggcaataataacacaagtggaccatgtcttcccaagatgctgtgtcacctcactggctatcaaacctgtgaagccattatagtctcatttcttctgagagaagaagcccgcagggcagtgagctattcctggtattttcttgatcccaggggctggctcttcatgctctcacaagctgttctttttctctccgtactgctgtgtatgtatcatagctcctgggtgcttcttcataataacctggcctgccataaagataatgatcctgatatccagactagcctgaacaattgaagtaatatcactgtcctggataaccaataattggagggaaaaaaatgccagcacatgcttccatgatgttcttcagaggcccttgagtgtgcattaatgcaagaagaatcccagccagatgcccagtgaaggaagtccctggtgagaataagtgaaaaggcacaagtgtggcccaacaagcaaatctattgaggacaaggaagcccaaaatgttgacaaagcctccaaggcaatgatggttgttaagaaactccaaagcaaacaaaactcctggaaaaacctacagcacagtaccttccaaagccaggttcatccagaaattagagaatattgcaagagcaggtacaccaccccagggaacagggaaaacgtggtgatgacacaggcaaaccatctacttcccagtcatctttccagattattcctttccagagcacggacgccatattgaaatacaaatgccaatcatcagcaatggtgagcaggagacagcaggcaatgctgccagtctttctgctggtaactcctctctgccctaaggcaaggagaggtggaaatggtggaagtgagaagggaaaggaaaacaactccacttgtcaaaggagaaggctgaggcagaagttaaatgaattgtccagcatcacccacccagcaaatgctgggccacagagagaaccaggtctaactgactgtggagcctgtgttcaatgcacttccatgtaggaggaggttaaagataatttaatggaaagaaggctttaaaatatatcttgaaaaatagatgaagtatggttcatgcaaagatgggaaggacattctagatagaataagcctagtcaatacctcttcatttcagcctcagactcaatacctcacaaaaaagaacatgtttaatataattttggtatctacaagaaaacacagagggctataacatctaatgatgtcaaaataaggctaagacaatccaaatttcagaagttttcaatcctgaaaactgtatatgcccataaaagagaagaagggtatggagttaaaatatatgctttaaaaatgttcttgtaataaaatcgagattatctgaaaaaaatcaacctccttaagcaagcacatgctctgctagcatgacccaatgacccatccactctgcccaaaactgaaggcaattatggagccttgggatcctagaatgtctacagccacatctggactgcatttagaatttatatcatgttcagcatcagaggaacattttttttttttaagaccgagtttcgctcttattgcccaggctggagtgcaatggtgtgatcttggctcactgcaacctctgcctcccaggttgaagcggttctcctccctcagcctcccaagtagctaggattataggcgtgtgccaccaagcctggctaatttttgtatttttagtagagacggggtttcaccatcttggccaggcttgtctcgaactcctgacctcgtgatccacccaccttggcctctcaaagtgctgggattacaggcatgagccactgtgcctggccagaggaacatatttgttccagctgagaaccaacctaacccaccaaaactatccaccttactatcacggagccacagaggacaggagtaggaagtatataagagggtgcctgatgggattccatcctgtgaccagagaggtcaaggacttacccctcatgacatgcagttggatggtgccataaatcaaatcaagattcatgtctccttacctagctctcctcctactcacaagactgcctctttttaaaaacctgttttatggaggtataaaattcacctaccatacaattcatccacacacctaccatagaactcacctaccatacaatttacccatttaaattcacctactatataattcacccaattaaagtttacaattcaatcgtttttggcatattaatagattttttttaattgtggtaaaatacataacaatatttgtgatttcagtcatttttaatcatacaattcagtggcattagttacacctacagtgttatacaaccataaccactatctagtcccaaaactttttcatcacactgaacataaactctgctgtcattaagcaataagtccccatacccaccagcccctggtaatagctaatctactgtccgtttctatgcatttgcctatttaagatatgtcatgtaagtggaatcatacaatatttgtccttttgggtctggcttatttcatttagcataatgttttcaaggtttcatccatgttgtagcttgtatcagaacttcattcttttataagggtaaaaaatattccattgtgtgtataaactacagtttctttatccatttgtctaaagatgagcactagttgaccactttttggctattatgaacaatgtcacaatgaacactggtgtacaagtatctgagttcccgatttcagttcctttgggtgtagatgcaggagtgaaattgctaggttaatatacagtaattctatgtttagatttttgaggaaccagcaaactatttcccatagtggctgcatcattttacattttcaccataatgcatgagagttccaatttctccatatcctcactaatatttgttattttcctttaaaaaaaaatgtatagccatcctagtgtaagactgactttgaaaacacagaaactacctaacaaaacccccaaacttagacacctcctgaagactttctgaatgagttcaagtttaacagcatgctaacctgaagtagctgggattcagaaattgctttttcacatttaatccacaccatattgccaaatgattgatttactctcaaaatagttattttcagaattaaatgtaaccattaattccatcttctaattttagtttatttacttcttaacctgttttcttttcaacaaactcaagtttttttaaacaatgcataggaatataggagataatgtttttctacttgcactttctagagcgcctaaacttaaactgaaagaatgtttctaagatttacaggcatccgacactgtttgaaacttttcctctagaaatatattttgcaaaaaaaaaaaaaaaaactcaacatcttttctatcaaccatattatatgtgttgcaaatgcagaaaaacagactccatttatggtggtagagattgtaaaccttacatacaaacacttcactttgaatttttgtcctggagtgaagattttcattaaaattgctagaaatgtcatagaacaaggagggattatttaggacacagtgaattagtcataatgatatgagtcactgtcatgaaaagccaacagaaaacatttttttattgattgacaaaaggctaaacttatgaaagaaaatttctatgaaattaaattcctcactttattattatcaaataaacatctattatgttctacaaactgtctgcagaaatctcaagaaaaagcaactatctcattaacatataattctagatgtataagcctggaaaaaaaatggggaaaacattttgaatgtaaaaaccattccagtgatttgaccttcagactttctcatgacaagttctacttgtcaaaatagcagcaaaaatatgtccttgtaagactgctaattattcaaataatatttttctcattttaattactttatttatttcattattttcctcatgttatgagggatcttcctcataaattcacagaataaaacaatataatatccaagaaacagcaattttcaaacaaaaaaatgtataaaatatccaaagaaaaagagaacaatactttacccaaatatctctccagatgcatatataggaatgctatgttttctatagagctaatgtaggaaacctttcactgtatgccatgtgtcttctaagatcatgacaccgggtcatcatagtcaaataaaaaatatattgtgagagaatacatattgatatggtttgtctgtgtcctcacacaaatctcattttgaattatagctcccataattcccatgggttatgggaggaacctggtagaagataaatcatggaggtggtttaccccatactgttcttgtggtaatgaataagtctcatgagagctgatggttttataaggggtttcccctttcctttggctctcattctctcttgcctgctgccatgagagacgtccctttgccacgtggaactatgagtccgttatacctctttttctttataaattacctagtctccagcatatctttattagcagcataagaagagactaatacacatatatatgataattcaataataaattgaaaagcatcaagcagtgaatgagcattgtaaaagccaatgatgacattctgaagccaacaactccaatggataaaatggaccagcaataatacagtttggcttgcttccttacttcaatttagtcctctgtgtgtcagagcccatacaacaccttgagatagacaagacccagacaacagcaatccacatacattaaagcactgatctttccattcttccagacaggagagtctccaggtagcatcaaagaacaatgcaacctcaaaaaactcatgggtcaaagagaaagtgtctccagctcgtcaggattagacatctacaaaagtttacataaccttaagggccacaatgaacatcccctcaaacaaatctgccaagccttctttactacaccccatcatttggagaatcattggagcaaagactctccccctctttctctcctcttcattttcagaacccacctccttctgcctgttctacttttttgaacattcaaacctccctccatcctgcgtcactgaatattctttttcaacacccttctctgacgtgtcatgacacaggccgccatcttggaattctcagccacagagccatcctgctgtaccagtctgggctccctgcaccatgtgggtcagtctctttctaccatttctcttctggattgcctttttccatcgtttctttttcttcttaaaacttcctatataatgtctataatatactttagaagatttcaacatacaaagtgtaatatgcttgtgttaaactagtttaagtcagaagcttcaaacactcttgttcgtgaacttccaaaagaatttccatgcacattttaaagttgagaactgatatttatcataaatttaaatcgtgaaaaagatgtaatttctagcatgttgttaaggagttgcaaatttagctcattcaattaatagaaaatgcctcctctggtacctaattggcaaaactagtcctcactgtcaaactaatcagccaaagcagatttattttctgacaagaggagtctgacttggttttggatttaaaaaccatgttataggtgtttccaaataacatctcacttcagaattctctttctaagataaagggatggatggatggatgaatggatggatggatggatggatggatggatggatggatggatggatggatggcagctggacacaaagccttgccctggatgcaacaagcaccagccatttaaaaaatttgtaaaggattgctctttgttttgcattcttaaattgtcctcttgtttgatgcctcacagcaatgcagcacagtaaaatttgaggagagtgagaggtatgactttcttttataaagtcaaaaagaagaattatgaaaggaacgctaagaaaagagacaggtaggatgctatcttgggtgccttaaccactacaaaagcttgccaagatcacagtaagacacacatattccagtgtgcaaaccacactagaggctcacatttgtgccaagccagtataacattccagagaagttcagctataatttaattagaaaggctaaactccagagtggaccactacaaaggcatcagttatctttattttcatcaacaccagagactttgttaattaatgaatatgagaaatgtgcttttactgtggcttaataattggcataattagaatgttagaaatattctcccactgttgattttagtgttattcaatgaacaaggattggtcaaaatattttctagacatgccccaccactgattaaacagaatataaaaatctagtgagtctgggaggctagatccctaaaggtcctatgttcagccattggctggaggattttagttatctgctgctgattataagactaaatcctctccctaagacaacattgtctaataaaaagataatgaaagtcacatacataattttaaaagccgcattaaaaaacaggtaaaatgaatttttagtaatatgtactatttaacccaatatctccaaaacattatcatttcaacatatactcaatattttaaaacatcttgaaaatatattttatagtctttttttcttactaagcctttgaaatcctgtgtgtatattacatttacagcattatttcaattcagactagctacagttcaggaactcagcacccaatgcaccaaattatacagctctagaatattgctgcatttactttaactatgaccttcaaaaggacacagagctgtcgggcacagtggctcacgcctgtaatcccagcactttgggaggccaaggagggcagatcacgaggtcaggagatcgagaccatcatggctaacaggtgaaaccctgtatttttgtaaaaatacaaaaattagatgggtgtggtggtgcatgcctatagtcccagctactggggaggctgaggcagaagaatggtgtgaaccccggaggcggagcttgcagtgagccgagattgcaccactgcactctagcctgggcggcagagagagactctgtctcaaaaaaaacaaaaatgacacagagctgcagcttaccaactttacatgcaagctgtatgaactgtttttcgagcctacttgcgaataatgattgcttaatgaatgccaatgttaatggcaggatttggtctgaaacttgcctttattatgacccttataggaagacagtggcattgggagccaacattaccaatcaaaaaaaagccataatttataattacgcataatcaaattggcttaggtcattttgtaagacttctagtcaaataaactgacataataagaactggggaccaggcaagtggctcacatctgtaatctcagccctttgggtggcctccaggaaggatctcttgagctcaggagttcaagatcagcctgggtaacacagggagactctgtccctacaaaaaatcaaaaaagtgtctgggtatggtggtacatgcctgtagtaccacttattcaagaggctgaggtggaaggattgcttgagcccaggagtttgaggctgcagggaattgtgaatgcaccactgcattccagcctaggtgactgagcaagaccttgtgtcaaaaaaaaaaaagaactgggaatatttccaactctttgttatgtttgttgtcttaagttttatattttctagtctaaatgactaattgttattaaatataacaattagttgtacaactattttgtgaaaaacactgtacaaagaaatagtaacatttacagagcatctactatgtgtcagtcccaaaagagatccagatgttgctttcaaggaagctgtggtccagtggcctgggatgagtggggaagggactaagacaacagaaaattataactaatatatcaggtacagatacattcataaattcatagacaaatatgtcttgatggggatgaaaaggggatcacggaaagatttgaggaacaggttgcatttgagctagatcttgaattactatgtttggggcacgtaaaaatggttagaaaggcatttgtagaagagagaacagctgcagcaaagtcctaaaaacatgatgcagacacaactgtgaagaggttcctttggctgggtggttttttatcagagctgtgatgccactgaattttggaacaggctgcagttaaattgcagaggactttgaaggccacagcaaggggttaaatgagcaggtaatgtgggccattggcttttcctgagcaagagcgtgacatgatcagaagggtgctttagtgagattaacatgaaaaatggactcatggggagggaggccggaagaaagtaagccagtttgaggcttattagaattgcccgtgctagacatcagcgagcctgaaagagtagagaagtaatgagacaagaaagggggaggtggatgcaataggtattgaattgaagagagaaggttgctgctgggacgtggtgaggtggatgggcatgatcattattatacagcgtgtctcccgttctattctcaattagactctatggctcttaagagacaaaattttatttattagtgcttttgcctcacatatttaccatttatttgtgatgagaagacttaaaatctgctctctatgctattttcaagtatacaccaaattgttattaactataatcatcaccttgtacaatagatctcttgaagttattcctcctgtcaaactatattctttgaccaatattactccaagtcccccacccccatgctgggactggactactgaattattataagagtaatgaaggaaaggctgggcacagtggctcacacctgtaatcccagcactttgggaggccaggatgggcggatcatctgaggtcaggagttcaagaccagcctggccaacatggtaaaaccctgtctctagcaaaaatacaaaaattagctgtgcgtggtggcagacgcctgcaatcccagctactcaggaggctgaggcgggagaatcgcttgaacctgggagacagaggttgcagtgagccgagatcatgccactgcactccagcctgggcaacacagccagaccccgtctcagggggggaaaaaaaaaagagtaatgaaggagaaagggatgtgcaaaaacttctcagactttggtaacttaaagaatggtgtctctccattaaaaaataaaaagtgcaaaaaaaatttttttaagcacagaaagaaattgattaaggaaagaaattcctctttgcaccaaaaaatgtgagagattagcagcatactcaggtaaacttatcaagcaagcccagtgtgaaaggaaaataaacggtggggccccaaaaatcactaagctaaagggaaaagtcaagctgggaactgcttagggcaaacccgcctcccgttttattcagtcacccctctgctcgctgagataaatgcatatctgattgcctccttcggagaggctaatcagatattcaaaagaatgcaaccatttgtctcttattaacctatgacctggaagccccgtccccacttcgagttgtcctgcctttccagaccaagccaatgttcatcttacatatgttgattgatgtctcatgtctccctaaaatgtataaaaccaaactgtgctctgaccaccttgggaacatatcatcaggacctcctgaggctgtgtcacaggcacacactctcaatcttagcaaaataaactttctaaattaactgagacctctgtcagatattcagggttcataccaggaaaatgcaacattagagcagacaggagagggtcttcacactgaggagctcaaactctcacaggcatctagctttcccagtgtccatccatgagaactgtttaaaagtatattttcatgcattaaaaaggatactagcgggtagggcaaggtggctcatgcatgtaatcccagcactttgggaggcccaagtgggtggactgcttgagccaccagcctgggcaacatggcaaaacctcatctctacaaaatgatacaaaacttagccaggtgtggtagcacatggcatggtagcacacgccatggtcccagctactcaggtggctgaggtgggaagatcacctgaatctggggaggtggaggctgcagtgagccgtgatcacaccactgcactccagtttgggtgagtgagatcctgtctcaaataaataaataaataaataaataaataaataaataatattagccaggcagaatggtccacacctgtagtcccagctactctggaggctagggtgggacaatcgcttgaacccaggagtttgaggctggagtaagctatggttgtgccactgtactccagtgggacaacaaagtaagaccctgtctctaaaaaaaaacacaaaaggttaaaaaaatgatattcagatacatataatgaatatggaaagacatggaaggattttcacaatgtattaaggggtaataaagcaggtcattaaagaatatacacagtgcttcacttatacgtaagtgtacgtatgacagaaagccaagagccaaaatgttagcactgtatctgtacgttagaagattctgagtgactcttatattctattatttgttagccatattttctaagtttgtaataaatacgtaataccttctgtaacattttttctttaatgcacccatcttgtaaaaggtgtatttttctccactttaatgaggacaagtaggaaaggaagagaatttgtcagctaaaaaataaactgggctgacacaaggtctgtctgtctgcgggtctgtctgctttggtggaggatggtaagaataagggagacttctgcatatctgtatttacatgcagacaggaaggatctaggaggaagggagatactgtagatgccaacactcaaccaaaaacaaaaaaagctcccaaatcccaaaggatgggagacagaaatgtatcgggagctaagctcctaaactggataaagcccacatatttctaaaaatgaaacttgccggtttacattgctttatttgcacctgcctgtccagtgggttttccacttggaagtgaaaaagagtgctaattctctcttcagagagagaaataatgtaaaataactgtgtttatggaggtcactttcttcccagcttccagtctattcactacagaaacaccgtggaagagggagctgaatcatttaaaatacaccttttgcaataaattcaagtattttaaggcaaaatcattagttattaaaatgggaagaaggccgggcatggtggctcatgcctgtaatctcagcactttgggaggccaaggcaggaggatcacttaaggtcaggagttcaagaagtggacaatatggtgaaacaccatctctactaaaaatacaaaaattagccaggcatggtggcacgtacctgtaatttccactactcaggaggctgagacatgagaatctcttgaacccaggaggcggaggttgcagtgagccaagatcgcgccgctgcactccagcctgggcgacaaagtgaatgagcctccatctcaaaaaaataaataaataaaatgggaagaaaaaaatagaagattaaggcaaaacaaaatgctaccaacagatcacaccaaactacctagactttctccaaagcctaatattttactcactttcagaaaaagaatagaaacctgggaaaaaatgaggagtatctgtcctttgcttatgtactttgatgaaatgccaactactactataaatagcatttttttaaataagaaaaaatggagtatttcggaagtggtttttggtttttttttatattgagtttttttgtctttatttggagtgttttaatatccgccatgacaagttaaaaacaaaatgtaagatcataaaaaaaggaagaagagtcattttaataattaaatttgtaaaattgcacatccgctaaaatgcaatcctttgtccaagataaatatttataataagcaggaaaaacaagtcagaaaggaacactgcattccccttcaaaactcagggctaaaaatttcttcccatggacatcacagtttaaaaattggcccataaatcacagaactctttgcctaaaagggtataaattggaagttaataaataaaataattgaaaggtttagtctcatattgaaaaatacatattcttatttttaattttcataactatgaaaaggttcacataaactactaatactttttgtttgtttgtttgagacagagtctcactctgtcacctaggcttgagtgcagtagtatgatcacggctcactgcagccttcaacttccgaggctcaagcgattctcccacctctgcctcccaggtacctggagggcatgtgccaacatgcctggctaatttttgtatttttctgtagacacgaggtttcgccatgttgccctggctggtctcgaactccggggctcaagcagtccgcccgcctacaccacacaaagtgctgggataacaagcatgaaccactgctcccagccttactaatgaattttttaattaaaaagctcattcaggtagggttggatgagggggacagataaaatccattgcctgagcaaaagcgcaagaaacttcatttacaggccactcactttcctaatgacttccttcatgttaacttcttgtcactgttaaaaattagggttctgggccggggacagtggctcatgcctataatcccagcactttgggaggctgaggcaggtggatcatctgaagtcaaaagttcaagaccagcctggtcaacatgatgaaaccttgtctctactaaaaatacaaaaattagccaggtgtggtggtgtgcgcttgtaatcccagctactcaggaggttgaggcaggagaatcacttgaacttaagaggcggaggttgcactgagccgagatcgcacctctgcactcaagcctgagcgaaagagcaagactccgtctcaaaagaaaaaaaaaaaaaaatagagttctggcagcactgtctttatttaatagtctactgtgagtctgacatttattgcctttaaaagaaaaaatttgtaaattcagtctatactatcactgggtactgcaaacttgctaattatatcttcagtgtaaaatagctcttcctctcatttgtcttgaacatttgctggtcttttaagcatcaaaaagtccagataactgttgaaggttagaagaataagtttatgtttgcttttctgaaataagcttatagctggtaagtatgtcttctttccactttcatatttttagactgaagagtactgatcaccttagtcagttttacaaaagtaacaaatgcattcgctccgggacttgggtttccttcactagaataccttccactgttaaatcatttaagtaggagaccagaatctcagatcgtaatccatgtgcacagtcaacatggctttgcaaaggaaggataacgttctctgttttctttcttgtctccttcctaaggacaccccaaaacctagcgtttttctgcattacagcactgcaatggcatcttttaggaacactagaattactcccttccctgaacctatggactgtataaaatataactcgtgatcacaaatttttcttggaggttagcaagagtcaatcaaacaaaaagatttggatgaatgatctttcctcaaaactttagcatttccctcaagataagagtaagctaactaccattacctagggttatgtcaaggagaaacgggatctgagtaaaaagcatatgcaatgatataaccagaagaactgaaagcagaatctcagagatatttgtacatccatgttaataggaacgctattcacaaaagctaaaagatggaagcaacccaagtgtccacaaacagatcaattaattagcaaaatgtgatatttacataaaatggaataataaccagccttgaagagaaaggaaattcagacacatgctacaacatggatgaacatggaggacagtgtgctaagtgacacagccagtcacataaagaaaactatggtatgattccacttacatgaggtacctagaatagtgaaagtaaaatggtggttgccaagggctaggaggagagaggagtgaggagttgttgtttaatgtggcggtccctaacctttttggcaccaaaaaggaaccggttttgtgaaagacaatttttccatgggcggggcagtgggggaggcagtgggggagtggtttcgggatgaaactgtttcaccacagatcatcaggcattagttagattctaataaggagtgtacgacctacatccctcacatgcacagtccacaatagggttcgtgctcctatgagaatcgaatgccgctgctgatctgacaggaggcagagctcaggaggtaatgctcgattacccaccgctcaccccctgctgtgtgactcgcctcctaacaggcaacagactagtagcgacctgtggcccagggcttggggacccctggtttaatgggtatatattttcagtttttcaacaagaaaagaattcaggagaacgatggtagtgatggttatataacaagatgtatgtacatttcaaatggctaaaataataaattttatgttatctgtattttactgaaataaaacatagaggaaaaaaaccagatgcaataaacatttttcatgttcatttcacagtgttatttttttgaagaaaagagattaatttatctcaacttttcatatattcccctataagacaaatggagaaattgtacttggttccaattttgtcttttaatactcatattttcaacctatcattctttcagaatataattacaggtaacctgaattctagaatcagaattgttttcactctgatcatgcctctagacatggtatttaagatagaactatttgctggaactcactatggtacacactgctagttgcctactcaagcatcctttctctccttctcacttacaagattaatcccattttttttccctgtagcaaggtggccagttaaaatattcaccttgccttgcaactagagataaccatttggctcaattccgcccagaggaggggagaagtatattgggtggaagacccaggagaactattatttccctgataaaaattaacagacttggctggcatgaacatcttgccctgggcctttctgcttcctccaggaagacagaagctgccagtttccctgagcaggtaaccagccctgggttgcctacctacagactgaagcttacttgagaaaaatgagttctttcttagttaatctatcgtaaaagggtttctcttacttgcagctaaactcaatcctaactcaatctggtgccactgagataagtctgaggaaagaaattcaggagtatttctggtctacaagttggagttggatgttccagctctgcaaaaggaatgttaaacaggctgaaatggcctgggcgcaatgactcatgtctgtaatcccaacactttgggaggctaaggcgagtggatcacttgagcccaggagttcgagaccagcctgggcaaaatggtaaaaccctgtctctacaaaaagtacaaaaattagctgggtgtggtggcatatgcctgtggtcccagctacttgggagggtggggtgggaggatcacttgaacccaagagttcgaggctgcagtgagccatgatcacaccactgcactttagcctgggagacagagtgagaacctgtctcataaaagaaaataagataaaataagcctgacatgtcctataactctgatctaaaacgtaacactgaaggacagatgactggaatagggagatgcatgcactaaggatgctatcagagtctccatccatgaatcatgttttctcataataaaactgacatttattaaacactttctatgtgccagacacagggctaaccactttgtacacattatctcatttgatcccaacagccttataaggtaaaactcagctcccaactactttatggaactgctttttgactgctttatgtcttgaacaatttatttttctcctatatacaaagagggtaaaaatgcaacccttaaacaattgttatgagaattaaagataataatcagcatgcggcaagagccacatggttaattctcaataaaacccaactgtcatcatggtcaaaaagaatagtacactgcacaaattcccagatgtagcaaaacatcagaatcccctggagaattgtcttagaatacagactccttgactccagccaggcttaaggaatcaggtgcagcccagtcatccagagatgtgaaggaatctggtctaagggaataccaactgctgtattctcaagataataaaaactttaccactttgttataccaaatcatcacaaagcttacctaagccacatataggaatctaccctgtgcctgcacaactgccttcacagaacctacattttaaagtatgccctctgttttcccaagacttaagaacatcgctgtagcttatgtgaaattgctttaaataaaagaagacatacatgtggccaagcatattaaaaaaagctcaacatcactatcattagagaaatgccaaccaaaaacacaatgatataaatttcacaccagtcagaatggctattattaaaaaggcaaaaaataaaagatgctagcgaggttgaagaaaaaaaggaacacttacacactgttggtgggagtgtaaattagttcaaacactgtggaagacaacatagcaattcctcaaagacctaaagacagaaatactatttgacccagcaatcccattactgagtatgtattagtctgctttcacactgctgataaacatatacccaagactgggcaatttaccaaagaaagagatttaatggacttacagttccatgtggctggggaagcctcacaatcatggtggaaggcaaggaggagcaagtcacatcttacatggatggcagcaggcaaagagagagcttgtgcagggaaacgcctctttataaaaccatcagttctcgtgagacttattcactatcacaagaacagcatgggaaagacttgcctccatgattcaattactcccactgggtccctcccataatacctgggaattcaagatgagatttgggtggagacacagacaagccatatcagggtatacacccaaaggaatataaattgctctgttacaaagacattgcagcacagtaacaaagactttgaatcaacctaaatgcccattagtggtggattggataaagaaaatgtggcatatacacactatggaatactatgcagccataaaatggaatgagatcatgttgtttgcagggacatggatggagctggaggccattatccttagcaaattaacatatgaacagaaagccaaataccacatttctcacttttaagtgggagctaaatgatgacaacacatggatatatagcagggaacaatatacactggggtctattggagggtggaggttggggggagggaaacgatcacgaaaaataactaatggatactaggcttaatacctggatgatgaaataatccgtaaacaaacccccatcctgtgacacacatttacccatgaaacaaacctacacatgtaccccttaacttaaaataaaagtttaaaaaagaaatccttcaaatgaaaaaaaaaaagaaagaaaaaaagaaaggaattgctttagagggcaaggtgcctcacttctgctcactttggggaccaggcataaagcagggtgtcttgacaaagatcagagatcttctttgtatcattttgtcttggctgccaggaagttcagagccaaatgttgtactttaatttttctcaatcaagtttttttttcttttttgaggcttcaggctggagtgcaatggcacaatcatagctcactgtagctttgacttgtgctcaagtaatcctcccacctcagcctcctgagtggttcagactacaggcatgagccaccaagcccagctaatattttaaaaaaattattttagagatggagtcttgctgtgttgcccaggctgatctcaaactcctgacctcaagcaatcctcccacctcagcctctcaaggtgctgggattgcaggcatgagccaatatgccgggcccctcaattgagtttcaactatcattattttcattatttttctttattttgggaggggatattttcaaacattttattacaaaagcaatttccatttattaaggaagatttagacaaaccaaaggaaggaaacttaaaccacccattttccctctgcccagagataaccagtattaacaggtttatatacatcctcctagacatttttgtctgcttcttccttacatagtattttatatttatttaaaatactttataaatctgtttttattacagtgcacattctttaataatgtcattttaaagcttcataggtattttattgtctggacattaaataattttttaccaatatctcccactctgttattatgcattcctaatgctgatttccattcttaattttataagcatttcaataacaatcatacttagaattaaaattttgaacatatacatgacatttatttattcattcttcattcattcagagaataaattcttaaaaatgaaagtcaaatacacattccagtaggcttccacagaatagaacactccctgcctgaaaaattcttctcatcttcccagattccatttcttccttctcctccactcctccacagcagatcctctacaagttagatttcctaaaggatcagtcttggacctcttcacacttttactaagtggtcacgcatctactcactccacagcatctatgtgcaaaactcctaatgtcttatttccagcccaaacctttcttctcaattacaaaatcatgtgtggtggttttaaaatacattcagaaattatttggtggctgtctattcaagcggggggcttaattccccacccactgagtatgggctgaaattggtgactcacttctactgaatagaatatggcagaagtgatgagtcggacttttgagactaaaagtattacagcttcccctttgcattctttcatatctctctcactctaagagaagctcacagccatgtcatgaagacactcaagcaccctagagagaggcccacgtggcgagaaactgtggccttcgaccgagaaccagcagggaactgagaccttctgccaaaagccatgtacataagccatcttggaatcagatcctctagcctcggtcaagcttcagatgatggcaaccctggccagcatcttgagtgcaatctcatgacagaccctggactggaatcacctagctaaaccacttcaaaattcctggccaaggaaactgcatgagataataaatatttgctgttttaaagcaccaatgttggggtgacttgttacagagcaatagataactaatatagatttgctgctaagtttcataataatttattatgcagcaagagataaacacatactatgtaactaaccacctacttgacatctccactgagatagctcacagactcatttcaaccttaacccatcaaaaaactgaactgttgcttctctctcaaatctattctgcctctagtctttcccaactacggaaaagcactttcatccattcactggttcatgccaggatgctgaaatgaatcctttcttctaataccacaatctaacccttctatcaacttttgttggttctaattcctaaatacagcttgagtccatccacatctcttcagttccactgtcaacccccagtccaagctactgtcatctcttgcctccagcctaaagccaataaccttctgacactgtctcctaaattctcttcttattccttctaatcaactctctgaactttggaacaactaaattaacatggttcatatggccctgaatcatctgaccactcctatgccaagccttgtcttgaaacactcaccctcctcagtttgctccagcacactgaccttcatgttactctgacaaacccagccctttcctgcctcgggatattggttcatgctgctatgcctgcctccttcaccctgttctcaacctgcttaattcagacgaacattgcaggtttaattttaaacatcttctcttcagagcggacttctggacgactcctccagtctctaaaggcaacctgttttccttccttgtgcacccagtacttatcttaatttgattacatattgttttgggtaagcccaagagggcaagaaatgtcaactttgatctctatagtatatgcagttcccaatacaggttgtcaatttaaaaaatattgaataagcttattgaaagtgtttattaagtctaaacacagagtgtattcaatctagacctctaacttgtccatttcaatagaaagaacatgaatctgttatatgtattgccttttcaaccttctgcaaaattgcaagaccatcatcatcaagatgatccactgactgtttttctcatcttttccacatgtttaaggatcctttaattcttggcaaagatgaaaattgacttctagaaacattaaaaagaagaaaagctggtataataatagtccctaaaggcagaccacaaaagcaattctaaagttcattagaaaattaaattggcccctgattgatctaaatgggaacattttatcctagtgtttagagttgtgatgagtaatcatttccctttccaaagctcagtgttttataaaaacagggttgatcatgactctctgcaagattattttttggtgaagaaatcagagactcactgatggaagaaccaagaaatactaataagggcatgctgaagcacagtgtaaatcaacagtgccctgtcttttaacttccagtaaataagacactgacttgtaaccagagacagagtaggtctgggagccagccgactctgtgggttctgaggcagagccacacacagggagcagccccacaacagtgttcacagtgactatacagaaaagaaactgttaataatggcactccggtagaaaaaatagcaacaatccatgcctcactcttgccacctgcattcatacacacagactctcaggctagcatcaaggctctgaattcaaagatcatatagggttatgtatatatatgtaatcactccaaactttgataagtggcacagattttaacttaatagatttatgggaaatacatggtgatagaatatgataaactcaactctgtaacaagcacatgtatattcctgcacacagaaagaaatgttacttggtacaggccgggcaccgtggctcacacctgtaatcccagcactttgggaggctgaggcaggtagatcacttgaggccaggaggtcaagaccagcctggccaacatgatgaaaccctttctctattgaaatacaaaaattagccaggtgtggtggtgcacgcttgtaatctcagctactggggaggctgaggcacgagaatcacttgaacccagaaggtagaggttgcagtgagctgagatcacaccattgcactccagcctgggtgacagagcaagactctgtcccaaaaacaaacaaacaaaaaaagaagtgacttggtatagaaaaatatataatagtcacagatttgaaatactatagctttggtcactccatttattgtgacaaacagggtgcatatttttctaatctgtagcttagagcacagtattattaatatactgtactattaactatgatttattcatttctataaaccaagtaataaagttagaccatttttactttggtaaattcttcagttctctagaagtgaaatcttggtaaaagaatttaaccacaggcacctatagcaattttatacataattctttaatttgcaaattaccagtagtaactaaactatttttttctaagcaataaaaagtaaagaacataatgctataaatgtttaggatacaataatcattctagaaaaattctagaaatctttctagaaaaattcaaatcagaatgacactgggaagcctgggcatggtagctcacacctataatcccagcactttgggaggccgaggagggcggattgcttgagtccaggagttcaagatcagcctgggcaacatagtgaggcctctgtctctacaaaaaactttttttttttttttgagacagagtgtcgctctgtcaccaggctggagtgcagtggcatgatctcagttcactgcaactcacgcctcccgagttcaagcgattctcctgcctcagcctcctgagtagctgggattacaggcacacgccaccacacccagctaattgttatatttttagtagacaccaggtttcaccatgttggccaggctggtatcgaactcctgacctcgtgatctacccacctcggcctcccaaagtgctgggattacaggcgtgagccacccggcccgacccaaaaaacttttttaaaaaaagcaactgggaatagtggtgcacacctgtagtcccagctacttgggaggatgaggtgggaggactgcctgagtcccagagttcaagactgcaggaagctgtgatcgtgccactgcattcagcctgggtgacagagtgaaaccctgtctcaaaaaaaagaaaagaaaaatgacagtgggtatcaaaaacccattacaacttataaaaaggctgctaccctatgtgggggggaagaaaacatgccataaaacgccaggcagaacgtgctgattgacagagaccaggctgtgcactagaccagaagagtggtgccctgaaacaaagaggtggagctaggaagcaaggactccaacatctaaggccttcaatggatacattccaaccagcaagcaacacccaggcagccgcctggcagggcaaggctagattccaccaacgaggtgaatcccccctaaaaatgaatcagagtcacagctttatcaaaggtcaaagtgaaacactgagaatcagtagccaggcaaaagcaaacaagggtacagatatatagcaatcaaagacaactcaaacaaggccacatatccaaacaaagagcctggaaaacaaaaagtcaccatgacacccaaccaccaggaaactgtgaaatgatcttgagattgataataatgaaattagaacaccctttaagcttaaggaaagaaatccagaaatgaaaggtatagcccagatcacttttagatctgtgctagatagctaatatgcatttccctagccataatcaaatattctaacatgcttataaacgctgagttattaatgtttacacacttgcataaatatcatttagctcttataaccataaaatgccccccagtctcatctgttaatagttctaaaaggatcacagcgcttaggatatggctgacgcatttagcaaacataatccaaatgttaattctagataaccaactaaagaatagagtccatctgggacatgtattttacgtaaaatattttcaaaaaacattcaagtgtgatgatgttagcatagtgcactactagaagtctcatactatgtagctactgcccaaaagaagtaaaaactccttgtttaactatgggagaaaacatggaaaggatagttcatcaagattgaggaattccagtattttttaagtatttccttttagttactttttttttttttttttttgagatggagtctcactctgtcacccaggctggagtgcagaggcacaatctcagctcactgcaacctccgcctcccaggttcaagtgattctcctgcctcagtcacccaagtacctgggattacaggcgcaggccaccacacccagttaatttttgtatttttaaggctgggcgcggtagctcacaactgtaatcccagcactttgggaggcaggggcgggcggatcccgaggtcaggagattaagaccagcctgaccaacatggtgaaacctcatctctactaaaaatacaaaaattagctgggtgtggtggcacgtgcctgcagtcccagctactctgggagctgaggcaagagaatcacttgagcccgggaggcggaggttgcaatgagccgagatcacgccactgcactccagcctggtgacagagtgagactccacctaaaaaaaaaaaaaattgtgtttttagtagagatggggtttcaccatattggccaggctggtctcaaactcctgacctcaagttatccgcccgccttggcctcccaaagtgctgggattacaggagtgagccaccgtgcagggcatcttttagttacattttaacatccatgctctttttgtctctactgattcattttttaattttgttttgttatacatatttttgtaagccactgaacctagaacaaagtatggagttattaacaaatgtaaaatatttaccttattccatgaactaaactaaaattattcaaccaaaaataaaaaactaaaagaagattgaggcattccatagcgttatcctattcttggtttctttgctttctctccatcacgggagttgagagtacccaattatataaatcaaataaaagaaagtaagaagaaaaatctataaatgccatatgatctgccaagaagtactttattttatagtaagaagatgcagtgtaagcaaatggataacacatacacccacggtaattcaaaggctctccatcccaggacctgttcacaaatgcagacctttgaaaatattctgcaagcactgagtggctaatatttgtgtaatttgaagaaaagaactagaaataatataaccataagaaattgatatttttaggaataatgaatggaattgattttgtagtaacaatgaaaatgatgacagcagcagcagaaataactaacacatagagtgcttaccatgttaggggcatggtaccacctcccagctattatcctattttttgtcattgggatgtaattcacacgccataaaatccatccggatttaacggatgtacgattctgtggttttttactgtatgcacaaagttgtgcgacaatcatccaatcttaattccagacactttcatcaccccagaaagaaacccattagcagttactcccccattccctgccagcctctgagccctaataaaccactagcctactttctctctttatggattttccagtggcagacatttcatataaatggaatcataggatatgtcaccttttgtgccagacgtctttcacttagcattatgttttcaaggcccatgcatgttgcagcttgtatcagtcctgtatttcctgtatggctgaataatactccattatatgaaatgaccatattttgttgatccattcgtcggctgatgggcattttggttgtttccactttttgcctattatgaataatgctgttatgaatatccatgtacaagtttttgtgtgaacatatgttttcagttttcttgggcagaaaacttagagagaaattactgagttatatgataactcaaagcttaactttttgtagaactgccaaaatattttccaaaactgctacactattttacattttcacaagcaatataaggttctaattttcccacatccttgccaacacgtatttctttccatttttattacagccataccagtgggcacaaagtagaaaaatttcgctatggttttgatttgcatttccctaagtgactaatgatgttgaccatcttttcatgggcaataattattagccaattgtttatcttttctggagaaatatctattcctttgctcatttttcaattgggttgtctttagattgttgagttataagaattcttggctggacatgatgactcacgcctataatctcagcactttaagaggctaaggtgagcatatcacctgaggtccagagttcaagaccagccgggccaacatgctgaaacacgtctctacaaaaatagaaaaattagccaaaattagccaggcatggtggtgcatgcctgtaataccagctacttgggaggttgagggaggagaatcgcttgaacctgggaggcagaggttgcagtgagccgagatcacaccactgcactccagtctgggtgacaaagcaagactccatctcaaaaaaaaataaaataaaaaataaaaagacttctttatctattgcggatactagacctttagcagatacctaatttgcaaatattttctcccatcctctggactgtctttcacttgcattttcttattttaatcctcacaacagccatgaggtattattgtggctattactatcccatttaacagatgggaaaacagagctgacatacacaactaataagaactggagcagagtccaacccaggcaatctgcccccaggcatccataggacatactgtcagaagcgctgagctcattagatgctatagcaataggcactaaataaaataagcaggattaaaaatgattaacttaaaaagaaacagtattactggtgctttgcacagaaataccagaaggcccttcttaacttgaggaggaagagtggcttaaaataaagcacattcagccttaaaaggaaggcaaaacttggcctttaaacactgtctattcttttcaattgtaggaaactttctttcttattgagttatgtagttgaaacaaaggaattcagaatacaaatggtatttttgctgagatgcaaacattgtaaatagtcacagtgggtgttttgttaggtggaggcctatttcttagtcaacaaccccctcttttcagaatgtatgcctccccagccctacgcacccactctctgagatgatgaacaaagcagagttttagcaactaagatatcactccaatctgtcactccttcttctacccttatttctgccaccagctatgtgaaatataaaagttaatctgcggccaggcgcagtggctcatgcctgtaatcccagcgctttgggaggccgaggacggcagatcacctgaggtcaggagttcaagaccagcctcaacatggagaaaccccatctctactaaaaatacaaaattagccaggtgtggtggtgcgtgcctgtaatcccagctactcgggaggctgaggcaggagaattgcttgaacctgggaggcggaggttgcggtgagccgagattgcgccattgcactccagcctgggcaacaaaagtgaaactccgtctcaaaaacataagcacataaataaaataaataaaagttaatctgcaaagaactttagtatgtctgtagaattaggttcatggtaaataatgggtaatagggggatttaaaaaagcatgctagatctactaatactggcatggaaaggaattcagtatatttagctaaggaaaaacaaaacctgtaaacaatataaataatatcatcttgtatttattaaaaataggcaatataaattcatattttaatactcacgttagtaaatgcacataaacaaaaaaagtcagtggggagagaagaccctgttgaacttgactctattctggcacagtgaagagacatgagaggtgtagaataagtgggaggcccccttgcagggatgagtcaggggactggggacagtgctaggtggggagtttgactggggcagtacacctgtcaaacagtaatgcaggtgtcttaaggtgagctcagggaggacagaaacatcccatggagcaaaagggcaaaagctcacttgatcttgattttcagtacgaatacaggccccatgtaagtctgaaatccaggaggacagtcaaatcataaagctccaaaatgatctcctttgactccatgtctcaaatccaggtaatgctgatgcaagaggtgggttcccatggtcttgggcagctccgaccctgtggttttgcagggtacagaccctcctggctgctttcacgggctggcattgtctgtggcttttccaggtgcacgatgttagctgtcagtggatctaccattctggggtctgaaggatgatggccctcttctcacagctccattaggcagttccccagtgggaattctgtgcgggggctcccacctcacgtgtcccttccacgctgccctagcagaggttctccattagggctctgcccctgcaacacacctctgcctggacatccaggcatttccatacatcctctgaaatctaagtggaggttcccaaacctcaattcttgacttctgtgcacctacaggtccaacaccatgcataagcctcccagggttggggcttgcaccctttgaatcaacggcctgagctatacgttggccccttgtagccatggctgggacacagggcaccaagtcccaggactgcacaaagcagcagggccctgggcctggcccactaaaccatttttccctcctagacctcctggcttgggatgggaggggctgccgtgaagacctctgacatgccctggagccattttccccactgtcttggggattaacatcttcctgggaagccctccaagttcttcaaagctctgcctgttacccagttccaaagtcacttccacattgtcaggtatcttaattagcagtacccaactctaccagtacaaatttcttgcattagtccattttcatactgctgtgaagaaatacccaagactgggtaatttataaagaaaaagaggtttaatggactcacagttccacatggctggggaggccttgcaatcatggcagaaggtgaaggaggagcaaaggcatgtcttacatggtggcaggcaagagaccatgtgcaggggaactgccctttataaaaccattagatctcatgagacttcaatatcacaagaatagcacgggaaaaacctgccctcataattcaattacctcccaccagtttcctcccacaacatgtgggaattatgggagatacaattcaagatgagatttgtgtggggacacaaccaaaccatatcagagggttccccactaggagtagggtgtaatttgttttctgttttgttttcttttttgagacagagtctcgctctgttgccaggctggagtgcagtggcacgatctcagctcactgcaacctcaacctcctaggttcaagcgattctcctgcctcaacctcccagtagctgggactagaggcacgcgccaccacaatcagctaatttttgtatttttagtaaagacggggttttaccatgttggccaggatggtctcgatctcttgacctcgtgatctgcccacttcagcctcccaaagtgctgggattacaggcgtgagccaccatgcccagcccaggttataatttttatgtgatgaaatgtttgacttttaaaatacaactacacaatattgtatttaaaaagaaagaaaacaactaagggtagcactctgtcagatggtcctacaaaccttataagccatagaaatgaataaacaaatatgaatcaaatgaacgaatgaacagatctgggtaagttttagtgacttcccaaacttcttaaagttatgagaaaaataatgcatgtcctcacatatgtgaatttgagcacaggcagaaattctataacctccacatcaatttttttaaagacctctcaatccaaaaaaagtttatgaacactatcttaagagaattctataaggtctcattttatgaaaggtcaaaacagaaattaaaagataaaccaaacaaaacaaaatcccttaagtcaaacacagtaaaaagacaccttgtaagtcacaaaagaactgtcattagagctctcttagatcctgatctgtaatttccaaactgccactaaacggaccctaactttaaaaaaccttatcatttattcatttataatcctttttttttctttttttgcgacggagttgcccaggctggagtgcaagggcatgatttgggctcactgcaacctcctcctcccaggttcaagcgactctcctgcctcagcctcctgagtagctgggactacaggcgtgcaccaccacacccagctaatttttgcatttttaaagtagagatggggtttcatcatgttggtcaggctgatctaaaactcctgatctcaggcaatccgcctacctcggcctcccaaagcgctgggattacaggcctgagccacccagccatgcttatcatgtatattccttaatggtaaagatatgtttctctttcctaaggccaaaaaacaaggaatctagcatataaaaattaacaaattaacatataccaacaaattatttggtccattgctttaaaaaatatttattgagcatctactctgtgccaggcttgttattcctttaatgtcatatgtctttctggtttgatatatgtcacagttttctttcttctacacactgcaggataaagaaactgaagaaatcaatggccagaattaggttatcttcaatgtccacgtgataattcccaacagcctgtaccatggctttttatgagacatgaaaagggaaagtagcaacaagcttataggatctcagtctttagatcactaaggattatcagtaataaaggaaacagaaggcggggtgcagtggctcacggctgtaatcccagcacttcagaaggccaaggcaggcagatcatgaggtcaggagtttgataccggcctggccaacatggtgaaaccccatctatactaaaaatacaaaaatcagccaggcgtggtggcgggtgcctgtaatcccagctactcggaaggctgaggcatgagaatcacttgaaaccagaaggcagaggttggagtgagccgagatcgcactactgcactccagcctgggcaaaagagtgaaactccatctcaaaaaaagagaaagaaacagaaacttctccttatataggggttttcacattcttaggatttttctcctggtcgccccccgccaacaaattactgtcttcttgaagataagtttctccttgaaaaataaaagctcgtagaatttatccatataagaacaaaagattcaggcagtatctaacctagtaggttactatgctatcgctacatctgtttgtctacgacaaaatccttacttaattctaacagtaacttgagtttttcagaaatgcataatagaaaatattctattattctaaataatttagatattattcaacaactgcattgtctatataataattgaggaaagtcataaaaagaacatatctataaaataaaattcacatctgtaaaattaaccaaaaaaagtgacagttctgagtaatgtatgtataattatcttggaaggatttttttttttttttaacaaatccttgactcatgtataatcctttattaaaaacgcaggtagaggggccgggcacagtggctcacacctgtaatcccagcactttgggaggcagaggcaggcagatcacttgaggtcaggagttcaagaccatcctggccaacatggtgaaaccccatctctactaaaaatacaaaaaattagccgggtgtgatggcacgcgcctgtagtcccagctactctggacactgaggcaggagaatcacttgaacccgggagatggaggttgcagtgagccaagattgcgctactgcactccagtctggatgacagagcgagagtccatctaaacaaaaaacaaagagacaaaaaaaaaatgcaagtagagataccatctcacatcactcagaatggctattatcaaaaagtcaaaaaataataggcactggcgaagtggcagagaaaaagcaacacatacacactgttggtaggagtgtaaattagtccaaccattgtgaaaagcagtgtggcaattcctcaaagacctaacaacagaaagaccattcaacccagaaatgccattactgggtataaacccaaaggaatataaatcattccatcatgatgacacatgcatgtgtatgttcactacagcactattcacaacagtaaagacatggagtcaacctaaatgcccatcaatggtagactggataaagaaaatgtgttacatatacaccacagaatatgtgcagccataaaatagaatgagatcatgttatttgcagaaacatggatgaaactgaaggccatcatccttagcaagctaacacaggaacgaaaaatcaaataccgcatgttctcacatttaagtggcagctaaatgatgaaaacacatggacacatagaggggaacaacagacatgggacctaccagaggctggaagatgggaggaaggagacaatcaggaaaaataaccaatggctattaggcctagtacctgggtgatgaaataatcagtacaacaaacccctattacacaagtttacctctataacaaacctgcacacgtaccccagaacttaaaatcaaagttaaaatatatataggtaaaaatttattgatagcaacatctcccacgggtatactctcctggctttcaagtgaataaacatgagctgtactgctttaacacatcaacttttatattcatgtgacgattacgctgtttattgtgtcagaaatagaatgcgatgcacatacatctctatcagctgccataatattttaagttaatgaaaataaattcccaggccaggtgcggtggctcacgcctgtaatcccagcactttgggaggccgagacgggtggaacacctgaggtcaggagttcaagactagcctggccaacatggcgaaacccagtctctactaaaaatacaaaaattagccaggcgtgatgacacatgcctgcagtcccagctatgcaggaggccgaagcaggagaatcacttgaacccaggaggcggaggttgcagtgagccgagatcacgccactgcactccagcctgggtgacagagcaagactcagtctcagaaaaaaataaaaataaaacttccttccatgaacgaaatgatcattgaatccacagatcaccaaaaaaataccttaagtaatctctgaacttcttcacttttcataaaattggagttatttaaatcccacttttagtttggctactcattttcttcccaagtacatttgaacactgtggtgaatgtttgtcgcttagtaacaatcctgccaatgacactgagagaaaaccattaaatcacattaactgaagcatgcaatttcagaataaaatgtgaaaagtggagaatcctaagtggtttatgtacatgcttttgtcacaagaaagttgaccatctcctcctcatgatctactccagaattccaatcctaggctggccctaaagttgaaagtacttgagtcattccttccctttttccccttcatcagacaaacatatgcatcataacacacacatgaacaggaaaagcttcttctaacattatttttaaaattaattattaaatcaactgctaaaagaaaggcatgaaatttatttcaggagaaagcaggaatgattggagaattatccaccactctcaattctttctgcagatgttcttttttaaaagaagtgaaaatcaagagctacgcaatgtggcaagcagaataatacatcttcttcctctccacttgcaaaagaggcccatgtcctgtgagtaccttaggttacacagcaaggggtaaattgaggttgcagatgaaagtattgtttgctaatcaactgactttaggatagaaggttatcttgggttagcctggtgtgcccagtgaaatcacaaggggccttctaagtggaaaaggaagagagttgaatagcagagcgagcaacgagccacatgagaaggactcagcccaccactgttggttttgaagactaaagagagccatgagccaagaaacatgggcagcctgtggaggctggaaaagaccagggaaaggagtctcctctggagcttccagaaggaacatggccctgtcaacaccttcattttagctcagtaagacccgtgtcagacttctaaccttcagaaatgtaagatagtaaagttgtgttgttttaagccatcaaatttgtgctaatttgaaacaatcacaaaatgaaacaaatacacggactcatctgcaacgcttctcagtcagtcatccctgcctgtgaatcacaaattgggaaacagaaaatcagaagtaaaaacgcgaagtggggagagcaaagctgtgggtgcctgagcttctagccccagctggctataagtacattagcacccacacacaaaatctacaccaggagtcatcccacacaaaccaacccaaaacaaaggacatttgacccaaatcactccttttacctctcagggggaaacataagggagacagtggggagaagcaggtcccaatcagaggcaatttctgcaggtaccaattgagttcctaatcaacaaaccaatagcacagacccaacaagagggagactctcacacgcaagttccttccatcacagttacaccgaaaagaagagtgagctcagctttaagcagtggaatcgcaaatattgaaatccacgaagagagctttgccataactcaatttaattcatcaacagagcccagatattcccaggctaccaacctcaacatccaggtcctcaatagcattctctcaaggtactacaataacctcccatactatctacccttgtatttgcttcctaaacacctctgacagattcaccttcttctgatcacaaaatatcttatgctccaaacctccgaacatcacccactgcctttaaattcagatacatctatatgctacagggctaaatgcctacctagcatggtattcagcatgctttttatagctaccccctattaattctgtgccctctacctggaacattttcctccagccccaacattgccatcagtatccacagcaaatggtaccccctttcatgaaggctttagatggtttctctcccagctctaaacccatcccaccctcaccttttgaattcatatggtactttgttccttatctataacaaaatattgtatatatacacgcctatatgatctctcccttttttgttttgttttcttgtttgttttagacagggaaagactgtaatgtgagttgagtgagtttgtatctctgcccatctgcaggtttgctactgcacaaattcctaccaactgagttgggacctagacgctgtcttgagagggaagatgtaaggcccaggtggaaaataaacaaatagtaataatgctacaaagaaacaggtccgaccaggccaagtcagtcctcaaccatcttacacctcaccagttctggaaaaccaagctctctgtgcgtcaatttcaaaatgattttaaagttgtgttaggtcgctataccaatggacatatgtatagaaatatttcagtgcttctcgaagtgagaaaattaaagatggacagactctttcctaacatctgactcaaaagcctagaaaacacatagaaaagaagcaaataatacagttctgtaagatactgtgttttgtgtgccatggtttctctatttttagatttaaatactattgtgtgtccatcaattattatgtataaccattaaaaaatcttttaaaaacataaaattaaaagtgctatgtactgagaaacttattcaaaatcatatttcaaatagcaaaccatacccaaaaaattaaaaatatttttttaaaaaatagcaaacccacataatacaaaacctaagagaaactgagcacttaacaaaataagcataaatataacacattacttagcataaaaactcattctaaatgacctggcacacagtaggtcctcaatacacctttgttttaaagtcctgactcagtgcaaactcatcagcctcataggtcagatgttgtaaggacccaagatattgcatcgcgtggaaatcaactttcacatcacataacaagtggcatgtcatttttttccttctctaccgtatttctaaaactattcaggtgttgatgcagacctttttccatgtcttggcaaagtgtaatttgaacaggcagtttctcatgaccttcaagtctgtgttcaacaatgaaatcatttggctttatatcccatccagttattaatcacaaacaacaaaagaagaactttcacacagaaaatgtgaaacctatgctggccagcactcactctgggtcactccaggtcacattcacttgtagctaagttcactgaagaccatgcaatgacctcagctatttagaaaatacattcaaaatttttctggagaggaaaaatacagctatgtgactttaagacaagtgctcctggaggtcagcagtctgaaaagggtacaatgaacaacatggctgggtcctgggcagatggggggtggtgtgcacaggtcactgggtgccaccggatgggcgggcacatcacctatcctccctcagttggctccttcactaagtgcctgagcaggaaatttctaccctggcatggaatgcccacaccaggatctcagcattcccaccccacccatgtaggaaggaatccagctattctagcaggatttaactttatataaatcagctccaatgagttgatatgtttaataacaaagcaaacattcacaactctattttactcctttttttgttgttgttgccattattatgattactatgatgaatttggctttgatttttattcttttaagtaagaaagtggcagcaaaaaggaaaaaaaaattccaggaattgacttgtgtctctctaatgaaacaggcagttctggctgggtgaggtgtctcacatctgtaatctcagcacttttaggagaccaaagtaggaggatcacttaagcccaggagttcaagaccagcctgggcaacatagcgagaccccatctctacaaaaaaaaaaaaaagaaagaaagaaagaaaattagccaggtgtggtttcagacacctgtggtcccagctacttgggaaactgaggagggaggatcacttgaacccagaaggttgaggctgcatgagccatggtcatgccattgcactccagcctgggtaacagagtgagacactgtctctaaaaaagataaataaataaataatttttttttaaagaacaagggacttatttccttatcagccccgcaatgccccttttagcatccagaaatagatccacctggtcttccctggaagattctggacttccctggaagactcctggatggttttaactcaaacatagccctctggattaagctcacaattgaaactaatatttccctgcctgccaagctaaaatttttccctggagcattaataattagctcaaaatcaaggacaaaattagtagagcaacacataaggtgtttctcccccttcctaacatcagccagtctttttagccacaaactacaagctagtctttctgaaatccagcaagcccctgagtcaaactatggtgtaaagaaagtgggtggaaagtcacattagtcagggacattaagtgccatctgccatggctttaatcccatagtacaatctgaagactctttcttaggacaccctgggaagcagcataacaagaatatttactgtcctgtctcttgaatcggtgaagttaaattcattactttttatacagaaaggtcttcaaaatatttctgttctcctggtctgatctttcctcttctttcatcaatcaaagtcaaaagaaaagttggctaataatatcttagtttggtccttcccccaagaagcagaccctgagacaaggattcaaatataagtagtttatttcagaagtgatcccaggaaacactgctagggagtagagaaaggagacaaagaaggaaaggtggccaataataaaaaggtcattatcaagcaagttaccattcgatcacaacccaactgggaacttggagatgcagtgtaaaatgttcatctcaaaagtaggcgacctgagatgcaagagagctggagaatttatactacagcagcagtcactggctatgggttgctgggcgctgacacttcctgccagccctgagtgtgaactttccagccagagaatgccctcaggcaaaggcatgccggtgtgggcagctggaagtcccagtgcaccagaagtactgacagcagggagtggggtcaatagcagcctctgctacagctaggattggggttatctccaaaagggtacttaaaccaggtctggtgcagtggctcaagcctgtaatcccagcaccttgagaggctaaggtggatggatcacttgaggtcaggagtttgagaccagcctggccaacatggtgaaaccccgtttctactaaaaatataaaaattcgccaggcatggtggcaggcacctgtaatcccagctactcgggaggctgaggcaggagaatcccttgaacccgtgaggtgaaggttgcattgagccaagatcatgccactgcactccagcctgggtgaccaagtgagacacaaagaaaggaagaaaggaagaaggaaagaaaagaaaggaaagagagaaaagagaggaaaggaaaaaagaaggaaggaaggaaggggggaggggaggggaggggagggaagggaagggaagggaagggaagggaagggaagggaagggaagggaagggaagggaaaaaagaaaagaaaagagaaataaaagggtactgaaaccagaggcaatcatttctgttacaggacatatatcactgaatacaaagttgaattcttttccacaaaattatccttatattcaaattttggaaggtttcatattatgcagcaacactgggaaaaacacaataatccaaaaggatctcaatcaatgttctactcagaggctgttaaacatcaagcgatgaaatgtaatacaggcttagctactgagggatgaatttcaactttaactgttgaatggcagagtaactaaaaaagaaaaaaaaaaaaaacgatgcgtagacaaaggtttttaccagaatcttcaaatgtggcaatgcaaataaaaaaaatataatagatgctcatcatggctagtaattacagaaattgaagacaaaacagtattttgggtactcacaattcaatactggctgggcctcagagatactggcatatttgtataaactgatgacgttaaacgtgttacagtcctctgaagggcgtatcagaaaccctaaaactaacctctcatcccataaattctatttctgggaatttatcagaaatgaatacctgaaatgaaggatggtgccaacaacaataataatagtagcaagtatttacactgcactcatcagatcagtgccaggctgttctactgacttatatcaggggttctcagctgggagtggttttgcccctgcaagacacctggcaatgtctggagacatttttgtttgtcaccactggggaaaagcggccaggtatgctgtccagcatccccaaagcacaggacagcttccacagcaaaatggaactgtctcacggtggacaaacctgccttatatctatcccctcatataatccttacaacagccctggagtacttgtattatctccattttacagatcaataaagataattttcgctgtactattatccataatgttgaaactagaagtaaactaaaaacaaaaacaggaaaaccattaaataaatgatggtataactacctaacagaaaaaaatggaaaatgcttatgaagtaatgtcaaacgaaaacaccagaactaaaattagaaatattacataattccaattatttttaagtatgagtataaagactagatgggaaaataacaaatgaaagttactgttgtattaatatggtagaaatagaaatggatgcttctttcttttctaatttttaaaatgttattgcaatttttaaaagaaaaagcactcaacaatgaagataagaatactggaatcttcttctgaggagactgaagtgggaggatcacttgagcccaggagttcaaggccttcctgggtaacatagtgagacccccatctcaaaaaactaaagaaagaaagaatactggaatgttttttaaacaacacaagagttaatagaatatgaagaagatggttaatattaagaaattaggaataaaaatttccatgggaccccaccaaatgttggtgctttaaattctgaagccataactgtttcacgtaaggctaaaaaatctaaatgttgtatctacctccttctgtattttacttatttcatggctcactatcacctatagcaaataggcaaaaagaatcaaatttcaattcagctaaacctgattcattttagcagctccattatacaaagtgtgtgtgtatgtatgtgtgtgtgtatacacactgttatggtatttcaactgttaagataatttagactgtcacatagttttaatatatatggtaatttaaactgttattctaaatttatcaaaagtagcagtcatattaggagtagtaacattattgctgttactatgagcaacatttactgaacgtttcttaaatggactaccatatagtctaatacccacaatatccatataagatagatgcttctattgtccacatttttcagcaaagagcacagacatttaaagttaagcagtttgcccaggtaaaagtagctgaatccaaattcaggcagtctggctccaaagctcaagtgcttgaatcaaactagtgtataagaatggttggggacaagatggcggggagggagccacaggctcctacccttcctctccctacagcaaggaattgactatctctgttctaccagatgtaaaacctggcttttgatataagtttactaagttgagtagacttcacaataattttaccagcagcatcttatttgaaataaaaataacaattattattaccaaccaatatcagcaaataaatgtttcccaaaaacacctacgtggattcaaaggaggaaaaaaaataaggctgtcagagtttctgcaggaagtactaagatcagtgattctaaagtggggggatttttatctgatcctcatatcccactgactattccgttcttgtagacttgaggatgaaaaaacaaaatcttcatcctgttaataggaaaatggataccatagaatcagtaacagaaggagtgtttacacaatgtaagcatctgtttctagaacaccgaagaggaaaggataggaagactacaaataaaacactatttgtggatattaaattgttgggcttcaatgtctctaagtctagtctcacctgcccagagcatatattatgaaatgaagtcactgaaaacaaaatgctgtgatcttctgagattcctgaagcacagcttaacttaacaaataacagggatcagaatactaataacatatcatcgtgcggaaatgaggggaatttggtatgagccaaagtacaggctcctacccttgctgagccactatcaactaaaagcaggctatgggtgggtgtgaggaagtctggaagaacaagtggtctacaaattccacacccatgtgctccaacagtctcaaacctttctcgaggctgcagtgtcaggaacatggcaggtgagggcaagtaaaaaaggctgaaaatctccctcaaaaatagaacttacatttcttcctacaacaggctatgggtctccaacaaattctgagtaaatcttacaaaaaaatgtaactttattttttatgcatgtggtgatttaactataaagaaatcctaatatgtcttgataaacagtatgtgtgtgtgtatatatacacacacatatgtatatatacacacacatacacacacacacatatatttatttatttattcatattttagacggagtcttgctctgtcgcccaagacagaatgcagtggtgcaatctcagctcactgcagcctccgcctctgcctccacctcccagattcaagtgattctcctgcctcagcctcccaagtagctgggattacaggcattcgccaccacacccaactaatttttgtaattttagtacaaatggggtttcaccatgttagccaggctagtctcgaactcctgacctcaagtgatccacccacctaaacgtcccaaagtgctggggctaagcagtgtatgtttaaaagttatcagaaataacaaatgaaagataccaacaacaataataatagtgaatatttagaaagcagttactagagcagtgccagcctgttctaactgctttatatcaggagttctcaaccagaagtgattttgccacctacgagacatctggcaatatctggagacatttttaggacattttagacattaatagaaatgtgtcagttaataggactgacacattcaccagccagcatcccttctgattacttgaacagcagtctgggtggttgaggcctatgccaacctgttaaatattttgaatagcacctctgcctgaatataccataaataattaaaacaaatatcatatctaacaaaacctgagatgtcgataagtaatgattgtcattcatatggagtactacagatagattaaatgaatgttagcctttgaaagtaaccttcccccttttgaggttccagaaggctaatgacaactgaaaaacctgtttcagaatcattctcacaagaattggtctacttgctttgtggatatattcccaactatgactacatataagaattcaaaagttttaattcttaaaatcaaagaattcaaattttaaaatatttctaattcaaaatttggtatgttctaaatattatttcatctataaatttataaatcttcaacaataactcttaaagcctttaataataacaatcctgatatcagttcactaagtgtgatcaacgtaacatagtaatgtaagatgttaacagtggggaaaactgggtaacaagatgttaacagtggggaaaactgggtaacagtggcaaaaagtggtaactggggaactttacataccatctttgcaacttttctataaatgtaaaattattctaaaataaaaggcttatttcaaaacggcaaaaatataaataataaagatacagtttattttcttgggcaagaaaataaaaaagctatttttgtatatccatattaaattttaggtttcacataatgttgatttacaaaacaataagaaaaaatgggccaggcatggtggctaacgcctatagtcccagcactttgggaagcagaggcaggtatatcacttgagcccaggagttcaagaccaacctgagaagcatagggagtccccatctctaccaaaaatacaaaaactagtgggacatggtggtgcatgcctttagtccctgctactctggaggctgaggtaggaggatcccttgagcccaggttgcagtgagccgagattggaccactacactccagccaaggtgacagagactctgtctcaaaaaaaagaaagaaatgaaaaatgttcgaaaatccttcaagcggcttttgatcacattgctggatttggattccataggcatacctgctttccacacattttttaacaggaattatatctcattcaccgaacaacaacaaaaaaattaccagaattctacctcattcactgaactacaacaaaaaatctgagcaactaaaaaacgtgccaggagctagggaaggtttaaagattcaaagacaagaacaggactttcttcaggctcatggtctaaaggagaggttctcaaacatacacaatgaccacctgaagagattattaaaagataagttccacctatctttcaacaccgtgcagagatagacctcgttttcaaaaacactgatgggtaacatccatcatgaatgttgtgacagatgaagacatcttagaatctctgaatttaatccaagcagggaaggagaaagcagagaagaggggcacccaacccacacttggaagtcagcagagaattcctagagaaggtgtccttgaccgaccataggagtgaatggctgatgatctaagggcagcatgaaccatgaggacaggcccggcatccagcagagaactgctcaataccaagaacatttaccctgcttctgaaagtcactggacactggctccaaagtaccaattagagcactggaaactgcctaactcgggccactacccagccagagaaaggggctttgttttaatccagttgggtccaacaaaatatgaaaacaggattctagaacgtggttggatgctgcagcacagaaaaccagactacctgccttaacttgcattgtcctttcggtggaagaactttttcacttgctaattatttctccaatgttagtctacttgagtagcaaaatacagcttcctactgacgcagggggcagagctttgagacttttttgttctgccctttattttttcatctcctctgcaatcagcctgtcaacaagcatatcgttattgtcagggtgtcagtttatagcagcattcacacccactgcctttctcatttactgctttagatctagaaaccgatacccaagtgtgaaaacagttgcaaaatgagaatctaaggctcttcactgatgtgcctgcactgcacaggtgaggacacaagtgtccatcatcatctctgcaaggcatatgcagtggttctaggctgccagtaagtagaatccttaagtttaaaaccaactttaaaacatcccagcaccttcacaacaacgaccgcagcacccagcaaaccacagttgctcaataaatgttcactgagtcatttatttttggctccttggtttttttgtttttgtttttgtgtgtgtttgtttgtttgttttagacagtctcgctctgttgcccaggctggagtttaatggcagtatctcagctcattgcaacctccgactcccaggttcaagcgattctcgtccctcagcctcccaagtagttgagattacaggcactcaccaccacacccagctaatttttgtatttttagtagagacagggttttgccatgttggccaggctggttactgttttcttatttctaattcctagtcatgtgtggcatagttgaagctgacagaaacatgagcactgcagtaattaggaaacataaatagccaggcacagtggctcacgcctgttatcccagcactttgggaggccaaggcagaaggattacttgggcccagaagttcaagaccctaacctgggaatagtgagaccttgtttctatttaaaaaaaaaaaaaaaaatcagaagggccgggcacgttggttcacgcctaaaatcccagcactttgggaggcagaggcaggtggaccacaaggtcaggagatcaagacgttcctggctaacacggtgaaaccccatctctactaaaaatacaaaaaattagccaggcatggtagcatgcgcctgtagtcccagctactcgggaggctgaggtaagggaatcgcttgaacctgggaaggggaggttgcagtgagctgagatcgcaccactgcactccagcctgggcaacagagcgagactcttacccaaataaaaaaaaaatccgaaaaatgagctgagcgtggtggcacatgcctgtaatcccagctactcaggaggctgaggtgggaggactgcttgacccccggagatcgaggctacagtgaacctagctcatgccattacactctagcttggttgacagagcaagaccctgtctcaaagaaaaaaagaaaaagaagaagaagaaacataaatagatgagaaaatttagaaaactactggaaaatcaatgctgacagtcttcctaacacaaacccaatatgataaaaatgattcattataaaacaccaggcaaatattatttactgaataacttcccaaattatgggaaataaatgtcaatactttatttcagtaatcaagacatagatttaccttgaacgaccttttatttttatttagatttgattactcagaaatgttgcagcgtaaggcctagtaacaaattcagcaaatatacagaatgcaatctcaaggactttttaaaagaatagtgcacacttcacttagtcaccaaataaattttcatcataaaacataagattctccttgcaacagcaggagaaatgcataggagggaggcagacagatatgacatgtcccgtgggacatgaaaagggaaatgagaactattgcctcaaccaacttgcaaaatgtccataacctccctctttaaataccatcactatgaaatttttaatgcatataagcaaagtgagaatttaataattattttaaagaattcacatgggcaaaggtaaaatataataattcatttcaaggtgtttatttctcctctatccccaaaagtcccttaaaccacattcgtacacacacaaaaaagattctacttttcctgctataacactcgttactcagagttagataataaatactgattaacaatcagtgggtctcagagtattggcagatgctagattgcatgggtgggttagagttacctcagtagaaagtgaatttgctaggggaataaatttcttctgtcaaacacagtctaggagctactaacaccagaaagagagtaatggccaatgagtccaaggagaagctaaaggcacagaatccagaagtcaacaagaaaataggccagggcagaagccaagtgactaactctggcagcaggttcccagcaagagactggctgagccaggagaaaagtagcagtgtcggtgtgataggagttgcttctcagagtgccaagtggatcgctatctgatgaggtatttctactggcgatatgtgcaagtgacctggaagaatctgtgcaaggtgcctatcttacaagtgccacacagcccagcctttcagagtatttggatcagcggcattcaactgaaatctatcacgtttccagactactatgacagttcacctctatttggagaaataacctctctgcagactaaataaagctttttatataaggcatcaaaggcaaagagcacagaatcataggggaggcggctgcgtgcccttttcctttgcttgcctgcttgcttgcaagcaatgaaaacctttctgaacaaatgatagcaaactttgaaaacagcaaaacatctggggcatcttgccacaaagatatcctccacacaactgcaggccatttgctgtcctgtatagctctctatttcctgccatttactggatctgtggttaaatgaacccaacatagaattacagcttcaatgctttgatgtgaaaaatcactaacgaatctaaattgaaggacgaggacacactggtaaattttcaatatgatggtgcatacggggcctcatttaaactaatgtcttatcttcacttagcatctaaatgtattttttcctgtactgacttgaaatactctaacacaaacagacaccatttattataatccttcttgcaatctgtcaagttatgttcaaaaaattttacaaagatgtacctttaaagactgacaacagccccaaaacaggaggcagaatagttagggcttaattttaagcctaactccacagcatctttctgctaactccatgttccataaaatatataaaaaatggtttttttcataaataaatctgggacttaccatccatatggaaataatttatcagtatacgaaaatgtaataaaatagtgtatctaaataactactagtctcagcacagtttgggatgatgacgtcttccatatcagccaaaaaaagaaagaaaatactatagaatctaagtccaaagactcaaacctctgtcctagatatctgaaaataatatctatcttttaaggtagcagttaaccattttagaactcaaaagaaattcaaataagtcctcccaaatctgccattttgtaggaatttcccttggaatcattaagagtataaaagtcagggatccaagcaacaaaagaaaatgagcaatgcatgaaaagccaaatcactgacgaatttgtccaaagagccaataaacatatgcagagaagttcagttccacaaaaaaagaaatgcaagttcaaacaactatagactacatttcatctctctacatgtcatctgttgtagatgacgatttaacagtaaaagcatatttgccccagcaattgcccaagtaagcgaagatacatgtacacaggtagtttttaataatgttttaagtgggatgccactaaatcaggatggtttcaattttggttcaaaaaagaaaagccatgctcacccatagaggcatacatttttacattcatagaaaacaagggtagcagaagaaacgaaactattaacaatggttttggagagaggaaggaaatgacagttttctactttgtagaattttcattttgcattacattttttttttttttagaaaacagtctgattacttaagatattttaaaggacatttgaactatattactaaaaattaaatttggagtcaaaaacgtatttaaatgctccttttccttgagagcaactccacacagagggccacaggaattcctgcccagctcacaatctaagtttcaatactctgcagctcagacagaaagtttggcctgtgttcctttagtcctagactaaaatttcactttagcacaatggtagaacctggctatgagtcatcttcctctgcaaaacaatgaaaggtctagttcagtgggaaaaaacgacttcagttgccagttcattgaactgttcaaattaaggtcaaaatactggagcaggagcgagggagtcgctgtgtccagatcctatctaaccccacaccagtcccctgaatggccctccaaccaagtcttgaatttgcaaacggttagaataggaagcacctggtgccctctaagtaggggtcagagaacgcaagtgaaaacatgaaacagatccaaatccagtttcatgagcatgcctttcaagtaatgccaaggaaaaatatatcaaaaacatgatggagtgcacagcttcagcttaaatatatttcaagtaccatgatgaatataatgtttgatttcctaccctagactctacctaaaagagcccattatcaacagactaggtttttataatttttacagaatttattattccatttatttacctggaactattactatagcttgcaaagaactttaaaatgtgtaacatcatgaatcctgaccacactctcccggggcatcctccctggttgggagatcctgtgatcctcctggttgggagtccccttctcagaggttcagtgacttaccctgacgatggcaggggtaatggaaacccagatcttgagggccaagtctcatcccttaaagaactgctcagggccaggcgccgtggctcatgcctgtaatcccagcactttgggaggctgaggcgggcggatcacgaggtcaggagatccagaccatcctggctaacacggggaaaccccgtctctactaaaaatacaaaaaattagccgggcgtgatggcgggcgcctgtagtcccagctactcggaaggctgaggcaggagaatggcgtgaacccgggaggaggagcttgcagtgagccgagatcccatcacgcgctccagcctgggcgacagagcgagactccgtctcaaaacaaaaaaaaaagaactgctcagtaccatgttaatcccatttctcattttctccacccaagattcttttcttttgtttttgtttttttttgagatggagtttcgctcttgttgcccaggctagagtgcaatggcgcaacctctgctcaccacaacctctgcctcctaggttcaagcaattctcctgcctcagcctccctagtagctgggtttacaggcatgcgccactaggcccggctcattttgtatttttaatagagacagggtttctccatgttggtcaggctggtcttgaactcccgacttcaggtgatctgcccgcctcggcctcccaaagtgctgggattacaggcatgagccaccgcaccggccgattcttttctttcacatgtcgctctttctactctttttctcccaacttaacaattctcattctctcacctctgtaagttatagttacctggtcttcctaaccacctactcattttctctataattattaagatctgcaaaaaattcacgagtcctaagatatcttcccagacaaatctcactgccctgtgatcactccaaattctgtgttcctttatttggatatagtcaactggtgggtctggcaatccctaacatatgacaaagatgacaacgttccttcctttcagccaccagcaaacctagcattcacttcacacaccatcctttccaggtcctaacctccacgggggaagaatcaaatcaccttcatttttatatccccatacctccccagagctgggcgtgtgctaggtacctagcaaatgctgactgaatagatgagtgtggtcgtcaacctcctggagttccaacacaaaagacttgagctcctttaagagtgagtcacggctgggcatggtggctcaggcctgtaatcccagcattttgggaggccaagagggaggatcactcgagctcaggagttcaagaccagcctgggcaacatagtgagatcccatctctacagaaaaactattaaaaattagccaggtatgggagcacatacctatagtcccagctactcaggagactgaggtgggaggatcacttgagcctgggaggtcaaggctacagtgagctaagactgtgtcactgcactccaggctgggcaacacagcgagacttagtctcaaaaaaaaaaacaaaaaaaaaaaacaaagaataagccacagttcaggagattctcccaggagtgtccccatctggcctcacatccacattcacacacacacactcagcccctgatgaaattctctttcccaaagttctcaacctgccttgcctcataaggacaccactgccctggagccttgtctcttctgagaggtctgttcagcattcccccagatcagccacctgttcccctgtgaccttttcctggagtgtcttccaagatgacagccactgttcagcctaacatagcacactctcctacatcagcaaagaccataactaagcctctgtccaatcttcttccaacttcctgttactcaaaggaactaattcattcattcattccacaagcagctactgagcctcttctgcacatcaggcacacattcaggtgctaggaggcagcagtaacaaagctgcctctactccctcccatggagctttcagtctagtgggggacgaatacattcccctgtaccctccacattggacacccttggctggcttttgacaagctacagagcagggcctcagtccaatcaagtcacgatctctgactgtggggcacaagcatgttggtgattctaatgggggacccaagtagtgaatcttttaacccttccatctaaaaaggaaacagctgacatagagtcctgtcagcaggcaagaaagcaggaaggatggcaaaacgagcagggctcccaggagtggtttcctgagcagtggcaatttccagacatgagtcatctgggccttcatagatgcctaaatggccagtcccgcctccaaattattcatttcacattttcaagcttgttttgaaactttggtttatctcagttatattattgttagcatctagtgaaaatgatgatacagctggataaagatagagatcgatagatagatagatgatagatagatagatagatagatagatagatgatacatagatagacagagagatagtgatagagatagagatctattttttttttaaacagagtctcgccctgatgcccgggctgaagtgcagtggcgcaatctcagctcactgcaacccccgcctcccgggttcaagcgattctcttgcctcagcctcccaagtagctgggatttcaggcacccaccaccacacccagctaatttttgtatttttagtagagacgatgtttcaccacattggccaggctcctggcctgaactcctgacctcaggtgatctgcccgcctcgggctcccaaagtgctgggattacaagcatgagccattgtgcctggctgaaaatattatttttaacattaaatttaatgtccttatttctaacaagatgactaaagagcctacactatggacacacacaaaaaaatcagttcaatagcaactgatgagaggagaatctaggcccttgtgaaattggaaatcatgtacacattggttttctatttttattaaaataacatgcactgaaatacattttaattttaaaaatgctattttcctaaagccttttgattggtcatagggcaggaaagaatgttatctaaatgaaccagaactcaaccagcacagcatttaaatatatttaacactgtagctactcatttaaaagcctgcttttttattttattttttttttttttgagacagagttttgctctttcacccaggctggagtgcaatggtgtgatcttggctcactgcaacctccacctcccaggttcaagtgattctcctgcctcagcctcccaagtagctgggattacaggcacgtgccaccacgcccgactaatttttgtatttttagtagagacaaggttttaccatgttggccaggctggtctagaactcctgacctcaggtgatccgcctgccttggcctcctaaagtgctgggattacaggcgtgagccaccgcccccggccaaagcctgcttattatttaaaggtttgtttgtacttttcttctagctgtcttctgatttcaatcattaaggttaccctagaccctttgtagcaagaccctttgatgaagactagctgaccacagagactcttaatggtggggaaagagagaggatttagtgacaatcaaaggaaatcttcgaaaggccacaagcctgcaattgctgcccctatgcaggtttttgagacaaggtatccctctgttgtccaaactggaatgcagcggcatgatcgtggctcactagtctcaaactcctaggttcaagctatcctcccacctcagtctcctaagtagctgggaccacaggcacatgccaccatgcctggctgatttttaaattttttgtagagatggaatctccctgtgttgcccagagtggtctcgaactccaggcctcaagtgatcctcatgccgcagcctcccaaagtgcttggattacaggtatgagccattgtgcctggcccgcgtggagttttaattcaggtccctgagaggtattttgatgttgtgttgggatcacatggttatttaagaaagaagtaacagttaatgatgagaattgtagcacaccagtctcctatgccacttgttcaagaaacccaattcactaagaaaatatgggctgctccaatcattttggtttgaatttgctctgcagagacaacgctacaaccccttaccacctcattcactgaagctaagaaggaaaacattaagagggaaagagtaattccacaagaaaggaaaacattgaaaaagaaaaccaaccagtctcaaagttttttcatagtgacaacattcatgcatgatatgtatgatcgaataaaacacatcacttggggtttttcccctccaaaagctcatacaaccagtacacacatgtatacattaaacaagatatgaacatctaaactgatcagaaaaactaagtcaccccggaagtaaacttcagcgagagaaaagtgcacgacactttccctgcatgaagttatgcatatgcatgtctcatagacaagcctgcactgaaacagaaaccccagcactcatactgtcccccaaagtacaaacgttttattctcccctttctcaggtcaaaactaaatatttcaagaagtaaaatgcctttttagccaacagagtaaatcaaatacaatatgggatgaggtctaccaatactcaacaccacaaaggaggcttcttctctagatggcagtaaacagcacagagtaagctattttgaaaatacagggaggtaaagtgaagcatatttgctaccacaaatatagggatcctggaaggcttcttccaaagaaactaataactctggtgaattatcacttcctgaagagaagtgtgaagcagacagcgttggtctctactcttgagggtccacaacagacgtggcagcaggaaagacaggctgtctgttcccgtcaccagcctggtcctaagctttgttacttaacaaaactgaatgaaagaaccctgtcttcatagacgtttcttaagaaaacctcactggctgggagtcgtgcaagttgacaaacttacctggtaatcgcttgcaagcctggagagctacatgccctggcaaatccaatctgcactttttccaatgaaacgtggtggctgccaggccgctcatcacctacatctgcttagatgatgaggaaaaagatgtggaggaagtggacaacaaaagcagccttcgaactgcacactgggatgtcctgtgttattttgggttttttttttttttttttttggtggcttttatttttcccatgagaggatctgactaaacctaaccccacctcctctaaacaccagagaggaagttacactttgtagtcagtgaaaactccttaggcaggttttttgtttttttaatagtcacaactaagggcctctattcatgttcctatgacagagattataactttgcttcctgttttgacagtatcagctgggaaggggcactccacccacctccctacccactgcgtagataaataaagatgttagaaggcgtttgccctgggtatacaactggccttaggagtttcgttacatattaactatacttcaaagaataaattggacttattatttcactatagtagttatacacaccttggggaagtaaaactgaaaaggatttcttcttcatcccttagaattcgctactagggaaaaaataaacttaaccatatgcagctataagagaagaggccaccatttagacaaatttttccagcctattctcttttgtggtcaccttgctctctttattatcattatttttttttcactcgtcacccaggctggagtgcaatggcatgatctcagctcactgcaacctccgcctcctgggttcaagtcattcttgtgcctcagcctcccaagtagctgggattacaggtgcccaccaccatgcccggctattgtgtgtgtgtgtgtgtgtgtgtgtgtgtgtgtgtgtgtgtgtgtgtttagtagagacgggatttcaccatgttggtcaggctggtctcgaactcctgctgtcacttctgcatgtgtccaccacatacatgcaaaaagcaaggaaaatcattattcatatgatcacatctactttctagtccttctctcattctttttcttgcttgttgtgaaatagaaatcttctacttattagcaaagacttttcatagaatatgtatctttgtcaggatacacacaggtttgaattcaaaggtgtctctcatcctgctactgtactatgatacagaaaagagaaactaacagtacctcccctatgctcctcctcctcatctctgcattttccttagactagtagctgtatgactctggcaaaatactctctctctctctctaagcctcagtctccaaatctgtaaaatggacgggctgacttcacctgtcttctaggactgtcacagggagggagaccgggaaaagcacagtgatacagatgatgtcccatagtcaatacccattgatctttttttgcatcaaactttattgatatataattcatatattatacaattagctcatttacactgtataatttaatgatttttagtattgtcaaagaattctacaaccatcaccacaatcgacccccatcccttagcccaaggcaaccactaaaatctacttccagtctctatagagttacctattctgtacatttcatataaaagaaatcatacagtatatggttttttgtgactagcttatttcacttagcataatgcttttgaagtccatgcatgttgtattatgtatgggtatttcatttatttttaaaatattccattgtattgatagaccatattttattatgtatttatcagttcatgaacatttgggttgtttttatctttcagctaatatcaataattctgctatgagcatttgtgtacacgtttttgatgtgggcatacattttcatgtctcttgggtgtggcgggtgtgtgtgtgtgtgtgtgtgtgtgtgtgtgtatgtgtgtacccagaagtagaattgctgagtcatatggcaaccctatgcttaacctttggaagaactgccagacagctttccaaagttgcatccttttacattcccactagcagtgtatgtggatacccatttctccacatcctcaccaatatttgttattatttgtcttttttattattgccatcctgctgggtatgaagtgacatttcactgtggtttgatttgcatttccttaatggctatcgaaacccatcttttatccatagcccaaaaatgtcatttctagaatcaggactaaatattcaaaatacagaacagccagtgaggcgtgggcaccacctagtcagaacggatactggctacaatgctgaagtgaggtcctgaaggtgtccatctttaacagtggctattttccaataggaatcaaagactttcaacattgttcctggtacagctgtatgggttcataccagctaaatattgctggccttcatacttctatctatagtaagaggctgtgaaagaagttggccctgcttcctctaccaaagggttcttctgaaaactggtaaggaaatgaaattctgaatgtaaatatgacatttcaatctttacaaatcagttctttccacctgtctttatgtgtcttcctctgaaatagaaacaggcacaataaaagcagccttttgtcagtaaatagtcataactgtttataggaagaattgttagaccagatgtgatttaagattaaggatctcaaattttgaaggtagccaaggaagacaagttaaaatttagacactagcaacaatttctccttccctctcaaaagtgcagtactgggagaatagtaattattcaaacaaatcaacatcaaagagatctttttttttcagaccttactgtgtttgagcaaattcatgtacaatgatgttaattacctttttcctaaaacattctatcttaggatttattttttgatccccccaaaactaaacagaacaaaaactatacaaagtacaacaaagaaaatatcagaaggctattaactttaaaaaataaaaacttttttccttattttttgatgtaaggccttgggccttgcaacatgtattaataatatgactcatccatcttctaaaaaatttcccatgtcccaaggctatactctgtaatccattgtcttatttatttcttgccgtggagctgactatgaaattgaccgttgaactttcatatgtcaaatagaactttccatagtgggaaacttctaaaacattcatattaagctaagtggaaatatcatgatagctcaggagcaaacaaggtctgtaacagccaatataacttccaaactagattctatgtaggaaaagcaaaccattgaacacacacaagtgcaaaggcttcattgaagtttctgtaaacacttgatggtgaggaaaatcagaagctaaaatcagtttatctgaagattcttctaaaaagatcaataggggggcgcttttgaaaactgttgtgcaatgtcaggacccactctattcacagatccattcttctgctagattacacggtggcctcattttctagttcttgtgaaatcaatagaccatttatgttgcaagtatctgtctagggtatgcgctttcttattcaatctagtgttgacagcagtaatcaaattttgttcataccactagctctattatagctcaatagcaactggctgccagcctaggtctactctcatcaaaaaaggaaagaaagaattggagtggagagagaattacagaacaaattagctgaaactacaggaggtaatgttgaagttagagagggaagcaaaggaattcagaaactaatcctctctccacggaggaaatatacacccagcagcatcagccccacaaaatccaggcaagctgaccttggccatgaagggtacacatcttcttcattcttccctgttatctgtaaaccttcttggctttgaacatcatattataactgtcagtcctaactaatacaactatacctcgccctgcagagctaccaacaagaactagagccaaaccacaccctccaacaccagggagactaaatgcaaaggacaagttatggcacttcccatgagctctccattttataactcttctttttttttctcttgagacgcagtcgcagtcttgttatgtcgcccaggctggagtgcagtggtgtgatctcagctcactgcaacctccgcctcccagattccagcaattcacctgccacagcctcccgagtagctgggattatgggtgggcaccaccatgcccggctaatttttatatttctagtagagacggctttcaccttgttggtcaggctggtctcaaactcctgacctcaagcgatctgtccaccttggcctcccaaagtcctgggattataggcgtgagccaccacgcctggcctagaactcttctttatatgattacgctacagtcaagcatttttctcagatcagaatataaaaagataatcttacaatagaaaccaggtcagcttttttaaaaagaaaaaattgggagggggtgaaggcctgactgaaattctactcgatttgcacttctagactttgaattctcctagaaaactagacttctgctcatagatactctctacctaaaagcatcatgaatgatactgttccctgatatgacaaacacctctttttcttatttttcaaagttttatcttgaaataattttagacttataaaagaagtggttaaaaaaaaaagaaaagagtacacagagttctcatgttcccttcatccaacttcctcaaatattaccatcttacataaccagagtacaatgatgaaaaccagacaattcacatagatgcaaatctatgaactaatctataggtctttttcaaatttctgcaattgccccctttttctggtctacaattcaatccaagatcacatacaagcaatacttcaaaaattcaagatgcatccttttcaatgaatcatgcctatctaatgaatatttctgacccctcctaaagttctacttcccttcagtgttaatgaggcagtgtcatcattaacttttgagtctttccagaaatgttcttttcttccatagatcttgcctccatttcttatcagtcagtttcatcaaccttatcctgtaaacacatgtcaaagagtttcacaacctcttttccaaaaccctagggccagaggtgctgctgaaccagaactcttcccatttgagaaaagttatatagcacaagtcatatattacagtgaaaacaaaaaacagcaagatccagggcaatttcccctaatcaaacacattaatagccctgcagtaaatacatatgtttatgaaggatgcctgacatacataaggactttaaaagagtcccagctgttcaagtcaggcttcaacaccaaatgagttcaggtcaaactcaagttttcttgccaaatgaactacaaataaaacaccttctggttttcggaggtcttcttcaatagtgtagctacagatgaaggatgatgaatctgtacctacgaaatccacagtttcatccatctcccgcccaccctcaccacatcttctacctggtctcctggcagagccacctgcaatgttccctgggcctctaggggctcttctctccaaatcactctcctacagagcccagagtgatctttctattaacctgcacctgcccagcttcaaaatccttaaaggtttcccatgcgaggatggagtctcgtctgcttcatgcagttcacacagctccctacaatcagaactaagtcccatgactatactgatcaactacacggcacccaagaagaatgcaaaaatgaaaaaggcatcaactgtcctcaagagtctcacaatctaattaactccccttaatatcttcatcagagtaatattgtttagaatacaacttatccaataatcaaagagcatgtcgggttttttttttaacccatttgtgtccagctaggaaattctacctcagttcttgatcacagcaatgattataaacaaaactcttcatgttgacattaaaagaattttcacatgattttaaaagcacatgtctaaaaatactcattatgcgactgttggtatggttcaaaaaattataaaaagcaaaagccaataaaaactgttttaaaaacaagcaaacccaaaaaagtaatgtcaaggatggtacttcatgggctgagtgatttctcatgaaattgtttttccaaagcatgaagatataaataaaatctgaaatcatgcctttgtttccatatgagtatactaatgggattgaatgacattataatcaacagaattaagtcagagagagttaaatcgaagccgccatcatcaaagagcttagaaaatattccaggctgggcgcaatggctcatgcctataatcccagcactttaggaagctgaggcgggtggatcacctgaggtcaggagttcgagaccagcctggccaacatggtaagactccatctctactaaaactacaaaaattagccaggcgtggtggcgtgtgcctgtaatcccagctattcaggagggtgaggcatgggaatcacttgaaccagggaggcagaggttgcagtgggctgagatcacaccactgcactctagcctgggagacagagcaagactccatctcaaaataataataataataacaataaagtattccaaaccacacggagccagacctcagacatagatcttaaatagctgccaataaaagcagggaaatcatatttaagtattggtttcattttctaatgtggaaacagacaaagacacctacttggaatgatgaattaaaaagaaaactcctagaagttgtatttcaggattaaattataacctttctcaagaaagctgcatgcaagtagtgagattaaaagggagacaataatcgcaccaaagcccttaatgaggaggtaaagagaggtagtaataggggcacacagcttctccctctaccaggagatagaaggagtagatagaaggagtgtgctaagaggggagaattcagggtttcctcccagggtggccctcctctcacatgtgtgtgtgtgtgtgtgtgtgtgtggtgtgtgtgtgtgtgtctgtgtgtgtgtgtctgtgtgtgtgtgtctctgtgtgtgagtctgtgtgtgtgtgtctgtgtgtgttgtgtgtggcagggtttctcactggcagtgttgcttctaaacagaagtggcagctgtctggaacccagtgggtgaggcctccagtggctgacagcgatctgcaggagaacagaaaaacactacatggaagccaagtgatgccaccacttggtagaaacagggtccaatctgccagggccacaggcgcaaccctacatgactggctgcttaaagcagtcatccctgggatggcccttccagcttagaacttctcactgtagtggcaggaatgaaggccaagagttcttcagggaggcaagaattgtcatttaaggcaacagtgaacgaaattgataaaaacaacccaaatacttcaaaaagaaaggaattttaaaatattactttaaaaaaaaaagaaagagggagtaatttttctggactgtctccataatctgtttttataaatcaggtggcaacctgctgggctgtggaacaaaggtcagcaagtgagttttctcgaagcacacttgctgtcatagtaaggaaaatttttctagtttctagtgagctctagaactttcaagcttcatgggaaggtgtgaagaagagacacctagaaattattctttggtgttggcaggaaaaaaaatgtgtccaagtgtcctacagggccaccagcctatgaaccccaatgtggtcttcataatattttgttccttggtcacctacagtcacaatctctacctcagaaaacttgtgccactgcctgtcttctggctggctctccacaggtgagtgtgctgacgtccccaagccctgaaggttgtttactgtcattcagcttgcccgtggcgatgtcggagtctggattgaagttcccaccatatcaggatcaccctccatgaggcaacactttccctacctacaacctgtcttccactggccaccacctgccgcagcccagcagacacacctgtaggcatctcagccctgatcacagcatctgtgtgcttcctcttgcaaatgcccacatgcaaatctgaggatgttggccactcagaagatgtgggtattaacatgtgtgagtcatctgtagatcctgccgcagctggtaccacacaaagatagtcctgtctaaactatgggcacacccacccactctcatgtgtcctatctctacttgggaatgagacataatcatctacttgtgacaacttagagccaagagtgaggagacaatgaagaatataggtgttcattagacagaactgatgctgaggaactgaccagaggtatttcaaatcagctccagggtttccaagatgatataaagacagttccaggatgatattaagaggtggtcaggtaagaactagagaattcaagtcacaattatcacttgagagtttatttatgagccacgagattcagcagtgggttcacagtgccagagttcctggaaagagcatttgagagagccaggcagctgataggtttaagcagtgcctactctgttccatgcagtacagcagtgaaagagccggttcccaggccaggcaaggcaagtgctatagatggagagttgagggacctgccatatcattgcctcaggaatcgggttcaactacggaggcaggtcagagcatgccaaaaaggggaaaggagaagtcagaggctgaggaaacaggtgggagtgagtgctgcagaggcaagacaggcacaaacaacctgttattaaaatgctctacagagttgcaaaggagcgggtggcagatgggaggagggaactcagaaacaatgtcagaaggtacaaaggagaaagggcgatccagaaataagacaagaacaaagctgggctctcttattccaggacagtggtcaacaagccattcctgagtttgcaagtcaggaccacttatgtgccatttcacattaaacttcactttccatgaaatttttctctgccagagaatgtccagtagtaaatctgtctatctataaaagtataaataaattaaacatggcaaagttggttttaaataaggaatgttagactaccgtaactttctggaggttgtcaatgaactatagtactggaactacggatgttcctacttgatcatcaggatataatttggtctgtattcacttttagagatctctgaacttcaaagttcgttcaatttattttcactgatgccttcaaaattcttaaaagttaagttgtgtcaatatttcaactctcacttgaaaaatgaggttattgaggtttcaggacacaaagtaaaacaccaaattcgtgctgtgagtggatttaaacctcagggccagctcccagctattgagccgttccttcagccatagcatgcatcttgcaaagcagctccctggctttcgagagcattgcctgaaccaacatgaagcctagagatgtcaaagttatgtttatgaaagtaaatgatactatgcaatacctcctgtcttcctcagtcatagccaaacagcaaatgaagccaagaggaaatacatgttcctcaatagcagtaaggttccaggtatcaggtggcggcagcagctgctgaaagcctgttccacttcacccctcccctagaaccccaaactcgggcacaaacccacgcctcaaactcttgaggctgcccggattatgagtctttcggcgacagatgacagagtgacgcaacactaccactcccgggggcgctaaaatcatagccttgacggaacaggaaggtggttactcttcacagaagctactaatctgctgcccccaccctgcctcaccacccccaccccccccaaacacacaccggaaagagggaggaggaaaaggaaatgaaagcaagtgactctagggtctggatttcatatgcaagaatagccagcaacaggtgcagcattccggtgaaattaagacactcaaagcaccatttgcctccacagcataaagagcccaggcacagaaacccaacattaggcaatgatgtcagaagtgcaaatcatcatcattctctagccagcagcaattttgtagggaaaaaaataaaagggcatttgtctgttgatacataatttcttttaatttaggagtcctctcttaaaatagtttgaaaataatcttagcatcgatcatcaatgtacttttttaatacctagtgactatcacagtgcctagcacatagtaggtgggtggataaatatttactgaacgaatgaataaaatgagatatttactgaacgaatgaataaaatgagaggtaaacaaaaaattttcttcacaaataaagataaccaaaatctacactagtatataagtgtatctttttccccatttctccaagaacagaacaaaaggttggaatcagtagccaaggacactggcttcatcatgttgttgatgaacacatcaggagatgcaaaccgtccacccctggctgaaactgagaagcccgatctgccaccccttgggtgatctatgcagggaattctcatctgcagaagatccaatgggaaaaacaatcacaatcatttaagcaatccacctttagattttcctttctttcaatgtgccatttcacataacattttttttacctggcattataagagaatttacaagataagtgttgctgtatgatcttcttcaacatgacagaaatcatcaactcataatatgttatggaaaatgtcttatactgtgtgtgacatgctatatgaaaaatctgaatgtgaataagacggtatagaaatgaagctattttatgggctctaaaaactgacagaatcagtagagaacaaagagcaataaaaatgagcccatcaatgggagaaggtctgttatgggaagactgtattgaattaaaaggttaatatcaggctgagctcagtggctcatacctgtaatcccagcactttgggaggccgaggtgggtggatcacctgaggtcaggagttcgagacaggcctggccaacatgacaaaaccccatctctactaaaaatacaaatacgaaaattagccacgtgtggtggtgggagcctgtaatcccagctacttgggagactaaggcaggagaattggctggaatccgggaagtggaggttgcagtgagccaagatcgcaccactgcactccagcctgagtgacagaatgagactccatctcaaataaataaataaataaataaataaataaataaataaataaataaaaggttaatatcagcatgagaacattactgattacgtaagttgaaaggtttcagtaagttaaaaataatgatattaattataagaataaagtgttcaaagcacagataagagtaaatcaccaaaattatcaggttttagagaactgagaatatacataaaaaatagtgtcataaataactttacaaaattactattaaaaacggtttgacttaatgatactctttgttcaatttttttaatctatgaatttttcttgtgtttgtaacttaagtattctgagtaggagttctctcttccctatatattcaatttaaagaatccttagattttttcaagttaacttccaaagatccaaaatactcccactttgttttactttgaggtaatacccaaaggtcttgactagggttcttaatggagatcctaagtggctagttaagaattacctcaaatttcaaagaataaacaggaatagcaagtctattacaaatgcttttgttcttttaagtgactccgccttttcattcattcattcactcattcattcattcacaaggatctatcatccctacagaacaggcaccgtacaaggcactatggacacaatcgtgaacaagacaaccttggtccctgcccatatggagagcacagtcttggggacctatcaacactaaagtaaacaaacaagtgaacaaaagcaatgagcaatggtgacaagtgtggatggtggagacaacagcacaaaatctacttcaggtgggtgtcaggacaggcttctctaagcaggtgcaatttcatccaatgcccaatcccagaaggaggagaaggagatagccaagagctgggggccggtattccaggtggaggaaagaccctgtaaacagaggttgttcccagagctgaaagctgaccagtgtggctggatggggcaatgatggacagtgagcaaggaggtgcattatacatttgaaaatggcatctcaccatatgattcactgaatatttgcctttccaaacactttctcctcagcctggaattcttcccttccacattcctctctaccactttgcaagtcacttctctgggaaacattccttgaccctctgaggaagagcaaaactccgggagtttatccttcctgacctgtggtcccacagcacatagtatgtatcatgagcacacgtcttaccacgctgctgaatcgctgcgtttgaaagcctgcaagcagagatcttgcttgtctgcctcccagcagcctatcacgtaacttggcaccagcagagagaaataaatgacagtgaacgaaccaagagataaatggacaaattaaatggatgcaggggcactaattaactactcaattgttggagatttggaatagcgccaaggttacagctccttaactcatttacagtttaatttctaccccatatgactttcatacaacagacacttttcggtaaatctttttccatcacggagaagtgatggaataactttcatagcgtatcattagacactggacccaatccattcatattcaacaaacacgcattaagtgccaagttctgtgccaggctctgaggctgacagtggtcctatcctagatgatttacaaggttagtaagcaaaataaatcatatttagaaaatgtttttaatgactgaccttgttagattctttacatgtaactatcttatttcatgacattatttagaaaaaacgtcttttaaaaacttcctaggtcacccagaggacaaaataatttagaatctgttaactcagtaattttcacactaattattggcggagagtcatgcctcggcttcctttcaatgaacaggtggacaaaatttaagtagccacattctcaatgagtctttacctgcctgtgactgtctgccgtctccgtttgtggattcagatctcacttccatttctcgtcggctcagcgtgtcctccaaatgtagttaagactcccaaaccaacagtgcatgatttctgaagtcacaaagggatgtgtacccctcggctggagaatgtgctttgatggagtcaaattgaaaaacagggccaaacagtatgggaaccgtggatagatgagttcctccccaactgcccggaccagaatggtcacattcctgcctctgtgaatagcccaatcctggtctgctctgtctgagcctctgccaggtgtggagcctgtcgccttaaaatctgaagacgtgtgacaacacttatctgcctaggaacagcaaggtatgcatttctacaaacaccactgttgaaactgcttggtatacagagaagccaagcacttcctctcttctcaggttttccttagattcaagccaaatagaaatctgagtgaggaaaaatgttaaggaatttagctttagaaaaatttgtttttatgtttctaactcttgcaagagagcttgttctcatcaattttataacctatttttcaacctacatactccagactaattcctaatgcttttagggatccatccattaatgcactaaataatacatgccctcaaactaagaggtaaaccatgccccttcaatcaggataagaaatactactgagtgaaatgcagactgcatctttctgccaattttaatccacagccctctgctcacttcactcccaatcaccggcctcaatcaggctttctgtgggccaagttctgccagcttagagcctgcacacagctctgccttcagccagtgccctccaccaccttgaactatggacttgaatagattcctcaagaaggccttccctgaccactcaaactatcactcattccaggtccctatgaagtccccgagtgatttgccatgacagcactgcagaatgtctaccctctaagcagttaaacaactatttgtatgctctgcaatttgatgtctggttctcgtactagtctacacactcaagaggccagatgccatcatagagctcatcagttttgtcaactacacccagtgcagtgcctgccatatggggcattcacccaagactactttccatttaaaattgttgtctcttttgaaacactctgtggcacactgctgccactgctgaggtttaaggaaacaaatactcattttaagccatcatctttatcaggggttattaccaggcagggggtccatgaacttggacaggaaaagcaattagatcttttcactgacctctaacagaaatttgcatttccttccattgtgatggcagatcacaaaacacattattagtggtagctttgactgtgtcaccagcaaaaatcataaccattttcacatcaccttacaactctagcaggtatcttgaaaataccatttggctcgttgttatttcagaagagtagagaggttagagatgctagaagttcttactgaacacactaatgaaacagcaaatactactctctcacagactttttcagtattttggtaactgtatgcatggaataccatgtactctattttatgcatttaaaaatatttgtcaggctgggtgcggtgcctcatatctgtaatcccagcactttgggaggccgaggcaggcggatcacaaggtcaagagatcgagaccatcctggccaacatggtgaaatcttgtctttactaaaaatacaaaaattagctgggcatgatggcgtgcgcctgtagtcccagctactcgggagtctgaggcaggagaatcgcttgaacccgagaggtagaagttgcagtgagccgagatcgcccccctacactccagcctgggtgacagagtgagactccatctcaaaaaaaaaaaaaaaaggccaggtgcggtggctcacacctgtaatcctagcacttttgcaggccgaggcagggggattacctgaggtcaggacttcaagatcaggctggccaacatggtgtaactccgtctctaccaaaaatacaaaaaattagctgggtacagtggcttgcaactgtaatcccagctacttgggagactgaggcaggaaaatcgcttgaacctgggaggcagaggttgcagggagccaagatcgcaccactgcactccaggctgggcaacagagtgagactttgtctcaaaaaaaaatttgtctggcttcactaaactgccaaaggagtctatgggggcaatgaaggggggatgaagataaagaataaaaaccctgatctattaacagatcactatcatgagatataaacatctgatgcaccaagaaacaattatattttgttctgaatgaatgtatttttactcattgtaaaaggaaataatatttccttaaaaagactttgcaaaataaacaaaattaataaattaagatactatttttaaaacaaataaagatatttatttccttggttttaatacaaaacaactctaaaagaagaaattcccaagagacattaacaagtttaagagttacttaacagctcaactattagacacccctgacactcctaagaatattcttgatttgatgaaacttctggtaacacctggaagcttaaagtcattttcctttgtttcatcacctctctaaaaagttatcgttcctttgttaagatgctagataagcccagttctaaccaaccctttgaattactcatgtctgggtactcccatgtgtatgcactacgcatatcttaataaacatgtttgtttttcttttgtttaaaaaaaaaaaaggaaagaaacttctctcccttttttctagaaagactcatccttgaaccatcaaggccctgggcttgcaaagggaggatagcagacaggtggggttgcgatagtagacaggtggggttgcggaatgtattacactccgatttccctcacagtgttgtcctagttctagcctagcagttggaaattcagccccatctaacttccgttgttttttgtttcgttttgctttgttttgttttgttttgtgttttgagacggagtttcgcccttgttgcccaggctggagtgcaatggtgtgatctcggctcactgcaacctccacctcccgggttcaagtgattctcccgcctcagcctcacgagttgctaggattccaggtacccgccaccatgcccagctaatttttgttatttttagtagagacggggttttgccatgttggccaggctggtctcgaactcctgacctcaggagatccacccactcggcctcccaaagcgctgggattacaggcatgagccaccatgagcagcccagtccccttacttctgtaacaactctgtgaatatatgcacataaccaccggaaagagttataattaacaccttactatgaactactttaatcagccaaccattaaaatccagggaaaaaagagctttgatgagaggcgaaaggccgagcctggagggagttaggccagtgggcaacacccaggggctgcctcagcagaaaacaggctcagagaagacaccaaaaccaagctctgcagaacctcaagggcagccagcaggccctggttgcgttatgtgggcttctctggaagaataaataccacagcatttcttttacacaaattaggacaggttctgaccagttcagttcagcagctccagttacattcaggagctttctcactctctcccgccaaaaggaaaatgcgtaacaggaaaagaaatgatcctggcacccctcctccttctcctcctcccatttcccctctccttcaccccctccctgttttctgtctctaaaacttagactccaagccaaggtcggcctgatctgtctgctttcatccacaggcgtcacatctcttacagaatattcacaaaaccccctcggcttcacacagcagacagaagcctaaaatccctcccgaaacatcccttctcaggtacaaatccaccagacgagcatcaacaacggcatgagatttgaaggaaagtcagaactgtccttcaggtccaggtggcctagagacgcagaaagaatgccaagtttggacccctagtcatctcataggaacaggtgcatcttgagaaaatcattttctccctccttgagtgggattcctcagggataggggaaaataactggactggttggccccttaaagcatctaccagatctaagattctgtgagggtccgtgttaccacaacagccatccatggttgcaagtgatggagaagagcagaaggaagccacttactattaaaagtggtgtatcagccagaaaatgttggaaagagaccatttcagcttgaaagtcggctcgctcctagtattcattcaggattccaagttccttgcatttgtaattcattactagtgagctaaatataccacaagtgtaaaatgtctcagagaaaacactcccatcatcatcagcaatatggaaaatacatggccgtcacatcagaggagaaacttgcctcaaaataatttggatatttacagccacacacacaatgtgatgatttagatgatttctaaagccatgaagcttctcaggcctggcagaaagtataaaaaatattaggatgactatgcctaacaacagcaagaatttggtgctgagaaaagagggctactaaaaaaaaaaaactaagggaccatgttattcacagagctttatgaaattgccaaaaaaagtaacagtacagcattttctgtactatcaataaaatgttttaataaaatgatttctacagtctatctcattatatatttctcaatttttatccaagtaataaatgcacttaagtttgttttcaataaaataagatgataacacaatgcagcaggcttgggcatcccctttcctctgttatctgtttcttctgacaatagattatgcatttctaaatactatgcttataaactccttcctgattgcaagtcagacattatctataagactttttttacttatcacttttatatccactcttccaatctctacttgagatcttatttctgatatcacacttttaatttccaagatctctttcttattctctgattttttttttatcacattctgttcttgtttcaaagacacaattattttcctacttctctgaggatacaggccacattcctatttcccctaagtggctccttccttttgtttgtgttaatataaggtctactggtggaggctttcaaacatctgctgactcctagcagcccctcccatttcaaaatgaggctcaacaatgcataggcttgggtgtcacctaccaactggtgggctcaaagtaaggtaatcaatttacgtgctgtaactatactgtactcccagtaaaagcactctttaattggtggctgatcagcgatgggaggctgtcttagtccattctatgctactgcaacagaatgccacagactgggtaatttataatgaacagaaatttatttggctcaaggatctggaggatgggaagtccaaaagcatggcactggcatctactgagggctttcttgctacatcatcccatggaaaaaggtgaaagggcaggatacactgacagcaagtaagcaagagagagtcaaactcacttttataacaaggccattctcaagataactaacccacttctgcaataatgacattaatccattcaagaaagagagcagagctctcatgacctaatcacctatttttaggccccacctccaaacactgttgcactggggattaaatttccaaaacatgaaattcgggggacacttcaagctatagcagacaggtatagcttcaggaactggggcacctcctggtgtcagttaatcttcctgatgtctattcagagccttgccatgctctctgggctaaggatcccaagttggaattcagtttttccagaaaaaatatataaatctctgttctcctgtgcaggtgaggaagaaggggaaagctctgagagtcaaagtgtgctgtttaaagattctcaaccaaactctcagttttcagcttcaaacttctcccactttcccctgaaccaacctcaaacaatcctggcaactttcaatcagagggcttgcaaaatctgtgagatgcataagaaagccactccaccatcgtctttcttccccatcaatggttatttcatttccacttccatttgaccacaggagtttattcctttttgttctcttattgtaattatagtagcaacatgacagcaagcaatgataaacacaaattgctctaccacttttaactgtaagttctgctctctttaatttatacacaggaagactcctaaaatggtcccatttccatgagcctggcactgagtttcacatggagcagtgtgcaagcaagacgtggttctcatagtcttgaattccaaaaggtagtcttgctaaatactttatggccaaacccagactttttacagtaatattaataacatcagctgtaactgtcagttaattattctctttatgattaagtccaatttgaaatatgcagtgatttcctatagagagaaattttatagtcatagcataaaattacatttcctttcctttattttcaaatgtgaaattttactttagacttggtaaatcaatacagccaaattacagttgctttttggggacctcgatgcagacttacttttacttcatgtactaaaaatcctaaattgcattaatgttttattaaaaatttaaataaatttaatctctaaaaatgtatgccaaaataaatacagaagctcaaagttcacctatatgtattaaagcaaatctatatcgagatattaacaatgaaataaaaatacacccagtgtaaaggtttctagaacccaaatgctcagctttctctgacccctaaaggtctgcctccaagttctgaaaacagatagcaattctcatcctggctgaaaggaaaacaaatgttgttgatagtaatatggtgaaatacagaaataatttcaaggccaccttgcagatcagaaagaacttcacctctgataccaatgttccccacaaaaccgagtaaaattgtctttggctacctaaggatggagaaaacttctcaagctaataaaggtaagattttccagcatattcataaaattgcaagctttcgcccaaattacttggtttaaaaggacacatacagccagtttgattaatcccctggcagtcaagaagcttgtaaaaaatattttgcccatatcgtgatatatgtttaatatatgaccaaaaaaacaagcaagagaaagagagaacaaggaagagaaagagagaaattttaataaagtgttcttttattttctttaaaccttaatgtttttgagaaagcttaaggaaaagataaaagtaattgctactaaatgactgcaaacttttaagcaaaataaatattaatgttgtgcttcatggattctgatgtaagaatgtttaaaatcccctaacatttaaaacagattatcacaaaaagtgatctccttgctcttttccagcccatcattaattggagggagggagggctcttctggctctcattcaaatgataataatttgtctattaatcttgataaggggatggagatgaatgatgttggaatactcataaataatctttatagtagttaatccaccatttacctagtggtcatgatgatttaatagcttactgaagggcatatatatagtcaatccaatccccaaatttaagaattgccaaggttatgcttcatcaatgcaaacatctttgttacttaaatgtaagcattagacctggaattgctaggaagccaaaatagtgccactctccacatttaaactggatttgcctctaaaaagatcagaatcacacactccctacacatttccctatgtgtatcctgctcactaatcctttacacatggatggagtccccaggtacaaagcactgcttaagacagtgacttccaatggcccatgaaatccatttttttttttttttttgagacggagtctcactctgtcacccaggctgtaatgcagtggcgcaatctcggctcactgcaagctccgcctcccaggttcacgccattctcctgcctcagcctcccgagtagctgggactacaggagcccgccaccacgcctggctaattttttatatttttagtagagacggggtttcaccaggatgtgttagccaggatggtctcgatctcctgacctcgtgatccgcccacctcggcctcccaaagtgctgggattataggcgtgagccaccgcgcccggccgaaatccacttttactatttctcctacactttgcccaccaggatgttagtttcatttaatgagtccctgtgtggaagatatttctgagtcaaagtgtctttaatttccaaatcctgctagagaatgatagaagctcttggtgatgagtcacaagggtagtttgctggtcaaaataaattcctgctccacaaagtcccctgcagggcagctgagaagggccactcacagatttagggggattagctgagctacaggttcacagatgagtgtggtaaatccatcagacacattcagtgaatgctcaccaggtgctcaccagtgcaggacacactgcagggagccaccaagatcacttgctacacaaacacccaactaaaatatttatttaacaaatgaaaacagccaactcccaaacaaacatccatccaaggtaaacaaaagaaaccagtttccatgtgaaaaaaaactgcatcatttcataaatttgcttgtaataaaataactttgggcatattgtggtaattatttaattatcatttgcttggagttagaggctcagcactgagaactactccagggtagtgattaagagtatgggcagccgggtgctcacgcccgtaatcccaggactgtgggaggccgaggcgggtggatcgcttgaagtcagaagttcaagaccagcctggccaacatggtaaaaccccatctctactaaaaatgcaaaaatcagccaggcgtgaatgtaggcacctgtaatcccagctactcgggaggccgaggcaggagactcgcttgaacccgaggcggaggttgcaatgagtggagatcacgccactatacttcagcctgggaaatagagcaaaactccatctcaaaaaaaaaaaaaaggccaggcacagtggctcaggcctgtaatcctagcactttgggaggccgaggtgggcagatcacgaagccaggagttcgaaaccagcctgaccaacatggtgaaaccccctgtctctactaaaaatacaaaaattagccgggcatggtggtacacacctgtaatctcagctactcaggaggctgaggcaggagaatcgcttgaacccgggagggagaggctgcagtgagccgagatcacgccactgcactccagcctggatgacagagcgagactctgtctcaaaaaaaaaaaaaaaaaaaaaaaaaagatatggcacagctacttgggtttaaactccacctctgtccctcattacccgtgttgggcaagctacttacccactctctgccttggcttcctgactgtaaaaaggcgaaaatagaagtgcctcttttatagggttattgtgaggatcaaatgaatttatatatgtgtgtacatgcacatatatgtatgtatatagacaaacacatatacccagatatgggtgtatatggttgtgtgtgtgtgtgtgtgtttgtaaatagtaaaacggttaaatagtggctggcatagaaaacatgaaaaaccattaagctactcttcttatcactacaatacttcttatacatcaaattatttcatacagtgtttcaggttaaaattaagcaaccactaaacgtgtgcaactgtgtttaatatgatgagctagagatgcttgaaaatgatcagctgattccaaacagctgtgccctcagagccactgctgcacagcgagcttgtctgagtgcctgccacgagcacctccccccactccatccccattagcagggaaagacaataagtaaatctggtgaataaggtgcaaatagaaactcaacacttaacagatttcaaaaagcagactcaggtaaataaaagttcccagtattaaatgaggcacatgctagttcatcttcaacctgaatgcgaaagctcagaccacgactgaaaggaaggggtggaaaaatcgagtgagtggtgcactagttttttttgattaatggttttacctctgtaattctacctatggaaactgtcctttgccccagaatacccttctctcctttgatttctcactgctctgttgttcccttgcttcctgcacagagaaatctaaccagaatgtcaaattgtgtgtgtatgtctgagcatcagacacattccaaccaatttataattgattatttcataatcattctttgtatacatattactatttataatattcacaaaggcaaaattccagtggccagaaaagtgggtcagagtccattcatccagacctggtaacctggattgggagacggcccctctcactatcagcagcctggagatagtcagaggcaatgatgcaaagagggaaagagagagcaggaatgaagccaggacgtaatagtaatagtaataataataacaaaagcaacagcccctaacaatattagccaaatactttgaactcatttaatcttcacaattataacgatctgttaagacacaatagaataattatttttatccgagtctgcagaatttacacctttaaaaatttacttaaagaccaggcacagtggctcacgcctgtaatcccagcactttgggaggcggaggcgggcggatcacgaggtcaggagttcaaggcaagcctggccaacacggtgaaagcccgtctctaccaaaaatacaaaaactagccgggcgtggtggcacgtgcctgtaatcccaactattcaggagactgagacaggagaattgcttgaacctaggaggcggacattgcggtgagccaagatcacaccattacactccagcttgggtgacagaacaagactccgtctcaaaaaaaaaaaaaaatgtacttaagtctgggcatggtgacccatgcctataatcccagcactttgggagggtgaggcaggtggatcactggagctcaggagtttgagaccagcctgtcgctacaaaaagtataaaaattaactgggcatggtggcatgtgcctgtggtcccagctactctgaaggttgagatgggaggatcatttgagcccaggagatcaaggtagcagtgagccgagatggcgccactgcactccagcctgggcaacagaaaaagaaaaaattacttaaaataacttgggaccaaaaactgaagatagaaacatacaatgtttcaactaaatcttatggtatataagattctaccagaaaatgtactaggcttcgtcctttgcagaagtgatcatgacgacaggaagcagaaagatgttagtcaaccaagttattccgagaaacaatcatctaaatgtctagtaccaagtaaatgcctcatgaaacaatttgtcattttatcaacaaatccttaagtgtcgaagtctctgccaaaaggcaacacacaagtacagaaagtctaacatgcccagaaacagcatttccaaggaaaatgtcagacccacaacttaacagcctgattggcagacagactaccctgggccacaacattaaaagagtaaaattcatgtaccttaacctggaaaaatgtgaaagaataatgaggaaaaaaaaaaacctaactaaatattataaaaattaactttaattcaaaaaaattttaagcaaatttatttttgtttgttttattttgagacagggtctcattctgtcaaccaggctggagtgcagtggtaccaccatagttcactgcagcctcgacctccaaggctcaagtgatccctccacctcagcctcccaagtagctgggaccacaggtgctggcatcacacccagctaatttttgtattttttgtagagaggagtttcaccatgttgctaaggctggtcttgaactcctgagctccaacaatctgcctgcctacgccggccaaagtgctgggattacaggtatgagccaacatgcccagctagatttattttcagtagacattataggccaggtgcagtggctcacgcctgtaatcccagcactttgggagcccgagacaggcagatcacttgaggtcagcagttcaagaccagcctggccaacatgatgaaaccccatctctactaaaaatacaaaaattagccaggcgtggtggcaagtgcctataatcccagctactcgggaggctgaggcatgaggatcacctgaacccgggaggcagaggttccagtaagccaagatcacgccactgcactccagcctgggcgatagagcgaaactcggtctcaaaaataaaataaaataaaattagccaggcgtagtggtaggcacctgtaatcccagctactcaggaggctgaggcacaagaatcacttcagcccaggaggtagaggttgcagtgagttgagatcccaccactgcattccagcctgggcaagagaatgagactccatctcagaaaataaataaataaataaaaataaagacattataaaggaattaaactaagcaacactttatttcttggtattccctaaataaacttgaagaagtaagaaagatggaatacactgaaggaaaattttcctttgaagaattgggagttacagagaagtccacagcacttcatcgttaacagtattattgtacaggctcttaacagtgcaaagtattttcagtatatatcacagggtgttaaaaaaaaaatcctacaagcagagtacctaagccgaaaatgaaactcaaaaagagataataggtcaaaaaatggtgaaacatacagtcgtgaggtttgtcaaaagaaaacaatcccatctggaagctatttccaggaaaggaaaggacagaacaaagcccagaaagaaatgcttatgttcagatttactgactgtgagagcagaaatttacataaagcaatggaaaaagtaccatgcaatatgatcaactatcaaagggttccttgacaggaaagtctgaggactattttaaaaaattaatttataaaaagaaaggtaagagaaggtactaatctctattacaacaatttggtaatttatcaagataccagattggggctgggcgcggtggctcatgcctgtaatcccagcactttgggaggccgaggtgggtggatcacttgaggtcaggagttcgagaccaacctggccaacatggtgaaaccccatctctattaaaaatacagaaattagctaggcatggtggtgggtgcctgtaatcccagctatttaggaggtagaggcaggagaattgcttgaacccgagaggcagaggttgcagtgagccgagatggccccactgcactccgaaaagagcaagactccatctcaaaaaaaataaactaaaataaatatatatatcagattggaatgtttaaattggcttcaggattaaggcaaatcgttggcgaacttcctgcaatctctctttttttaaaatgattttctgtactgtaactggtttacaatatgggatgccacaaatgagagttctattcatctagattatcacatgtagctgaagaaatagcttcctccatatcattcgctgtcctatttatgaggttctgagttttgggggtcctcaggaccaggagaaacacaaactgccttatttcatcaaatgtatttgtgagaatttatgaattatgtcaatcttaaaactaaccattttcttattgctttgtctaatatgacactttgagacaaatatgcatccaaagtttaccaaagggagcaagcatgttagagaaagcaagcagtttctgtgaactacccatggccttatcttaccaatccactcatttcttcctctctgcattgttgttgatttttgctttttcaaaatcctacttcctatgtggctctctgtaagaattcagaattagatggggcattttttaaatatgataaaaaacttactctaagtcctaactaataacaagcatatcctcatctatgaaacactgacaattatatcttccccataaaattatggtagggagtaaatgaaataatatatttgaaaggcccaacacatacacctagctctctgcctccctctgttattttaggaaatattttctccatctaaaattaatttcccttgtgtgctccagattagcaagcgatcaattcattcacactttgctaacttttatagtgaaactaactggttacaattttaaaagttaatgtatatccagatacttcctgtgaaaaacattgactttggctaagactcctgaacccatacattattggaagtaaaagtttaacagattatggttaattttaaatgaaagtaatgtaagtgaagagactgcaaacaaagcaacagctatactactaatatatttacccagaccctctcatttccgatgttttctttcaacatgacagcattttcaactcaattggcaacaacattgtgcccactatcacacaaaccacctgaatgagagctatggggtcagtaagagccaccaattgccacacatatccaaataggaaccaacatcagtctatccgttgttttgttttttagagactttttttgttttcttgcagagacagggtctcactgtgtttcccagcctagtctcgaactcctggcctcaagtaatcctcctgcctcggcctcccagagtgtggggttacagacgtgagccactgtgccaggccccacttttaatacaaccatgaaagatgagaaggtagtgcagaaggaaacaactgagggaaatgtatcctgaaatcctctagctgcctcttccattttgaaagagggagtgtacagggaacagtcctgtccagatagcaatggagccgaggcgaccttcagcagttcacagcgccatgacgttctcatctggcaaatcatggtaatacctattctgccagatcatcaccagatcatgccaaggattcaaacacatataaagtgcttttcaggtagattcctactaatgccaagctgcctgaaatctgtccactgcataaaggcacgaggccaaggtgaaaaacgacgctgaaatccagccagcacagcggcacggaggaaagaacaccttttgctttgcacaaaggcacagcccacgaagtagtgtgtccatcagactgtgtctctccagagtgggcgccgttatctaattgcccacgcaaaagggctgccttggtctaagttaaaataatgcccagcagcagcactaactaatggcaatttctaggtgagaacaagaacaagagtttggcatcgggccctgtccaactagtgtcagaacctcagccagtagccaattcccccttccctgaccccttcaatgcacatcaagcacccgaaccttccttcctctcttcccatctcaccacagtgctgcccacactgccactgggtcctggaacagtgccctgactgacctactgcccctgccagccatccaggaaggaagataagccactgttcaggccagggaccccacttcctgaccccgctggttgaacttaagatgtcttttcttaagaaacaatgttaggataattacatcctatggcacttttactgcagtattgtctttcagctaccattaaatgtgaaacaggattctgcaggctggcttatgttccaatgcttcaaacaagcaaattagaaactcttatagcccactaagtgcccaggccctgggtcctggcctctgtttgcaaaggagatcatctcctcttgatcttgtgtaagccattcgagctcatgaaacctgtttccttagctgttaaataaataaataaataaataaggaaaaaaatatatagagagaggtatatatatacataggtatttttgttgtgagtacttcaaatgcaatacatgtaaaatggcaccaaatggacactgagaaagcagtcaccataccaggtgcacaatcccttatccacaatgccaggatctgaaaagctctggaaaccaaaggctttttccataacccatttggcagcaaaacgtgacctgaactgacctgaggctatttataaccctgtttgtgttccacttagtgtaaatattcatacattttctgcagaatgatgaagatattggatgatagggtactgtcccaaactcctctggaggctttatgtaacatagggcatatgggccatagcctttctgaaatgggaaaaagaaaaatcataaattctgaagcatatctggtcccaaggatttggataagggatggggagttttaccatgaaggaggttcgctggccaacccaagagcagctttttgtgctagactttcagctacatttcccatcaacaagttgtcacgatgtctgagcacagcaacagctccgccctgaagaggtcagcatccaggtcctgggtctgggctggccagctctagggagtggatggggttaggagctaaaaggctgagcagacagggaatgcggaaaccaggcctgcgccctacttcacttgcactcagacaacccaagccatcaagcacattcttatgacttgtgtagtcattttttttttctagattttcaaagtgaatcttagtttttattcccaacgctggctccctctagtctgggcaaactgccatttaatcacaagggccactcaaaggttgttttttctctttttttaagctgttgaaaacattaagctaaataagtgaatattctccagcctccctctctgagcccctccctacctttctcatccattaaaacagcactccatttcattacaaatattctactcctagtgtattaaagacataacatgtatattataaaaagtaaatatgaatattaatgaaacagaagcatgaggaaaagggaaaattttaagaactgaatcaatgtaacattctctttgtagcatcacctgtagacctagacaagcaaggaccttgccttaaatcctgacttttagagggcctcactctaccctcttccatccccatctctcccccagaaatagagaaatcagaggaccaaggggatatgcaagtcctaaagcacggtctagaggcacagggtcctagtactcactgctcaaatgagcactgggctctttcccaagcaagggtggaccacactactgtttgcaagtggggaagagtgggagaccatgggtgcttggccaactgaccacaaacttgggtgcaaagcccttcccagtgccaaatggagccagcatgggcagacaaaggggaaagtctgcaaactggagccagggggcagctctctccaccaccatgttctgtcatagaatctgaggacttggaaaattccaaactcaaacttggcccatgaaattgtgatcaaagcatatgtatatttattattatccattctcctttctattttcttttctttttttttttttcagtatcagaaacctgctcttctcctccatccccacagttctagctcagcacaagccatatttctcaacctcccttgcagcaagatgagtccacgtggctaagcagcagccagtgggatgtgaaaagaaatcaggaatgcaacctgagggccatgcacgttttaaaaaattgcttattttttacttctcttttctctttccttggactagaacttgacatagtgttgaggggcaagcctcatcaagaaaatggaacaacactttggaaaggcagaacaagagagaaggaaccaggatccctgagagaccatatgaagcggagccaccttcccaccctccatcacccaccaactctgaactgtaaggagagaaagaaataaactctgattttatttgagccactgtattttgaggtttctttggtacacccctggagcctctctgtaactaatacatttgcaaatgatctacataaactggctggaaattagttgtatgaatccactatggtgacttcagccaaaagaatataatatccagcctcagcaagtaaaataaaataaaatgggagaggagagctactgtgtgatgcagttattttttcaagaattctaccagaaaatcatatcaaatatataaacatggaagagaaaaactaaaagaattccacaggacaattagccatgaaaaggcttagtctatcctagaatgtcttgttattaaatataaagaagcagaaaaagggaaattctgtatatatttaagaaacaaaaacaaatcttcctagtgcaatatgattaaaactatttttacatgcttattttaaaagactggaaagaaataaacccacattataataattatttgtatggaggtaacggcttacatttcttgagtgcttctatgttccaaattgctttttttttttttttgagatggagtcttgctctgtcacccaggctggagtgcagtggcgcaatctcggctcactgcaagctccgcctcctgggttcacaccattctcctgcctcagccttccgagtagctgggactacaggcgcctgccatcaggccggctaattttttgtatttttagtagagacggggtttcaccgtgttagccaggatggtctcgatctcctgacctcgtgatccacccgtctcggcctcccaaagtgctgggattacaggcatgagccaccgcgcctggccccaaattgctttatatatgttaattcacttactttttacaacacgaggaggttgatgctattactatctctactttactcaggcacagagcagctaagccatttgtccaggttcacagagctagcaggtggccatgcttacacccacagcacctgatactgtctgaaccattccctaaagtatttctacagaagagtactaataagatttttaaatcctgcaggatttttcttattattcttttcaaatattgtgtaatctaataccatgccatccttgatatctaactcattttagagataaaaatgcttaccctaaataccatcatataatctatatttctataaccccaacagcaatattgcaggttagaatccaagtgtgcagaatatttgtgaagatcagtgtagataatactgaaatgacagtgatgaggaagaaggtactagaacacagcccttcccgagcacagctcgcacaattaagcattaacaattaggttttctggagcttagaaagtgatcagtgtgaggtcatctagtccatactccttaccttacaaacaaatcaattaattgtgcagacagcttgagtgacatattcaaggtcacacagctggtgatctgcagagctaaaactggaacctagttcctctttgacactaagctaagctctttttttaaatagggcatccaggttttctagaatttagcaattaaagcagtgattttcaaattgtgttccaaaagacatgaaggaccctcagaagcctgggttgagctactcacctgccagtcccaccccccaaactctgctgtatagaaagccacatcctacctatcagcaatgcatcgtcacattcctaaaatgagcctccactggaagacttgtttgcagaaagacttccaaggcaaaaataaaaatcacataaccaagtgaagtattcgcatcgttactttccagagccccataacctgggaccttttagagtgcttagtaatctgaagaaagcttcttacgccagaattcttcccccaggaagatcctcatcatttcactaaatgggcattttcatgccaactaaaaatgtaatataatcacacaataaagggcaatcttagaagaggaaaggcagttggcaaccacgctgacaaatatctatactacactgacctcagtctgctcatttcatgactgcctgttgaaaacaacatcaagtgatcgatctgtcgtgagcatctgggaaacacagtcaaaggctgacatgcagctaatcaatcgggacaataaagatcaacaaagattgaactgatatttttctcagggattgcacacttgtttgttttttgtttgtttgtttgtgtttgagacagcatcttgctctgttatccaggctggcgtgcagtagcacgatctcagctcaatgcaacctctgcctcctgggttcaagcgattcttgtgcctcagcctccccagtagttgggattacaggcacgccccccaccccccgccacgcccagtgatccctgtctccccacctcggcctcccaggtagctgggaccacaggcatgcactaccatgcccagccattttttttttttttttttgagacggagtttcactcttgttacccaggctggagtgcaatggctcatctcagctcactgcaacctccgcctcccaggttcaagcgattctcctgcctcagcctactgagtagctgggattacaggcatgagccaccatgcctggttaattttgtatgttaagtagagacagggttgctccatgttggccaggctggtctccaactcccaacctcaggtgatccgcctgcctcagcctcccaaagtgctgggattacaggcatgagccactgcacccagaccaatttttatatcttttgtagagatggggtttcactatgtagcccaggctcacacttgtggaaagcaatgaaaaatgtgatttgcttctgcacacgtgtatttattgagcacatactatgtgtcaggcactgttctagatactagtgattcaacctagacaaaatacctgcattctagtggaaaaagacaatcagcataatccagtaagtgctatgggaaaaaatgaaacaggataaagtgggtggagagggctaatgagggaaggatttgctattttaattgactggcacagtagctctctgagaggagggagttagccacaaggttatctgctagaagagggctcaggccctgacctgggaggtgcctgcctcatataatgagcacaaactagtaaggggagatgaagccaggcaggataaacagggtcctgtagatcactgtaaggtctttcgcgtttattacaactggaatggggagtcactgcagacttggaaacctgaagcaacatatccacttctgatttgaaaaggatccctctactgtggggttcagaccagcctccatgggccaagggaggaagcagagagacaagtaaggaggcaattccagaaaaagcaatggtcccctagaccaggacagtagcagtggagatcgtaaaatatgaccggattctgtataaattcagtattaggaaaatagaaccagcaggatctgctgcattggatgtgggtatacgagaaagaaaggactacaaagatgactccaaaactggggcaattggaagaatcacattgcctttatctgagacaagcaagactgtgggatcagctttggggtttacgggagatcaggagttcagattttcagatctgaacatagaagatgtgaagtaaacaactggaaatgcaagtatgcagttcagaggaagaggtctgggctagagatagaaatttgagccagcattcagatagtatttaaaccaggatactggtgagatgacaaacggcaacagtggggacagagaggaggtccaaggactgggtcctgggccctccaacgttaagaggaagaatcagcaaaagataatgggtgggaaaccaggagcgtgtggggtgtcctagaagccaaatgaagaaagagtcatggaggagggagtgatcagcagtgttgatgctattgagaggtggaataaggtaaggactgagaacaggctactggatttagcaacaaggaggtccctaataactttgacaagagcagttttactggactggtagggggtctgcctgatttgagtggtcttaagagggaatgaaaggagacgaactgcaaatgttggtacatacaatctttgaggagctctttcataaaggggaccagaggaatggcgtggtagctacagagacaggtgggatcaaagtaaagttttgctagaagaaaaacaatagcatgtttgtaagcggatccactaaaggggaaatcatagggatgcagaagagagaagggaggtgactttgagtaagtaaaggaggatgggtacaatgtacacggttagggtggccttgggtgggttctggttgaggatagatgtggtattgaagtttctggattcctctttggtttgcttcaattttcttagggcaagagtaggcaaagtcagccgggcatggtggctcacacctgtaatcccaacacttcgggaggctgaggtggatggattgcttgagcccaggagtttgagaccagcctgggcaacatggtgaaacctcttatctacaaaaaaaaatacaaaaattagccaggcgtggtggcacatgcctatagccccagctacccgagggtgggaggattgctggagcccaggaggcggaggttgcagtgagccatgctagtaccgaaaaaatgggacgcttaaattcagatgacagaggggctgccaccataaacaatgacctggtctagccagaatatacccaccacactgggagacaagatcactagaaagagaacttagagaaattaagaggacagagtattagaaggatcatcaatgtttacacccaaatcactaaaacaagagtaacttttagagagagtgacagagctaaactcactgagaaatgagagtgagcggtggagggagggagtgacatctcaccaattaggttgagttggtgatgcaatccgatggcaggagattgcagctggggaatctggtctgaatgcggaatgaggagcaaagggccattatctctctctcctgtagtaggagagggctgggagaaaagaacccacacaaaaggcagtcacaacaaacatgtctacactttgacaaagaaatttcttttgatgtcagaaaaaataaagcactgtgatatccattccacctgagcttgatgaagcccaagtttcattaattaaaaaaaaaaaaaactgaggcagactgttaattagtaatctatgtctgattatttgccacttttagcaacaaaagggaaatattcatcaacaaataaaaatacattatatgcaaaactgggtcaaacattatcagaaattttgcccttcaaactttgtgtcttctcaacctaattctagcaatcaggtcttttgtttgagtggctttaaggcagtagaagtaaagtaaggaccagaatttgagttacagcaaaagtgtgagaccctcagttcgtgccagcgtattggactgccaatctaatttcagaaaaaaagaaacattatgaagacataaccctataatatgtcactcttcctctaacaagacttaacttttcattaagtcataggtctcctttgagaatataatgaaaactgtggaccctttttctaagaaaatatgcagaaacacaagtgtaaaaacttctgcacatattgcaggatttattgttaacctcttctctccctccccaaacacccagtcaggctaggtagagtaatatctgcaagggggcttcctatgcccttgggagataaatacagtcaacaactgcggcatcaactaataatatctactaaaaaatattacaaatcaaaaaccacttcttaattcttcatcttccgctgccgtcatctaccatccagatgctcattttagggtcagtcaaaaatatctcagaaaatacaaagataaataaaatatgcaacagttcttgatttttttttttttcaacagagtcacactctgccacccaggctggagtgcagtgatgtgatattgactcaccgcagcctccacctcccaggttcaaattattcccatgccttagcctcctgagtagctgggactacaggtgcgcgaccccatgcccaggtaattttttttttttttgtatttttagtagaggtagggtttcactatgttggccaggctggtcttgaactcctgacctcaggtgatccgcccgcctcggcctttcaaagtgctgggattccaggcatgatccaccacacccggcctcttgaatttttaacattatcttgcaaagagctcaaaaaatgactcaggaaagtactcaagactccagctgccagttttcaagggcagaccccagcccaagccagtctcatacatgtaagagaaatatatatattacatatttttcccagatatctccaggcacctcaaaactcaatctagaacttcacttactatccccttatgcactgccctctccacaaaacctagaaagaaaggcttcatttgcgagtgttaaagtcaaaaaccaggcttctctctccatcccatccaccacccatcatctgaagaccaccaccatgtcctatcaggtctgcctcctacctaaagcttctaaactctcccctctcctccttcccagctacctcaatctcagttttggcttcaatacctcttatcctctaactgtgacagccacccaaaggtcctccagaaccccaggcttgcctcatccagcacacaccccacaccatccatgctccacgtggcttctagagcaccactcagaagagcaaatctgatcagatcagccctctgctcacaagctttcagaggaagcaaggccttcccaaaccaggagtgagagagaggaggccatctcaagtaaccaaaaacacagagaaaagggaaaataaaacagaaagtatgtaacctgatattacagctacggtttgtggtgtgtggtgtgtgcagggtgtgaggtatgtatgtgtcagggaagtagttcggtgaatactgctcctagaaattggaagctttttttatttaatatgtcatatctttcagacatagaaatagacaataataggcaaaagaaaatggtacaaggtccatgactgcagtgaatctcctatccagatctgcctttcaggcaaggcaatgcacaaattcattcccccagcagctgagggctcatagctgagcatccgtccaggaactgcccttggccaagttaccttgcccagattttcacctcacctccttcccagggtcagccaaaagcctactggtcaaggcaaaggtccccaggctcaacacattgcctcaagttgggaaatctctgaagggccatcccagcaccagcattccctatggatccaatggtggccctgctgtaactcaactacacttcagcttttccctggcccagtccttcttccctcatttctttcattaacaggaattgttctcaagtgcacacaaatctctgtctcaaatcctacttccaaggaactgggcttaagacagtcatcactcagttcacaaatcagcattatttcatattaatttaagattctatttctattttcattgaggaattaaatattatagataaaactgaagaacctcctctctcactatctctaaagaaatctagtgtttataatttccataaaaatttttgtattttgctatatatttataatatgaatacataaacactgcagggcaatttctgcaggtatatgagctttatatacagtaccattcaatacattgtgcaacctgatttttgtttgtagtcaaattgtttttaagatttatctatgctgacataattagctctttaaaatacaacctaaatcaaatacgtcaaaacattaccagcctggccaacatggtgaaaccatgtctctacaaaacatacaaaaaaaattagctgggcatgatggtatatgcctgtaatctcagctattcgggtggctgaggcacaagaattgtttgaacccaggaaggggagattgtagtgagccgagatcgcgccattgcactccagcctgggcaacaagagtgaaactccatttcaaaaaaaaaaaaaagtcaaaacattaacagctgataaatttcaaatgagggcacgagcatatctgatatatcatttcctgtacatttttttagattgaatacttcagaattttaaaaatgataaatatataaatataaatttttttaattttaaagccctttcaaagattcaccattatgcttaggatacaactcaaactcctaaagatggcttataacactcttctcagcttcattctccagcatcctgctttagccatattgaaaacctcacaattctcacctccaaacctcttgtcatcaactccctctgtcttaacagcctccccacatccccactcattctttcagatctcagcttagatatccactcttccaagatgccttccttgaagccctgggatgtcaggtaccactcccgtgagctcacacagcaatctgtgctgtttttacttttacaactgtgtaactgcctgtttaatctgttttcttaaattcctgtgtacctgccctctctaggtgacagacagtcgacaactggaactgtgtcttattcaccatgcgccaatccacaagcctaacatgttgtagaggcaaggcaacaaagtactatgcaaaagtctcttaccggccaaagcaaaaacttgggtaccaccaagagacaacccaagaatgcttgcaagtgtttacaaatgagagcttttgttttttcttgaaggttaagggaaccaccatttctgaaatatcagcatatatagtagattttagttatccactgaatgtaaagaaagatgaacttacaaacagtatgacaataacagcctcttctttcttctattcccaaaacctccacagcagagcatcacattaaggaaagcatttgttacctgaattattataatttctgagcatcccagctttattaactgaactccagggcccttctaccacttaagaattccctaaatgtaagatatttctcaacatctgctcctaatttatttttaatttgcatttattctatcctatttgttgaagctgaaattactaatagaggatggcattatcttcacagcatcacattagactactctttaattaaagttcctctgaagtagttttccaaactcttttagtatatagattttctcttagctgtgcaagagttttaccttcatttaagatgagattaacattacctttctttgctactttttcaaagaactgttaatagtatactgcatagacatgaataaaccatctcttttctcattttcatcaactttttcctaaagcatgacccttctctcagaatatatatagaaaaaaatacagatcctattgcagctgaactgaatttgaagttccccatataaactgaccaagaggtactgtgagaaaaacagcagtagtcaacttcagtaagaagtagaagtaactgtaaacggttaagaaattgatcaagaaaattctagagaaaaagctaataaccgaaagtgttgaaaatctgaattacagtacgatttgaaaaactacatacctcattgaaaacataaagcaaatcccaccaaggtgaagtttacattgcggctttatagatactgttactaaaaagtcccacaaaggtgaaatttacctagaggctttaaacatactgttactaactaacaaatcccacaaaggcgaagtttacattgaggctttgcacaccctgttactaactgctaaccacttttcacatcctttcccctgctcagtctcctcttgtaccactctggtccaagtccttatactccttaacctcaattttttcacaactcttacctgttccctgcctccccctaactctgctaccttccaaatctatctttcctgctgccagccaagttatctttctgaaaaacagttctgagctagtcattaactcacctaaaatcctgtagtggcttcttacagggaaagatcaaataaaccctgcttcaaaagggctttcgaaatctgaccccagcttctcccatcatccccattaccccagccacactcagttaccagggacagacttcaaatgccttgctcttttctcatcatctgcaatgttcttcccacactgtccacagcgttgcctcttacacatccttcaaggcacacctcaaattccttgcctctttcacgctctcttactcaaacctaccctcattccaaccaaagcaagacatccttcctccctccatgtgtccctggtttgtgtggggatgtttattgatgtctttctttccaactagcctgagagcatcttaagaacagaggtgggtcttgcttatctctgagcccagcatctaacaatgaatgaacaataaccatttgctgaatgaatgaggtatgtatgtaagcaagtgtaatttttaaaaccattaaaaggcatagcaagtctttttttttgagacagagtctcactctgttgcccaggctggagtgcattggcacaatctcgtctcactacaacctctgcctcccagttcaagcgattctcctgcctcagcctcccaagtagctgggattacaggtgagtgccaccacgcctggctgatttttgtatttttagtagagacgaggtttcagcatgttggccaggctggtctcgaactcctgacctcagatgatccacccaccttagcctcccaaagtgctgggattacaggcatgagccactgcacacggccacaagtctttgttaagcacttactgtgtgtgtggagactaagctaaaggctagcatcagaaagtcagatgaaaaaaggcatatagacatacacaagccagaagggccacaaacagaaatgaagagtgaacacgtgggaaagattgattctggcatgcagatagcacagagagcagaacacctggtggcactgatgctgatgttttaaagatggaggttgcaaaactggggacgcagggagaaggagaacaatcaagcccagaacacaaaacaagcgaagtcacagaggtaagaaaaggaccatgggcagtcttcacctggtgccctctgcctccttcatggtggtttttggggcgagggggagggtggggcagtgctgttagaaagtaggatggtggccatgagcagtgtctcacgcctgtaatccagtattttgggaggccaaggcaggcggttcacttgaggttaggagctcaggaccagcctcggcaacgtggtgaaactccacttctactaaaaatacaaaaagtagccaagcatggtggcaggcacctgtaatcccagctacttgggaggctgaggcagaagaatcacttgaacctgggaggcggagggctgaaattgagtcactgcactccagcctgggcaatggagcaagaccctgtctcaaaaaaaaaaaaaaaaaaaaaaaaagaaagaaagaaagataggatggcatgagacttccctaaatgtctcccttagacatatatgcagagagaccccctctctgagcaatctgccttgatgccaaggccctcagaataaggtatgtctgacaccaaatgcccaacaaggctgccctgagacagcaagcatatgcatgtgttccgaaaacaccaacactcttctaatttacaacacgttacgtatcttgaaaaagcgtatgcaagttcaaataattcaagtcaactctgatttttctatacaaactatcaaaatgggagttaatatataattaagggtctgatatgttaacattatagaactggccattgatttcacatgtaaaaacacaaaagtaaacctttttatatttgctaatacggcattttctaatcacctaaaggaactagatgaggtaacagagtaaactagaacacacacagttttatttatgagccccccaccgaaaaagctgggctttagggtaagtccaggagcctttaacactaaataagatggagattcatcctcccacccctgagacaatatttacattttaaattttaaaagataatataatttcaaaactggcaatataacaatcactttaagaaattggtcatatacaacttaggaccaaatgttgttttaaagtctatttgcttcggggtattttattacttttattttgcagtttcttagtttcaaataagaaaaggcttcctcctgtttcatgaaaacttactccacatatgaacatggccaacctctgcaccaaagtctctgttctaacatagattaccagccactcacacctttccagtggctccctttttgatccttaatcttaaaactgcctgaggagcaggtctcattaaattttgagatgtgatctcaaataccacacaatgatatacaaagaagcaattccgtatctcaagtcactctgaaggttattttatcaaagaagaaataaagatcccttcctgtatcttcaaagaggtaaaagattaaagctcaaaagacaggtaaataaccccaaagatctgcaaataactcaaggtctataaaaggtttggggtttgttatttgacttgatttggtttggttaactgaatataaggatatcacaagaggccgggaaccatggctcatgcctgtatttccagcactttgagaggctgaggtgggtagatcacttgaggtcagaagttcgagaccagcctggctgacatggtgaaaccccatctctaccaaaaatacaaaaattagccaggcatggtggcacacacctgtagtcccagctactcatgaagctgaggtgggagaatcacttgatcctaggaggcagaggttgcagtgagctgagatggcaccactgcactccagcctgggcaacagagcaagaggaagactacggctcaaaaaaaaaaaaaaatcacaagacttttgggctgtttttacagatccatagggaaaatgctacggtggtctatgtcacttaactctttaattcatcttcacataaaaatcactatacatcttttaaaattcactcattttaaagaatggtaggcaaattatttcaaaagcaagcatagttatattaaatatgtcacctatttagaattaaaaaacagggaggcaaatattaatacatatataatacatttctctaaccacccccccttaagataagaaaactagcatagaggttgaatgtgaggagtttttttcccaccatgattcaaaaacacgtctgtctttgaaataatgtaatagaaaatatacacaatacatttttataatgaatgcatcagcggactctaagctgatgcattccctagaaaaagagttcaagatgtgatgttacactcacagcaagaagaccttgaacacactgcagcaataactaaggagcgcagtggagaaatatgtcggcactagatatattggtatcatcttctggttcaatgggccaaaataagaaatgcaccaggtttcatcactctcctgacccactttcctcacttttaacttcacccaacacaacccaaactcttcaaaatacagtgtaaaagaaaaaatgcccaacatcatgaaatctattatcttttcaaattatttaaagggaagtgtttataagtagaaataataaacgttgtagctttccttgctcctctaaaatgcagatcattttcactttggttctatgacttttaaacctgccttccttgtctataaattaagagcactaaagagaatagcccacagaacttgttaaaactccagatgctgggaccccaccccacatatctgagtctggacccagaagggtggttctgacataaagcttgaattaggaactccatatgtgagaagctcaaaacctagttttcaaaataaaagcatgtgcataaatctacatattgactggatcaatgttaaataacatgactcacacgtagcctttgaggggcaagtgaacaaatcaattagtatcaacctcaaaatgttatttcctgcaccaaaaatcttttgcatataaatattgtataccaaaatcttaattagagaatggagttgaagaaatttgcaaaaattaagactatgaaattaaagaaaaagatctaaagagatcatacttttgaaattatacagatgtgttaatttcaaagctgtaccactttagagacacaaagtcatattttttattggattcctctgctacatcagaaatgcccttatatgcttttctctacactttgaaaaaagattttgttccataattaaatgttaaaaggattgaactgaatgtaactagccacccgtccacataccaaaaaaggctcattcgaaaatattcacacaaaaaatgtgactctcatgctctatgtgttgttgagctccactgctatgaaagacagatctgcattttttttaaacttaatttcttaaaagtgaaggtgaggttataccactgtaaaccttaatcttagctgccagatgcgcatacacagacatttcccttatgaaccgggccaagagaatgtgcttctgatagaagagccccacaggatattaataaacgtcaggtatttggttgtttaaaggcacaaatgcaaagattggaaaaccacatggatgctggaaactacctgcttcctggaattgacatgtgcaaatccagtgtcacaggaagtaaaagcgaaaggactgggacctggtttcaatttctcagtccaagagccatcatctcgagagtaagtatacattaagaactcatactgcctcacatttcaaatattgaaataagtctatttattattaaacagttaaggcatataaaaagataaaaatataacatagtaaatgtctatgcctccacacaatttaaggggagaaaaaaaaatccagccaatgcatctgaaaccacttcagcagagtaccctttctccattgctttagattaaattttaactaatatttacagctgctcaaatagtcttgcatgttgacttgttcccagaaaaatcatcatatcagcatctagttcaaacttctgggtacaaataaggttcaataaaattgagttctctgttctgtctatataattaacgtacttcctttgcttagaatcatcctcagcaattcacgttttccagtcgggaatggatctcctctaaaagtttcacaaccatagtaacaggtcatgagaatcacattaatacaaaaaaactttctcatgattgcactacttcagcataatgaggtaacaacatggagaatatctttacaagcaggacaagaatagctgcccttctctgccagagttgaatttccatcagggttactgtctatcactacaaatccccagggctcatggaaaaaaacaaacctgctcaaagacctcccttcaaagcacaggtattccagccaaggaaagcttcaggagaaacaaaaaatgaactattttttcacagtcccttgagctgtttagaaaaatcccctcacagatactgctttaaacataaaagaaagaaatagaccgatgactgcctaaatacaacttaaccactgtctttcctcaagaaaggcctcagaaagataaacaaataaggtaatcctcctcagaattttcataaaattgaatcttgttaagcaagtttactttccaaacatagcagattttcaggaggcttgctataaatgtaacctggtataatatttcatatttaataatttgttttatttttatttcactggtctctctttgcttccttcccctacactcctcaaccaaccctttgcttccttcccctacactcctcaaccaactctttcagtaccacagatacctatctgggcatcggaccaggacctacactgtgccaaatgtcagtccttatgaaatccactaccttttttttttttaacttcagctcgttaaaagccttgagcagtagtcagaagaaaagagaaaaaggaattcatgtcagaaacacattatccatttctctatcttccacccaaaggactgtttgtcctctggtattttcccctttgctaactcaacagagaatgacagagactagagccaaaaatcaagaaaggatgcaactggcccagaagcagtaggctgtgtctcttacaattggccttcccttgtcagggctctgagatactaacctggggtccagaggagctctacctcacagtccagggtcccacccctgaaaactacaaaaaaagagatagaagagctgtataaatacaattaatacagtgcaaaatgtgtaagggacagaattaggcacaaaatgaagaagagtcaccgagcagcaatggaataaaatgtcttgtgagttaggagactgggcactccatagaggtcaaatgcagggtttctagagtcagatcatctgagttcaaatgccagctctggcacttccagactctgtagcctttatcattgaataaacatttattgctcacctattatgagccaggcattgggctcagtaccagggatgtattggtccctgctcttggggagttaattaaagtgcagcagtccccagcctttttggcaccagggaccagtttcatggcagacaatttttccaagggatgagggggatggttttgggatgaaactgttctacctcagatcatcaggcattagattctcataaggagcaggcaacctagatccctcgcatgtgcggttcaccatagagtctcactcctatgagaatctaatgctgccgctgatctgacaggaggcagagctcaggcggtagtgcttgctcagccaccactcacctcctgctgtgccacctggtccctaacaggcaacggactggtaccagtccaggccctgggagttggggagccctgttctagtgggaaggctattaatgaacacacagtaccagaaaaggtaccagagagtgctaagaacaacacagggaacgtaaatacagagatgcagtcaagagtgactgggagagctactttctaaagtcagcaaggaagatctctgaagaggtgacattaggcctacatctaaatgacaagaaggaaccagccaggcaaagatggaagaagagagatgtgcaaaggccctgaggaagacacactgggcctttggagaaatagaaagaagtccagtgccacaaatcacttcagtatggctcacatttatcatctgcaaaatggcggttgtgaggattaaactgttagcaccacatctgcacacagaatgtgttcaattagtgtaagttgctagaatcgtcatcatcagcagcagcagtgagatgccatcattggaggtgtgcaaacagagactgggtgagcacatcacaggaatggctgggttatagggcgtttaaggttccctcaacaattagatcctaagattagacaagaagagaaaatgcaaaggaagaaatgataaaattgttacacacaggcttccagcccaaggtcgcttgaagaacacattgaattatccaaaaatgtgaagcttgcccaactatttcattcatcaaacagttctttcccagctgagagtctataatcccaaactgtcaagaactccacatggagccagctgacacactgtccttagccctgaggtctactctttctacagggctctgggataaaaccacaacaacactgacagcaacagaaaaggatgacttattctgtgttactagctttaatgtatgttaattattgaatgaaatagcagtgaggatattcttcgattgtatatgcatcccaaaccattttattatttcatgtttaaaatgttccaagcagtactttctgcatcacacactctactggcaataaatttcactttttaaaaattcttagtcttggcctattgtttcaaaatatttactaacttgttgaactttctaaagcctactaattaaggctgttaataatacagtacttgatgatgaacttggcatatgtgcttttaagttagagaaagacaggtctacttttacccaacaccaaatccttggtcattatagatcaaattctttccagttcctttctaacactcacccaaacccaaggcaagtatactacaaccataaataaatacatggctttgtatttatgaaactacttcattacgtacccttgacaacttcctatttctgtttagatggtagaaatggctttaaaattataaaatttaaaaaattataatattcaaaatggcatgaaacaaagtaatactaagtgaggacaataaaaataatcacaataacttaacataaaatgcatagacatttttattatgccaatttaattatgccagccttttggattgtccaaactcgaggatttggagagcagaaaccacactctccgtccccccactttcatccaatttccccccaaaaaagaaacctggaagagcagatgaggatcaaaattttcctaaaggaaagtattcccttttaaaaaatggaaaagcaaccaatttggcatacagcatgtagacagaggatctttaaaatacatatatgatatgtagacaattcctatgacttaatctaaactaaaaatctcttaaaatatgtaagttttagagtaccatgaaatattacctctgtatagtaagcatttgccttaaaagaatcaaaaaaagtcccttagaggaagccagattgggactaatgggtccattcaaatccaaatttatctactggcttttgcaacataattcagccaaaagaatgtgattcatatctgagctatgtaacaactaaattttcagtgtgttttgaagtagatgccaccacaaaaaaagtaatagtcataaccttggcatctaaacactctaagcaatttgataatctttaaaaatataagaactcagtaatgtgggttcattgaagaactttagaaaatataaatcagcaaaaaaaaaagtaataatctcaaatgccaagatgaccactattaacatttattgtatacttcactaaatttttaaaaaacatttttcatataaatgacttcatataatacatacttgtttacttactatatcaagaacacatttctatattcatacacacacacacacacacacacatcacacacatctgtatcactttttatgaatgcttaatcttctactttatggatataccctaatttagttacctctactgagatcatgtatgatctgttcagatgtgctagagtaaagaaacagaataataggtttaaacaactatttcctaaagctatttgaccataacatccttttgtgaattacacattaacaatcctagaacttttgatcttttcgaaatactttgggaaataatgatctaaccaattcctaatattagattttcatggtgtttacaatgttttctattataaatgatactgtgatcaatttcttgagtgtacctttttatgtattgcctagggaaaaactctagaaacagaattactcagttaattgatatgcatgtgttaaaaacatgttatcatttttgccaaattgttctccagcaatattttaggttcatcagcctttttaaaagataattttaaattaaaatagtttgggagtttatatgttcattatatatacacggtatttctgaaattagataattactcttttatggacacggctaaagtacaagttataaatatcaaaggtcttactagaatgaaggctgactcagaaaactatttaggaatatacctcctcacaatttatagaaaatgactagtatggagacattaaatcgtctctcttccattttcctctgttatatttacatatgtctgaatatgtattccgtactcctaagatgatattaataatcccttacatttttgtagtaccttataccactaaaacatttaaaacaaaaagaattttacaggaagagaacatcctcaaagcatattttaaaacaagatattaagctataccttcaaaagacccgtcaagctacacaatagttgctacatatttacagccaaatctgtaataactaaaatctttatcaatcaaccaacaccggtatcatggaggaaaatgtgtattttaagacagttaatttagatcttattttcactgtgtatttctacagtttcacataataagaaacaagctcctaacagaacataaagatggttcacacagcaaaaacaggctttgggttccttttttgtctttaaagtgacactggatgtaattttatacctcaaagtaacttttcaaagttacttaagtatagtgttcacactcagggtggagttctgtgtaattttcaaggctgagaagtgttctgcctgttcaaaaatatctcccctttgagtttgtctcagaatcatatttgaagctttttaaaaatacagaaatttttattcaatgggtctggaatggagccaatgcatctgcgttttttaaaactccccagttgattcatctgtacagccagagtcaaaaagcactcggttatataaaaagattggaggagggggtggtatcctgaggaccccaatttaactgttcgtgtgaaaaccatgaatctgtctgagtctggtttattagattacctaggtgaaaattttaccttgagaaggctcataagatatttcaaggtaggacacctgttggcctatcaatggctatgaacagggatgggggtgaggatatatggtaatgaaatcaaactgtgaaagatctttcctgccagaaactgtggcacttcctacattaagcatataatcccttcaatttccagaaaatagaaagagaaatgttcggtcgtattttattttaatggagtagtcttccaaatgaacaacctttagctacaagcagcagtttcactaagcacaaaattgggttgagaaaggataggacactcagagatattataccttttacatataccttttacaaaattatagtcatttgtcagaattcagtttcttaaaagaacttcacctccaagaagttcttgcaagaacaatgcaaatcaatccaagaaacataggttttctaaatacataaaaatccatagctttcttgagcttcctttacctaccagatctggacttaatgatatcactgaattcgttctgcccattgtcaggactggcttcatgttctccatacttggccatcttgccagagtttcaagataatccaaaaactttaccaagtcctctttctaaggctttcaacttcctacgatggttcagcttgacatcaatacctaaaaggaaaagggaaagtactgacttgaaaaaatgtatttatatattttatatagttattcgtagtaactattcattcaccaaatatttattgagtgcctaccacgtgtaaagcaccaagccaggcaatggtgttatgactatgaacaagagacatagcctctgccattacggcgcttatgcacactaagcaattaattacataatgaattatttcattacaatactgacagactacaaatcatacaaaggagaagcacagagtattaagagcacacagcagaggagtctgacctgccctgggcaattagagaaggctttcttgaagagacatttgagccaagcctttaaagatgacaagaatttaattagccaaaaagggaaacagaaagagaaaaggtaagagcttcctatgtgaagtggcagaaagaatcatggagcagtcaaagaatggagcacaagccagtgtttctggaaagaagacagccaagagacaagtgtacctgttgaaccaggtgaagaagctgggcaggaccagggataggaccatggagaacaggtcaagggtttgtgtctttatctgaagagcaatggggagccagtagatggttcgaaggagggaaccaacatggtcaaattggcctttttaaaagatcgtcaagggacgggcacggtggctcatgcctgtaatcccagcactttgggaggccgaggcaggtggatcacgaggtcaggagttcgagaccagcctggccagcacagtgaaaccctgtctctactaaaaatacaaaaaaaaaaaaaaaattagccaggcatggtggtgtgcacctgtaatcccagctactcaggaggctaatgcaggagaattgcttgaacctgggaggtggaagttgcagtgagctgagatcacgccactgcactccaccctgggcaacgagagtgagactccatctcaaaaaaaaaaaaaaaaaaaaaaaaaaaaagacgattgtggcttgtaggtagaccacagtaatatgtggggaaccagtgaagactatggcagaatatagcaaaatgcaaattaaggaacctagctcatgggtatatgaatgctgaatgaaaatttcttgcaactcttctgtatgtctgagaattttttcatagtaatatgttggggaaaaattcctaatcttaaccaagtgatcaaaattcacataaccaatcatggggcatcatgcaattgaatggaaaatcaccacatcatctacacaatatccttgccaagatgttgaacgtgaatcttctcatgagcagacaaatctagactgtggctagttttcaaaagaaatggcctggtttcttcaaaactgtcagcgtcttgaaaaccaaaattacctgggagagggggagctttgtgaattaaaggagactaaatagacatgacaatgaaatgtaatctttgattgaattcagaattttaaaataaaacatttgaggatcatttgaaaaatctgaatttggactatgtattagacaatattattgtatcaatgttaaatttctttaacattaattatggtattgttgcaggagaatgtctttgattgtaagagacatgtggtgaaatatttagcaatgaagtgtgatggtatcttcaacttaagttcaaacagaatagcatatatctgtctatactgatataggtatatttaggttgatatatgtatgtagatgtatatatgcatacacacagacagacagaaaaatgcagtaagtattgtaaaataagtgggaaaactaggccgggcaaggtggctcacgcctgtaatcccagcactttgggaagccaaggcaggtgcatcacctgagttcaggagttcgagaccagcctggccaacatggtgaaaccccatctctacttaaaaaaaaatacaaaaattagctgggtgtggtggcaggtgcctgtaatcccagctacttgggaggctgaggcaggagaatcacttgaatccaggaggcggtggttacagtgagccgaaattgtgctattactctccagcctgggtgacaagggcaaaattccatctcaaaaaaaataaagtaagtgggaaaacttgttaaagggcatctgggtctaggcgaggtggctcacacctgtaatcccagtactttgggaagcttaagcgagaggattacttgagcccagaagtttgagatcagcctaggcaacatggtgagaccttgtctctactccatgtaaataaaaattttaaataataaaataaaataaaataaaaaggacatctgggtgtttattgtgctattctttctattgtaatattatatgcaggaaacaagtgtggtctaaacaagagtagatagaaagaaatgggtgaatatgtgggatatttagatatcaaagaaagtcaataggatttgggaattgattggatatgagagattcatatccaatgtgcaaaatgtgcaaaatgactccccaattttggcttaggcaattaggtgaagtgtgagtcattgagctgggcaacactgaggatagcaggctgggagaaaggaatcatcaatgtgatttggatttgcagagcttgaaatgcctctgagttatataagcggagatgacaaaaagagagttgggcccagcatggtggctcatgcctgtaatcccagctctttgggaggctgaggcaggcagatcacttgaggtccagagttcaagaccaacctggctaacacttgaggtcaagagtttgagaccagcctggccaacatggcgaaaccctgtctctactaaaaatataaaaattagccaggcatggtggcaaacacctgtaatcccagctactcaggaggctgaggcaggggaattgattgaactcaggaggtaaaggttgcagtgggccaagatcgctgccactgcactccagccttgacgaccgagtgggtgagactccatctcaaaaaaaaaaaaaaaaaaaagagagagagagagagttggatataaaggattggatcatcaatctgacagattttatgagagtctaaaaaacttttttcattttttataggctctactactgctaaaaatttatggattattatatgattacattctttcattcaagtacataactataaaggatttgctaaattcttaagtgtattttattatattcaagaatcaaaaactttgttcagaagaatgtctataaaagtttatcatggaaaattaagtttgcccagggaaaaattctctttcctggaaagaactacagtgtatcactttggagcagtaagtctaatgcttttcttcactattggtcttagccaagatctccacttctatgctacccaaagcctttattcacccataaaagagaaaagtcaactgtttacacactactttattccatttgcccattatcagtaacacttcttcactataatgtttcacttgccactctcctcaaggtgatttttcaaatttttctcttcttgataatgaaaatcccttacaggttgcaaagatacagcagaaaaggtgatcagagtacagaggaaaatggggagaaagaagaataacagaaggctatttaaatagtgatagccactgaggttacttgccattaatggccagaggaatttgagtacacttaaggcaaaggatgactccttctaattgccaaatgcagaatctttggttctcaggagacagaatcaaagtttcaccacgaacaatgcatcccagtgtgaccctccgtcttccacacctataaaatggagggaacaccatcttcacagaaggctaggtgagaaactgagaatcaatgaatgagatgttgctttagaagcttcaagccctatacaaatgcaatttattgttacctctgccctagatttcccttccctcaaatgatattctgtaaaagccagatgttcttactgaaaccaatccagtcaagtcgatattcactaactctcccttcagaacgcttccggctgtcatatggaccaccaagcaagagtgtatgaaataaacataaggtgtttaaaaaataaacataaggtgacagccttaaagacaaaactaatgtttcaattttttaagattttaggaattatacaatgaatatatgtatataatttttattttgtactatattttatgtatatagcacatatatatccaacagtgtgcattatgatggaaatgctgtgtaatgcaaacactattcattaatttactataggaaccaaaacctaggaacgattgagatagtagaaaaggaagccaagcggacaagagtttgctgctctgcttgaaacacagtaaaagaaaacggtgagtgccaagaactgccatttacactcggaagcgctccagggaaggttaatactactgtgattaatactgtttacagagccaataaattttaggtaaacacccaaaggagagttaaagagttgtctcatcggtcccataaaggctggtaaaaggggcggggaatggttccacgccaaccctgtccgtcaccgcagaactacccacaagcttcgcattcctccacctctcccctgaccctgagctatccgcaggctgcgtctcccacgcccaccgccaacgaaccgggagggcccagatcgacttcctgaggccggtgcaacttacaaaggaatggatgcggtcgctgccgcccggccgggcggccgggagggtcggctcagacctagggaatccggcctcccccgagctccgcgcgctctggccgcggcgaccgctgcactgaccctcccaaccgcggcagggggaactggcccgcaaggccctggtgatccggctgacctgaaggctgggaaagaggaggccctgtcctgaacacctcagagagcggggccgtggagttagaacccgagctctgcagttccttgtaaaataaagtgctggtcccacagctctctcggaggtcgggcaacgttttctccctcctcctcgaaaaacgcactggaatgagtccctttcataatctgaggcttggaggaaaaaatcctttgaacaacctgccatctgaaagttgcacagccttcaattggtgctttgttggtttttaagtggccttgagcaaccacagcctcggaccccgggccaaagcggggcatgaattaccttgtcagttgcagcaagagatccccagagtccggaaaaggagagccggcgactgcgcgggactacacaccaatggggcgcccccctcctcctgtcccctcagtctctccagggccgctgccagggagcttggcgatcgcgccacactctccggagccccacccttgggagcagcaaccacccagaggtcaagcacgttccccgccgggcggctggctgggaagcgctccgctggccgccgaccacacagccaccctctgcccaccctctcctgtggacaccgccggagccccgccttccccgggcccgggtgtctgtgacagactctcctaagaggccacgtcccctcttgcaaatcactggcccagcgccctgcaccgcgcgatgcacggagggcgactctgtcaccccggcggggaggaagattaggggagcagggaggcagcacagagctggtcagataagtttggatcgttcacaactagtacggatcccaaggacctccacgcccgagctctccacgcctccggcattctctctcgcaccgcggggagctaaactgaggccccgaggaaagggcacgcaaaagttactcccatcttcgactctgggacttgggaagcagctcgggacgccgatcccaggcggaagaaccacagaaagagccatcctcctcccggcccccgccccattccctcgggggctgtagtcacattaccagcccgaggcttcaataatgcatgggcttacctgctgcccgcgggcctcctcgcctgccggtcgccaccgccgcaccccgagctggccaagggctcctctaggagtttgacacggagtaaccgcgggggtgtgtgcgagtgttagtttggtggtgcgatgtatttaaaaaaaaaaataaagcttggagaagcagacacgaaccgaaattttaaaaaaagaaagaaagaaagagaaattgacacccgactgaaaacgccccttacttgtgcaatcttcctgcctggtagttccgccaaaaacaaaacagtcaaagcgcaaacctggaaggggcgcgcaggcaccaactttgccaaacgctacagagttttccgtttgcagaaatgacccaaaagaaggggggcgccgctccccgtgattccccaatcggcttctggagccagaggctcctcctcgcccctcggcgggagaaagcccgcggccggctgctgctgcccgcttccctgctccgaggaaaaacgactccacaactttgtgcgcgagagaggctcgctccttcggcggctcctcctcctcctccccgctgcgggcctgcccctttgttggagccgagcgctggaggcggaggagggagggtggggcgcaggaccgctgggtcgcgcgttgccgcccccaccccccgggaaggggctcgcctccgggcagccaggggtccgctctccagatgagaagggtgcagatcagcgccagccctccggcccgcgcctctgcagcgctccggctccccctcggcgctctcgccccgccgccgccggcccagcaactttgttccggaagatcagccccactacgttcccgggtcagcgtctgccgggcctcggcggtcaccgcggccaccgcgtcgggaacttggcgccccaagtcacctgactgcgcgccccgtcaatcagcgccggccctgcgcgccctcccagcccgcagcagcccggctcggcgcttggctggcctggggcgcgcgctccagagtgaaccgtgcgtgccgggagccgggagtccggagaccgaaccagaatggatgcctcgagcagacacaattccccttattcagattatccgaaaatgtgagtcacgtccccttaggcaaaacaggtctctagttagggtgatatttttttaagagataaattccaatctgccttccaactcaccccatctcagtttgctgacgttgctgattttttttttacccctagttccaaccgtatatttattttacattatttctctagtgtcgttgttaatattgaaaaagaagttttctcttacattagtttgtattacaagtagtgtttgcgctgaccttatttttctgttttccaatatgcacacacaaacgcacatctgttatagagcctgttccaagcttgagaggttgaccaaaaaatatctgggaagaaatgagctcgtgatgtgtgtgcatttttcttatttacacatttcattgctcgtgtgttcctgtgattcttttacacgatcagcacacgtgggaggggaaagaaaacagcaacctgagttcctagttcgtattaacagagaaaaggatggttgatactggagcgccggtttattgctggcttaatatttgagttaatttacgcggcagtaaagattaaaccactaggggccttaaactaattttcagaaagagtttactcgccttttgttatagtgaaagtttcccccatccatccctaagtgctccagggagggggcaggtaggagattcccaaaagagactcttccttgtaaggtttctaggacagtttccttccttttgatgattttctacgtataagccaaataaaatccaaaggattaacttgaaatgggtatgattttattcattcacttcattcattcatttaacaagcatcagtttagggctgtcaggtttgctggttctgtgggtaaagcaaagataaatctgatagtgatcttacccttaaagaacttggaatgtagtaggtgagataagacatgtaaacaagtaagtatatacaagatccgggagataaatgccataagaaaagaacagatcaagtgctagctgagtatggtcacatagagggactccaggattttttctttctttctttctttcttttttttttttttttgacagtgtctctctcagttgcccaggctgcagtgcagtggcgcgatctcgctcactgcaagctccgcctcctgggttcacgccattctcctgcctcagcctccctagtagctgggactacaggcgcccaccaccacgccctgctaattttttgtatttttagtagagacggggcctcccaaagtgctgggattacaggcatgagccaccgtgcccagcccccaggttttttttaactgatcattttgcagacaccaaaagttgcttatcactcactgtatcctggttgagttgatgaaactcagattttctccttcaaaatagataataaggccacattggagtgtttgatgatgttgtcacttaaattaatatttgtgacacttttcacaatttacaaagtaatacatcattttagctcaaaaattttgaaaaacgcacgtttagggtcctatgatttctgggattgtaagctgtgaggagatgtttagtcgagcttcctcaacgcctgtaagagatggaacaggaggccaacaagccaccttctgtgcaggagtgacctgccccgcatatcagccatagtggcttacagccagttacctggggacctgtgccctatctgtttctagcccttctctccaggcagagactgatgctctttgtaggtaatgagcaaaagaggctaaagaaattcttgttgactgggtgcagtggctcacacctgtgatcccagcactttgggaggtcgagacaggtggatcatctgaggtcaggagttcgagatcagcctggccaacatggagaaactctgtctctactaaaaatacaaaaattagctgggcgtggtggcacatgcctataatcccagctactcaggaggctgaggcatgagaatcgcttaaaccccggggcagacgttgcagtgagccaagatggcgctactacactccagcctgggtgacagagcaagactgtcagaaagaaagaaagagagaaagagagaaataaaggagggagggagggaaggaagaggaagggagggagggagggcggaattcttgttgatggaacgatcaagagatctcaagctggtcctgtgctggtcctgtcccccaacactttctttatttggtagggaaaccacatttggtgggcgatcttgaccacagagggctatatttccataaagcacagtgtgatcttcctttatatccagagaatctaggtgaggcacggtggagacaggcctctaaggtaatgggcctgcaacaaggatgctcagtggggttttgtctgctcatcccaaagatcagatcgctgtagaacatctggagagaataataggaatgtggccctgggtctactggtaacccaaagtcagaattgccctgctgtcaccacagaactgtgaaaattaaggaaaatggagttagtgtcactgcaggatagaaagcctttgacaaaggagaaaattatgatatgagtagtgtatatatagattcatatataaagatatatgtatatgtgtgtatagtgtatatagacatgattcacataaatattattcccatacagggaactgcatcctaatataagaaccaaaaggaaaacatttgctactaaactttgtgcaagactatataaatgcagtttttctttaaacagtagaaacaggggaaaatacacaatgtataaaaaaacaagacactcctttagctttacctttggtattgactataattaaagccccacatacaagcatttaagagaggaggaaagtttagggaatttagcctttcttatatttttcaggtaaaaaaagtataaatctggagcttgtgtgtaatagatactggatttttgctgagtattgttggtaaattcttcagtcaaacgtctagtatgtgtgcgagttgataaaattttatcatataaatttttgtaatagaattgaagaaacaaaaaataatagcacatgaaacttttagaaaataaatagtacaaaggctgagttccttacaacttaatgcactcaagaattacccagagaatatattttaaattcagattgattgccattccccagaaattctgattgactaggcctggtggggcccaggaagctgcaggtttaacatgccttagctttagatcagaatagctgaggagccacactttgagcccctgtgccctggggtgctggccttaaataggccactttggatgattggaggggtcaagaaattgccctaccaaaaaaaaatccatactgaatcaatcataattatgaaatacccgtgattagctttatctctttgaattcaagtgtttcattcgattcggaccaccctggaggttacctacaattggtaaaaccctaggactattcctggcaatttaacctgcacaggtggtaggaagcatggcccagttctgaggaaatgaggctctgaagagaaagtttaatgatgagaggacaaggaggacaggaatattgagaatacaggagctgaaatgtggaatccaaagaagctaagggcaaaataaaagcactaagttgttgggcagagaagagcaactgattgatcaaaatgggagaataaaggaagcgccaaaaagagaaggaagagacgcagagagggtggaggatgggaaacccagagcaccaccttcggggaaaactgaacaaaacacagtctacgctgagtttatcctacttataaatttttcttggcttaatttaatttgtataattttataatgttgttgctgaaaaagattttacagagtctttccatcaaccctctgaatttttttttttttttttttttttttttttttttgaggcagagtctcgctctgtctcccaggctggagtgcagtggcgtggtctcggctcacttcaagctctgcctcccgggttcacaccattctcctgcctcagcctcccgagtagctgggactacaggcgcccaccaccatgcccggctaattttttgtatttttaatagagatggggtttcaccttgttagccaggatggtctcgatctcctgacctcgtgatccgcccgcctcagcctcccaaagtgctggtattacaggcgtgagccactgcccccggccaaccctctgattttacaaagaagcaaatgaaagatacaaagctgatcagggaatacctttaggtaaaataaaacaatctattgggggaaagtgtccaaattactgagaagtgaaaagagaagatccctatgttacatgagttcattgttaaccagaagaagaggggagaaggtgggggaagaaagcgagcgtagccgaaagagaactggtctagattttagttacctaagtactcattatgatattgaaggctattagccatgtaagcttgtggaacttaacctttagcttcctacctgtaaagtagaaagagtaataccttctgcaagtgttgtgagaatcaaatgagttagttaacataaagcatttaccaccaaatctggtactttttacttttattatgttcctttcccctttctcttaactcaagaggattggctgccattttgtgattgtcttcattcattctttattgaaaacattcctggaacttccattatctgctgcaaagcaggatatgcaaatgggataggccacagtggttaccttcaaagagctcactgtctcgtgagaaagaccaacacatagatagacaattataaattaatagggtacaccagtacagccaaaatgtaacatgagccaggagagggacacataacccaatagaaaggacaggaatgggcagtaccaagaagtgacacctgagttgagccttagtggttgagtaggaatcctaaaaggcacctgttgtcttgctgtgcccaacatctttccactcttattgaaggaatattactccttcctttggagatttc

SEQ ID NO: 3 - DNA, 503548 bp, Mus musculus
ggtttgggggtagctgtttgaagttgaaggtgtctgtggcctagcagaccctactctgaatttctgggggacaaagggaggactattctgaatttagaatagtctccctgggggatgatggttagctccttggattgtgtttgtgttatttattgtcaaaacatttcatgtgttatcttgtttccttaacttgattacaaagaattttatttgtagctatcctcaacctcaaatttcaactcaccagtattatgtgctcgcctgaggaattcttaaacgagtgaatattctaacacctcttacatatgcagttttattagatattttaatcggaaaaagagaaggaaagcctttcccctctcttccgtgtgggtttattcatattcaacactaatggaaaacacgaagtgatatcttgattttaatatatatatatatatatatatatatatatatatatatatatatatatatatatatatatatatatccaggcatggtggtgcaagctttaatcccagaacttggagggcagaagcaagtggatctctgtgagttcaaggccagcttggtcttcatagtgagacactgttaaacaataacaacaactaccaaacaaaaactctgtcaaatcatcacacacacacacacacacacacacacacacacacacacacacacacatacacacatcccaaccaaacagaaacacaaaaacacacattgtatagggggctggtgacatacctcacttgataaagcaatttgccttacaacttaagcttgatccctagacccaagattgcttgtttgtttgttttctttctttttaaagctgggggagatagctagcacttgaaacccagtgctgggagggagagtattagatagatctctcgggtttactggtcagctacctagtctactcagtgagttctaggctagtgagggacccttaaaaaaaagtgcctggagaataatccttaaggccgtaagggtcctctggcctccatgccctcacatagggacatacacatagacacacacagaaagatagcacatgttttctcatgtttctattctaaaagaaactgcatctatacttcatctctgtctctctgtctctctgtctctctgtctgtctctctctcttgttgatactgtgatactgatgattcaacctagagccttgcacatgctaggcaaacatttcgccactgaacaacgtccctgatcctcttactaaggtgctcaagctgtcctcaaacatgcagtcctcatgtctcagtttcccaggtagttgggattacaggcgtagcccaccatgtccggttgtatttacatgtcatgtccggttgtatttacatgttattgcacaggttcagtagataatgttttcttctggactgctatattatatacagtcccctgtatttatgtggatcatgcccatagagtaaacatatgatatatacatgtacatatattttatgtattactctctctatatattactcatataataattttcccttctataaaagacttcccttacaatagtaacatcagtataaacatcttcagtcttcattattcagtggccacttagtgtaattactacttcaggttaatcatgggcccagggtcatgttcctatcactccctccacatgcttcatagtgatcattccagcagcctcagtgggcagaaggttctgttgtcacaggccactgactacccagggtgcattaaaaggtggacggctggttgcagtgcatcaatagtcacccatgcctcctggagacgtgttcacagtccttcaaaatgaagctgggctgaaaaggtctcatagtgactgctcttatggaaatagagccctttgtagtcttagtctcctgccagatgtggtttcttctcctaactcagggtcagggtgggaattcttgatcacagccaaactttgatctttttttcctcctctgtgactcacccacacatatgcttgctcaggttgccaggtaccaaagggcctctcttcccagtgatggccgactagtccatcttctgatacatatgcagctagagacacgagctctgggggtactggttagttcatattgttgttccaactatagggttgcagaccccttcagctccttgggtgctttctctagcttctccattgggggccctgtgttccatcttatagatgactgtgaacatccacttctgtatttgccaggcactggcatagcctcatatgagacagatataccagggtcccttcatcaaaattttgctggcatatgcaatagtgtctgggtttggtggctgattatgggatggatccccgggtggggtagtatctgaaaagtggatattagcccagaaacatagaacacccaagatacaatttgcaaaacacaagaaaatcaagaagtaagaccaatgggtggatactttgttcctccttagaatagggaacaaaatacccataaaaggagttacagagaccaagtttggaactaagactatcatggactatccatgaagacttcttatgttggagactcagtcagttgctgaaaggtaattgttttatgaagtttttgacttaataaatgggttaagtcacttggtgaatgcataattcaatggaggcggacctacttggagacagtaagttagtggactcatctctttggagggcaggtctttttctggacctccttctggatggctttctgcttcctgacagccatgaggtgtgcacactccaccacagcttctgctactcctcaggcccaaaagcaaaggccagcctcagcctgaatcggatgaaaccgagagctaacagaagtcttacctgtcagtcacagagatggtaatctatacaacatgtttgatctgatagcaggaatctccaatgtttttgcttacatgtcttatctcacctgaatgaattctacgttcttcaagggcaagatctatgttggatttctatgtatcatctgcctcagtaggccttatatagatgcttgttaatggaaggaatgaaagtgaatgagatcaagtcatatcagttcccagttggtgtttaggttctatttggcttgtatgaagaatgccctccaaggtgaagttgttaagtcagagactttataaaaaagtcttttccaagacttccttcagtcccagcccacagtacttagagactccagaggttttcaactggtaattaacacaaggctagtgaattatttttactggctcataaattaacccttgagtactaaggaagcaataagccgtaatcaatctgcttcgactttggttgctatttttatttccttctccaagttttatcaggaaaacagtaatgggaacacgttagaatgaaatgtataataaaaatgcatacataacacaaacttcattacgtccgtgataggtctcggctaagcccgtaaactcccaacaagttctgcaaacagatgtaagtttgcttggaaaaatagaaaataaataaataaataactagataaataaaggtttggcagatggtgccactggtaagacccctactgaatactaaagtctgaagacctgagtctgattcctgggtcccacagaaaggtgtaaggtgaaagctggctctacaaagttgagacagagagaatttagataggtatgatatttgtgtctactgtcaccagcaccccaaatacacacaacacacacacacacacacacacacacacacacacacacacacacacacggtaaaaattttaaaggtcagcaccaacactatttgtgtatatgaacatataaggacacttgggattgtttagacagcatttaaaatgatgcaaaagaaatttccataaaataaatatacccctggatttagaaccccaaactcaacaacctcagtaaactgaaatggggcgaattggccagaaggttgagatttatgtaagataataataaaaaaaattaaaagtactgttgataagagacctagtgtgcctagaggggtgtgacacacattttcggacaatttgaataaagggcacggtgcgtgcgcgcggtgactattccagcttctggcttccagcacgcacgactggttccgggattctcgcaccgcgcaccgcacggagccggctgctgcgggctgggagggcgcctagggctagcgctgattgaccgggcgcgcggtcaggtgacccgaagcgccacgttctgggagcccggcccgcggtggcttcccaggccggggcaggaccgaacccggagccgagggggactggtctccccgggagaacaaagttgcccggcctggggccccggggcgcgcgagcggcgagacggcgggtccgacctgcgggatccacggctccgaggctgggcgattcgtgctgggagacgcgagcccctacccggggtggcgggcggacccagcagcgccccaccctcgctctccaacaaaggggccggcggcagccggaggaggacctggaggaggagccggagcggcgagcagctctcgcgcacaaagttgtggagtcgcccttcccccgaggaggggagcgggcagcgccgggcgcgggatttctcccgcccagggccgaggaggagccctgggctcctcagccgatcgggccacctcggggagcggcgccccttttctttcgggtcattcctgcagagggaaaactcctgcgtgcgcctgcccccaggctagcgtttggactgttttgtttttggcggaactaccgggcaggaagattgcacaagtcagggggcgtttccaatcgggtgtcaattttggatctcccccccccccacccccctttggatcttgtcgggctttccacgtttcacttaaaaaaaattcttgtaacgtccaaggcaagctccccaccacccgaacacgcccagaggaaccttggggcctctgggacttggctagcaggtaagcccatgcattattgaagcttcggtctgggtaatgtgaccgcagtcccctagggaatggggcgggggttgaaaggaggtgggacctttctgcagttccaccgcccgggtcccgaagtagctgtagccaacttctgcactttccctggaagctcagcgtcccctgcctgggcgggagagagctgggttgagaaggtgggaatctgtactggtcgccaaggtctcagattcctaggtctagtttagtactgttgttttgtctctccctgagaggagaggctgtctgtcgcctgtccgtttaccgccccgagccgggcagcaggactagcgatctccaagaggggacgtggcctcttctgagagcttgtcacacacctccggtcccgggaaggcggggcccgggcggtgtccgggaggagagggtggggagggcggttgtgcggtgggagggttggggagagcttcctagccggcctccaggctgggggcgtgctcgacctctctgtggttgccgttcctgagggtggggccccagtgtggcgaggtggcaagcctgcagctgtggagagacagaggggataggggtacctcattggtgcgcagtcccgcccggccgcctgcttttccggactcttggcatccctcactgcaactgacaaggtaattcatgcccctctttggcctgggtctgaggctctgcttgcccaaggccacttacaaaaccaacaaagggctaattgtaggctgtgcaacttttagaaggcacattgttcaaagagacttttcaagtccctggattccgaccgtgtggcgttccagggttatttcaaggggaggagaaaacgtgtgtgactcttcagagtcagggacccgccttttttaaacccccaaattggagatcctgggtgtaattccgggccccactctctggagtcactgaggtatcatcctttattcttctagccttcagatcacctgggtcaccaggatctggagaggtggcctctccatgcgtttaagtgggagggtctgccgcggccagagcgcacgaattccaagagagatgggatctccagggtggcatggcagcagtctcatcgtcccgttggaacttgccctgggcctgtgaagtcaggctggaccctcgggggctggctgctggtggcgctggagaagcagcctgctgataacgctagtgcctgccagagctggaggaattcgaagctcttgtgggtcgttcagtcccgaggacaaggcagtgaggggcatgggccattcctgctgaagtccccccaccccctcaccagcgtttatgaggctttcgagatagctttaactctcctttgggtgtttactcaaaatttattgcgcctgtaaacagcattaatcacagtggcattaaccttccctggagcgcttcttagtgtgaatggcagttcttggcactcagcggtttcctttacaagcagaagggcaaacttgttcttcggcatccctcttcactatcgccagcattcctagcttttggttacttgtgagtgactaggtttcctccacagccgtctggatgaatattcccttaggatgacaccgtttgaatgttgtgtattcttgaacttttgcctataaagccatcacccctggcgttctgttctggtataactaagaagcgtccaccctgaagggggaactggcgcctgtgctgtggtgcgtgtaggtttcagtaggggaaacactcggtcaacgtcaccagctgtcattttgagggaagagaacggaggacagcaattgcataggagccctatacaacctccgggtcattcacctctagtttctcccttatccgggtgtagagtgtggctacttccattccaccagtgtggatggcggcagaatgtctttgggacacattgttactaagaaagccttggttctagcccaatgtaacttgaacagcctgatagagttgcagtagcattttatttatgttattttgagaaagggtctcactgtgtggcctaggctggccttgaactggcactcctcttgcttcagcctctgaagtagctggggttataggtgtgcaccactacacctggttggcatctgggagtttggaaggaggtatccttaaactctccaactcacatggagctcctgggacattcgtggcaacaagagttggtggctcttaaatgttgttgtttttcttttttctttttattggatattttctctttctttctttctcccttttcttttcttttcttttcttttcttttcttttcttttcttttcttttcttttcttttcctttcctttcctttcctttcctttcctttcctttcctttcctttcttttcttagacagggtttctctgtgtggccctggctgtcctgaactcactcggatattttctttatttacatttcaaatgatttcccctttcacgctgttcaatgttttagtgtgtccctcttcattcttttctagctcattgattttttttttctgatgtttttgcagtgtagtagggatttgtattaggaagaagacacgactggaaaaattatcccaatgtgaaaggcagaatcaaacatcacgatgaaatggcattattggatctatgcaaatgaaacgcaaccctgtgcacaagttaactttacctcaaaatcaaatcggtgacagtgtttgtgtgtgagtgcgtgtgtgtgtgtgtgtgtgtgtgtgtgtgagagagagagagagagagagagagagagagagcatgtgtgcatttttaaaagatggctcagtggttaagagagagtccacgttcactatcttatgtccatttttggcctccttgggcactagacagtcaaggcagacattcacacaaaaatttaaaaaattcatttttcgacatttatttatcgaatgtgtggtgatcaggtttaggggcaggtctctttctaacagagtggaaacatttttggaagcctaactggaggtccctgcataaagccccttgggaagtggcactggacttgtctttcaaaggaacttcattccaggaaagagactttttcttagacagccgggatttcctgtaattaaatgtttacatattctgtggacaagattttggttctctaatatattaaggatacacataaaagtttagaaaatctttcacactctgtacctcaagataggaatatatttgcttttgattatattctttgtagggagctgttccgtgaccccctagtctcatgtagctcaggccgccctcaaactctctgtgtagcagaaggtggcgttaaactctgtcttctccaactggggttacttgttcactcctggcgaaagctgcttggcaaatggccaggctgccagtcctcttcgctggttacttttgactttcattttgtttttgtagttctggggatcgaactcaggaccatgcatgcacaccctgcaggctaccattaaggctcatcctcagcccttttagtttatttttaatttttagacaggtagcctagactagtttgggatttactctgtagctcaggctagcctaggatattgaggaccctttttcctctgtctcttaaatgctggggttacagctgtgagtcactatacccaggtctgtaaatccttaataaccataaagtcagaataaacatttaagaatttttttaatgtcctttaaagtctgggagactgatgaagcaatccatatatggagaggaaatggttcttaaagctttaacagtttcccagtgttccttcgcttctactgcattcactctcattttgctcttattaatggactctactcatttcctgacttgcagaaagaaaagttattatgttgcataatgttaatatttatataataaagtactgtttgctacggtgaatgactattgaataatggaacacacaactattacacaaataagaaatttaaaataacaatatagtacaattcattcttcgaagtaaggattcatgctggagagatggctccttggctcagagcacttcttactttcccagaggctccaggttcagttcctagcacccactgtgggcgactcaagactactggtaactccacttttagggaatggaacactcttttctggctttcgaaggtatcaggaattaacagagacaaaaatgcaggcactcacatgtacacataaaaatattttaaaatcgtaaagaagaaccactaaagaattggtggtccattactacctagaaagaaaccctagttctgacatttgcttctctctctctctcttttttttttgaggtggtgggggtctgacttggcagctcaagccgacctagaactcagtgatctgtcatctcagggatgacagacacaaaccaccttgcctggctctgacgcgtgttttaatgtgtgaattagtgtactttctctgcagattactgttgggatgtcttgactctgatattcctaagtagtgattaagttcattgacattggggcgctcttaaagggggccgtggtctggaagagacagagagactgagctgagagactgagcttggctcctctctgggcagtgtaatccaggaagctcgggagcagagaggagcagtgtttgctggcgttcttaatgaacgggtgctcctgcagggcagatcttcagatctttaggccctggagatatttctcacagttactgaagattggattgttttatctgagtggtacctacccatgtacagcagaattggtgtcatgacccttccagaatgaagtttttatcagtgggcaacatggctatctacatttctacatacatctacaagccgtaccacccctgaggtccagatccgtatttcccgaatgctccctttctctttctgtgtctcagaagcaccttacactgagaaaatccaaaccgcatccattcttctctgtaatgtcctcagcggttcccaaccgagtagtagttcgtctacttctgagctgccctgtgccagctgagtcactcagcatgctagtatcctgcgtctctaatgccagggctgtccctgagtcttattgaccttttatttaatatcctgtgtatctatttattttttttccatctaatccattgaggccacaatcacatattgcttatattaacagcgttataacagagagattagcacaacagatacagagctgctcgtattttctttataacatttacttcctctgcctgtgtgtatctttgcatgtatgcttgtgcgtatcgatttgtatatatataaatgcatagacgtcgaagatcctgtcatacttctcactaatgacttcatagtgtctcctacaatggaagatatcctcctccctaacatcgctgctaactaatcctgcagtgtaacattggtataataatattgcctaaagtaaaccctaaaatgttttctttgaaaattcaacccaggatagtatttggtggtcaggtctcttttgttttgtttaatccatgaagaaactacctttctttgggtggtttttgtttgagtgacactgggcctgtgggatgtgtgtgttgtttgtgtgtattatagtttggaggccagagattggcatagtgccttatttttgagacaggatctctcattgaacctggggctcgctggttggctatgatcctttgtttccagaggaagtagttggaaacaggcattgctggcacatgcccatgcttgcttccctcttttatttttataaaattcgagggattgaagtcaggttcccatgattgtgcagtaggctctttacccacagacccatctcctaattccctaggccttttgttttgatagcctcttccaatttgtgtgcccatgataagcctcatgattgattctccgacagacagagatactcaacagagggtgcgctgtgattccatttatcacctgaggccccattgatgcttttgtaaagtctggtcaagcgtgggattatttttctctaacgcagtagcatgaaacaatttcagatgcagagaagagctgaaatgtttccattcgacatctcctttctcacggcctaagttctttaatgagagcactgctctaatgtactgtagtccttggtgcttcctgagttactctggtctactgacaagccatggtgtgaacgggcttatgtcacctctctgattgtccttctcctcagacaggtatccaagcctctctaggaatctctggccccagctttcttcctcggctgtgtgacgtgcttcccaaaagcaggacttagccccctgcctcccagttctcagcggcgctaatatttcacataccaagctcttctcttttctacttgccctgtagctagtgaacttcttcctctccttgaaggatagacccaaatgtcattgcttaggaaggccttctcagtggccctgggcaggtgtgactcgtccactttatgactttatgactttatctttctcttccggactgctgtcagtcatcagggttgtaatgaggtcattgattatagagtgaatttcattttatccgtgaagctcggtgtccataagcctcactcacgtggaagaggctgtgctaaataaagcctcatgtggatgtgctcaggaagccactccgtaactgtgtcttagactatatgtggctggagatggcttagcagttaagtacttgacaccccacctcagtatccgtgcagatgcccggcacatttggcagcctgtttgtaatcccagcacgtgggatgtgagttcaggggaaccctggggttcaaacagagaccctgctttaacataaaaggtagagagcagcagttgaggcagacacccaagtgtcagcctctgacctccacgtgcacatgcacacatgtacatgcacacccacccctttcacatgtgcacacacagacctgtgccagaagcaaaggaaaaaacaaataaggaatatgtttctgtatttctactcaatactttctcttttcctgttaggtattcatgctagcctggaccatttttcagatttagccttcagaagaggatctgggaaagcctttggattatactgaaactcattcaagatggccaagtatggggaccttgaagccaggcctgatgatgggcagaacgaattcagtgacatcattaagtccagatctggtgagtaatggatgcatcactgtggagccctctgtatagactgtgttgaagacagagatttcttagcttgttgtgcattgttcttgttaagtaaacttctgagaaactgaattctgagccgtgagtgactattgctctgtgaaaggcaatctccagtctctgtgtggcctatcttacactcccagcttgcctttgttacattgtgtgtgcagtagttttactgggagaaactcctgcctacagcataactgatgctgcgcagttatgatgtcaataagatagacaagcttagtctaacatttacccttattacctgaaaacggaaaggaatcacatgcttagagtagcgaataccatagtttctggtggaaagatcattttgtggtgggattccttaaccttttgcccacctgctaattgctgttggatgctaacactggcatgtgaccttctctttccttttagaaatgttagtttctaaagatacagtcttccccagtgtgatcaaatcagccagactaagaccgacgaatgactttcatgtgaacattcggattggaggtctttggatgccaccccacccccagcttattatataaccactgcttttcaattctggctctccaaatgaatcaactgggagtttttttacaaatgcagatgtgttggctctgctccaaacccactgaatgaaaatttctgtatttttaaaagagcttcaaacatggttccgagacaggctcaaaggggagatatttttgagcaagcatggcctttttaagctgggaaaattatatagagttctcacctgggtgtgagcattgtccttttgtaactccagcattataaacattccttcgtgtcactcttcaacaacaacaacaacaacaacaacattgaatagaactcaaaggtgatatttcctgttggaaatgtctgtgtgttatggtaagagttcatttcttagtcgaaactgctaaaatacgtgcaggaaatgagatctcagtaggatatgcattgcccttcgtgatgctggttgtgcttggtctgtgaaacgtctggatgttacagataaggctgtgactatgcagtggtttttgtagctttaaggactctttgggaagtgcgtcggcatgttgtgtggtgtattcactgtgatctcctaaatgtcattttaggggtacagaattcatatgtagagatgtggaaagtgacaggaaagtggaagagagacagctagatgtctctgtacgtctcagagtctataacttgtgaggccaggtgatccttcgcatcgtcccgaatcaacctttattacagaagaccttggattctggggtaggaaggtggctgcgtgggtaaatgctgtcgaagcctagtgatccgcgctcagctctcgggaccccagtaaagaaagggagaggagagaaccctttccacagaaactgtcctcttactccatacgtgcacattggcatgtgcgcagacacacatatacatcaatagtaaataaaatacactaaaaaaaagactttagatatttgtcactggttctctgtctttgtccactagaaaatagttttatggaaaaatttaacttttagagtatattctgagtatccacacttccaaactatttcttaaatttaaaatggctatttataaagttagtaaggtccatacatggctgggggtaatttgttacagtgtatactttttggtgttaagatagtttgtttataaaatattgtggtggtttgaatagctatggtccccatagactcaatgtttgagtgcgtgacccatagggagtagcactattagaaaatgtgtcactgttaggacgggctttgagctcttttgtgctcaagcgacacccagtgtggcacacggtcttcttctgctgcctgtgcatcaagatggctcctccagcaccatgttggtctgcctgcatgctgctgtgcttcctgccatgatgataatggactgagcctctgaacctgtaaggcagccccagttaaatgcttccctttatgagagttgccatggtcattgtatctctttacagcaatagaaccctaaggaagacaagtgttatttcatttactttctcattggtgtgtacatgggggtttggatgctcatgccacagcacgccagtgggggtcagaggacaaatgtcagctttctgtgatgtgccacgtgcatccaggagaccaaacttgggtttcttgctgagccattttgccaaccttccgtgctgctttttttaaatagggaacatcaactgttcgaatgactctgcttatagagtttcttcctaggcagaggatataaatgtacatttaagaagttgactgtagcactgtttacaatagaaaaaaagagagagagagaaagcaccataaaaatccaatttggacatgagttaggtcattgttgcctagagtgtttagaaatgaccgccagttcttaggttgttactattttatttaaagtctgtgttcttagtcaaataactctagaaatagctaggaacttactgtctccttactggggtcgcacagctgtgtggatgacgcagcatcccagtggaggtaattaagatagagcgcatgactgaagcagcgacgtgttcataagaagtgatgatattgaggtgtgtggatgtgagtgtatataaacattacaaacatggagggtgctatgaggtattgttaagtgattatgatacaggaggctgttgatgtgaaaagtaccctttaaaagcttgccggtgggagccggaagatgagtcagtggttaagagcacttgttgcttttctaggtgacctgggttcattcccacagcctatatggtggctcacaaccctctgtaactcctagggtagctaatgctctcttctgatctctgaggacagcaggcactcacacagtgtgcatgcatacacgcaggcaaaacactcgtacacataaaataacaacgtaaacacacacctgctctcctatcaggtgggaggctggaacagggagattttgagtttgatgccaacctgggctatgagatcctgcctccaaaaagatgtgagctatatcccagaatcttggcatttgggatcgttctttttcttactgtccggccacacgtgttttccaaagccgcttgatggacttgtattacttaacttcttacgttttaaaaaattctcaaattgcttttagcatttttactgtcagtgttataactgtgccctccctttgaatggcacctacttcaaaacacgacgaaaatttagctcctgcatagctgagctatgaatcacattcctctggctggattgtgttgcaaaagctggcagatcaatttggatttgaatgagtctgtgagtcatctctttgatttctggaagccatactcttgatttttgtttgtggcaaatgcttagtacacagggtaggatctcgggacactccaaagtttacacattattaagagacttttagaagtctagattaaatagttggaatgatccatatccaataaataaatttgaaagatttttactggttatgttattccatgctgcatattagttttccactttttaagaaggaatattcaccctgtacctgttgcttgtttataatcccagcatttgggaggtggagatagaatcgagagtaaaaggccaataaaaaaaaaaggtcataacatcataaacagagagtagagaactcaagtgtggtgctgcatgcctgcagccacactatttgggacccagcctgggcaatttagggagatcccatctcagcgaaacacccctacctcctataaaggaatatttttctttctattggagattaaaagactggaataaaattgagaatcttatacatgcatataatgtgttttgatcaagttgatctccaattacctccctttctattcttcacgtctctcttctagtcctgttcaatttcatatactctttaaaagttatctatctatttctatctatctatctatctatctatctatctatctatctatctacctatctatctatcatctatctatctattcatttttgaaacagagtgtggtggctacttttgagtcaatttgacagaggctggagtcatctgaaaggagggaacttcagttaagaaattggctccataagacaggtccagctagagggcgttttcttcatcaatgattgatgtgggagaggccagcccattgtggacggaccatcatttgtgggctggtggtcctggattcttataagaaagcagcctgtgctagccaattagcagcatccctccctggtctgagtcaccgcctcctgcctggttcttgtcctatttaggttatgaccttgacttcctttgatgatggactataatgtggaagtctaaaccaaataaactctttcctccccaacttgattttggtcacggggtttcatcgcagtaatagtaacccaaacaaagacataaggtctcattatgtaactgtggctcgtctggaattcactatgtagaccaagctagctttaaactcacagagatccacctgcctctgcctcctgagctctggtgttaaagacatgtgccaccatatctagactttacattttaaagtaggtctttggtaatttcatacaatatattatggtcatattctcccccttcttaaacatctctcagatctactcttccttccctactcacacaaatttgcttccttttttttttttccccctgaatccagtttgtatttccatatactcttgagtggctatccactgggtggcctggttgaccttccaggggttggtttgaaggacagcggctcccatgggctctgtgtttgaatacagggtccctcactgatggacctgcttgggaaaaaccaggaacttttgcccttgttggaggagttggaccactgtgggtgaactttagggttttgaaagtctcagcccaataccagtattcctctctctgtttcctgcttttggatcaagatatgagctcttagctcacaaaaccaaccaaccatccaactaaccaaccacttattgccctcgttccatcttaagttgtgcatcagattcgtaattcagtgtttaaaagccattttgccatctgaagagaaatacctagcaccagttacttgcatgtcgcccccaggattcggatgagggatgaaaacgacagaaaagcgggggtcttgtgggatgcgctgactgatgtagcttagcgtgcttattatatacagtttaacagggaggtgggcttattacatacacctggaaatagaggcctgtttccctaagcttgctaggagcagtctctataagagagcagcctctaagactgtaaacattggaggaataggggagttatggaagacattttctgcaaacactgtcaagatccacaatctaatttgaggaatgcctagccatccctttgagtctcacccagggagggcgtggccacttccaggaggctgaggcatggctgtgctcacatcaacaacacactcactctgggcttcactcctgccctacaactaagtgatcaaaggtaggcactgggatagtttaaagaacaaaagccacacactttgtgattgccttagatgtgaagcctgtgggtcactttgtagagttatggcctagcattcatgaggctctgggttcaatccccaccaatacataagcacgttgtggtggtccacaccagcaatcccagtgctcagaatgtggaggcaggaggaccagaagttcagggtatcctcagcttgtcatgacacactgacaccctgtcactctaagataccctgcctcaaaaaccggcaaaccaaccgggccaccccacccccacccaataaaaaacaaaatagaaaaaagaagagtctagaaagcatttgttgtctactgggctagggtttagggctgctgacagtgagccttcactgtctgctaaagcacttgagataaggttgtgagaagtggctagaatagtgacagctcttaatctgtgtcagtcggaaagcctaacaggtttataaagattttaaaatggtagtccaagaataatcttcagaagccgggtgtggtggcacacgcctttaatcccagcactcaggaggcagaggcaggcggatttctgagttcgaggccagcctggtctacagagtgagttccaggacagccaggactacacagagaaaccctgtgtcgaaaaaacaaaaacaaacaaacaaaaaaagagagtaatcttcagagaaaatgtgctactggtggagtgtgtggtttattaacttttctttgggacatgatgaaatgtcaaagaacaggctgggcatacacacacacacacacacacacacacacacacacacacccctttttgcctcccacgtgctgggactaaaggcttgcttcactgtggctggctacctccttggttttttatctaactctgcgttctaattgttgaggaaattagagcccatgcaaagctgagcctctaatgctagcatcttagcggtgatgctgatgctgattcctgcatcacagctgcacgttcacaggtggcaatcaaaagccatagaggagtcatttgttacactagccttttctctgtttccgtaggaccttcccaggtgcacctggttccctgccatttaggttaatatttaaatgcagccttcattgagtggccttctctgttgactttggaagtcatgttttttgtttgtttgtttgtttgtttttgacctacactttttctttattcttctcttttttttcttttctttctgtatttatttgagaaaagggcttgctttatatcctagtctggcctcaaactcatgatgctcctgcctcagcctcccaagtgccggagttacaggtgtacacaccacaccctgcttagtcaccctgtgccctatcactgcttgtgacttctctgtgttttctttctcgctatctggtactttgcttgcattttgtacttgctgatatcctttttcaatgcagctcgactccatgtgacttggggaaccagtacacctctggcatcaagcccagggcacagtggattgtagccaagtgataagtacttacccaatggaaaaggttccatggcttggagattcacgcgctgggatttgaattcaggatcaggttagacgggggaaacctggagtctgaactctgcacagtcttcatcctgtgcctgccaggagggtcattattttatgctcagatctgttccttgcgaatttgcccggtgttaactgtgcacaggtcctctcttgctccctccttgctacctactgagggtgaccctgggctgaagtctggggctgctttggttccctagtggtatcgtagcccacataagagacaggacctgctgctgcttggctgccttcttttctatctctgtcctgtcattctcttccgggagctgacaaaggggataacattggaggacagacagtccttggggcggaagatgagagactgacactgtctctgacgtggattctctttctctcttcctctgatggctgttcaaggcttttaactggatggcaaagaaggtaggatttcagatgcactgacatttggcacagggtaggccctgatctggtgcccagggaggtaactgtgctatcgagatgtgttgggggagggcagaggagcccatgaaactaaaggaaagcaaatttctttgctgatggtttacgctgtgttccattatagccagcttactgaaaacatgccctgtgatatctggtgtaaattagagctgcccaacaaggtctggagtgagagaaaggttgaggaggttggctttctctgttgacctttcagaaggtcctcttcagacaacacagtggctaagttgcgtttagggagtgagtggtctggtttttaaaaggtttacactgatcgtagtatccaagagagatttttctccacagtttaagggactatgaaaacagttccttgctccttctggagattcccttagctgaaatatctgtcctttgaagggaagcctttcagcgggcttggtttttttccacaagcccttgggacttgccttgagggacagacagggacccgggtggaaactcaagtctgttagagaacagcagtcttgggacgagcaaaagccttgcctgtgtcacaggtcctcacgaggctgaggaggagcgatctaagatcttgtctgtgccaatattctagcagaggcggtgtgttcattatatagacaggactgaaaactcaatttgattgaaccttatttgaacccagaagtttgcactggatgctgatatcatgattttccctgggaacaagggaacaagggagatcatgcaggcagttgtaaacactagttaaagtttaatctaaagcagtggagaataggatgcaggtagctagagtcccgccctctttcactgtgtggagaaacaagcatttactatggtgttgttttgatatgcacttttaaaaattaaaactgctgaatgagagctatgctcaactcaatatttggaatgcgagccagcgtgagattgtctgcacgtatgtgtatgtgtgcgtgggtgcatagagaccaagggatggcctcaggtgctgtttcttagcagctgcgaaccgtttttgtttaagcctctcgcactgagtggctcctggtagtctgcctgcacactgagccccagaggtcctcctttctccatctccctagttctggaattataagcataccaaatgctgccaccataccaagcgcttacaaggcaagcgccttacccagtgagctacaggatgatagagatttactctcgagatgatagcctggggaccagacccagccttggatcccaggcttccttcccatttgccattgcttcctcccctctcagggtgcaggtgacacttagggacttaggaagtcctcagacttctcagctaagctgtgtgtcccacgcacggggctgcttttgctgaggctggctttcatggcacgatgactcacaagtgacttgttggtctcttttgcatgtgtggcagctgagattccgacttggtgtggcacagccaccaactagttttgggaactcaatttttgttatattattgtttaaaaatgattttcttaacatttattttagtgtgtgtatatgtgcctatgtagaggtcagaggtcaggttatgggagttggttttctcctctcgatgtatgtgggttctacaaatagattttggtgactatatgtgtgtgtatgtgtgtgtttcagttctgtcaaagtggtggagctcagttacacagcaaacacacaaatagcgtgtgctatttcacacgctaggaatcttatgtgtccagtacaatccttgtggcccttacttctgtcacaaaactttttttctgtccaaacagtaagactctgggcggggtggtggtagtgaacccctttaatcccagcacttggggagcagaggcaggaggatttctgagttcgaggccagcctggtctacaaagtgagttccaggacagccaggactacacaaagaaaccctgtcttgaaaaaaaaaaaaaaaaaaaaagactccgggctgggtgtggcagtgcgtgcctttcattcaggaggctgaggctagtggagttcctctgtaagtttgagaccagcctagtctacacagtgagtttcaggtcagccaggagcacacagtaagactctaccttaaaaacaaaccaaaaccaaaaccaaaacaacaccccccccctcccccaaactaaaaaccaaaaaacccaaaccaaaccaaaacagcaacaaaatcacatcccctcccctccaccagccaaccaacccaaaccaaccaacccaaaccaagagaatgcaggaccttctcagcagagaaatctatttcagtataggacttggtacttggcatctgacgtgataaagcctgggacgttggccttgcttcccgccctttcagaaataccaatatgcctgcatattagaaaggtttggttgccttcctatgatttttggctctacagtatttatgtggaggagatatattttgagactgatataccccgtcaagggcacccgtgaattgcattatttaaagtaaattctgtaatcacatagatcgatgtgtgttctcttattgggaacactgggctttgagcttcaggctgtgtcagagtcgccctcctggattctgactcaggaatttccatgagccctgagagtttttccttcctagtgccttggcttagatagtgaaagtcaggcctgtgggtctcagccttagagagcagcctgagttcccccgaagggaggaaagggagagtcaagtgttgtttatttttactcagaaacatttcctggtaaatagatttaaaaggtaatggctttcatactattggcctttgatggtttggtgtctcatagtttggagcttgggtttggctgagaggaggtgaaactcaggaaagtgggtcaggggagggctgacagatgctgcttcagttctggggcatctgaactggaatgtccctcccaaatactgactagggctgtctctgtccgctctgtactatagtcacacctcagcgtggttagccctttcctgaggctaaccttggttaactttcctgcccacagctcctgagcaaggactgctctgattgcttctttgtgaaagctttcttcttttcttttcttttggtttgtctgtttgtttgttcttctgtttttagagagggtttcactgtttatttctgaccatcctggaatttgctctgtagactgggctggcctcagactcactgagatcatcctgtcttggccttccgagggctgggatttgtgttgtgtacttggatggctgcttggctggttctctccaccccgactccacctccatcgccctttttgagacagggtctcatgtagcctcagatgcccaaagttctgagacgacagatgtatgccaacatgcctggtttatggagaactggggatttctaccaactgaggcccctccccagccccttaatatgactatatagtttctaagacattacttcctaaaagggtgtatttgtcactggtaatgggaaaagaaaaaaaaaaaatctgtgctactttcctgattttctttatgctcacagaaaagttgtaagtatatttgcctctctgctttttaaagtctaagtacgtgatgtttggtgtttctgctccctttgagatgaagcagtctctctcttttctttctctctttctttcttttttaaaatttatttacttattatatacaagtacactgtagctgtcttcagacacaccagaagagggcatcagatctcattacagatggatgtgagccaccatgtggttgctgggatttgaactcaggacctctggaagagcagtcagtgcttttagccactgagccatctctccagccccctctcattctttcaaaaccagtgaattttaggaaagggtgatttgtgtgtcaaagggttaaaaagttataaagggactggagagacggcccagtggttaagagcattgcctgcccttctagaggacttgggtttgattcctagcaccatgtggtagctcacaatcacctgtaactctagacccaggggatgcgataccctctcttggcctttgtgggcatggcttgaacatggttcacagatattcacacaggcagaaggataaaaaaggatacagacaggataaaaaaggataaagggaaggagggggagttaagtgggtcgtgaccatggtagcatgttccttagggatctacaagaacatcctggagggcttgtaatatctttatgtttcaagaaccaaaactgaatgaaaccaaaccaaatcccaaatctttcatagacctctgcaggaataccactgagttaaacatctctgaaagtgtaggaagggatgtcggttcattcctagagaaggcaaccctcaaggttgaagatagtaatttttgtgtttgtttctgtgtatggaatttgagcaccccccccccaagtttagtgggagccatttcctgggcagtttcagatggatacgtggaagggcattgtgggttgggcctgagtagcttgctgtctatctgtgacggggacacagaattttgtgcagacattggctacaatgaagagtggggcaagtcttaacaacccatttaggaaaaaccatatttagattgacttaaaagaaagagaccacaaaatagaaccaataaaatctatcctaaacagactatcccaaacagcaaaaaaggtttccaagtgatacaggatccagttgtcagtgaattgttgtcgtgtcttgtgtgaaatgataatgctttttgaaatttacaatgtaaatattgactcagaaatgagaggatgttcctgaatttaattagtgtggaagattccaggccatttcccccaaagcctagcttgcagtgagctctgagttaagctctggatgtgttctggtctttgtatctccatgttgtctctgcaaagggttagaggatgccttactgtagagtgtagacatagaaaggcgtcatgcaacgcagaccaagcgttctttgtaaagacagcaaggaaagaacactaacctcactttgaagcggggataatcatctccgacaagtaaaatctgcaggcaagagagcccagaaaacggtttgagctcaactttaattgaagactgggggtgtttagcctgatgctgtgcagatgatgtcatcctgtgttaccgaattcagcttcagcagagacgatggagtaaatgcaaattaaaaataaatcgagagcagatgttgaagaatacctttcatttagggaataattaagcagtggaaaggtcattggagtttagtcaataaagctgagatgtgctgaagtcataattattcagctaacagatgcctgcttttggttgtgctctgctggggagcatttgggattggtgactggaggaagctgttcctatcttgttggatggaaagttccatcttccaaagttgcccatccagtggactaacttgaatgtacactgcatgagccaccaccacagtaactttgaagcagactggaggagcccctttcaaagctctcgtaatgattaggcctgtgtgctgctgatacctgtgtttttggtttggcaaaatacattgtgttttgtcattgcaatcttgctaggtttcagtccctgaaaagggtggcaacttagaagaaagccttagggctttagagggttatagtctgtgccggtcttgctggggagtgtggcagtgggcaggcacagtactgcagcaatagctgagagcttacttttttttgttgtttttgattttttttcctacaaataattgggaatgacttgggcttttgaaattttaaagccctcccccactgacatgtctccttcaacagggccacacctcctaatccttcccaaatagttccactaactggagactaagcatgcaattacatgagcctatgggagtcattcagaccaccacaggactcttgatggttttctctagtaaattatagagcatatagtgatagcattgagggagctagagagtggtagtttgccagttaagaacatagtactgcttttacagaggatccaagttcaattcccagcacacacaaggggtgcctcataactgtaactccaggtctatgtaggagatctgatgtccttctggcctctgagagcttgatgtgtacaaagtgaggctcacacgatatgggcactaattaaagggcactattaaaacttttatcgatgttttgaatattttattcctttcgtattttctgaggttttaggttggctgtggagtgagcattagagaggtaatatgaaagatggaagatgccaggcggtggtggtgcacgcctttaatcccagcacttgggaggcagaggcaggtggatttcagagttcgaggccagcctggactacaaagtgagttccaggacagccagggctacacagagaaaccctatctcgaaaaacaaaaaacaaacaacaacaacaacaacaacaagaaagatggaagacaccggaaggtgggacagtgagtggtttgggaggcttaatatttgggtaggtcattgatctaggtcataggacactgtttcacaggtaaaatgtagttactctcaggttaggaagtaactcacttagtgtgagggcttgagtttagctccctagtcggtccctgacactgtagggacagtaacacatgtatttgcgaccccagtgctgggggtgtggtggggcattctcaatggccagccagcagcctaccccaaatttgtgaactatgggaggaataaaagccatgtctagaactatttgtttgagaatgacagaggcagacacttgatattgaccacagctttctgtctctgtctcctcctgcctcccctaccccatacatagagggatagcctgtgacacccaagagcagatctgaggctgctagatgctccaggcagggtggtgcactgtctggttttctgtgtcaacttgagttagcacagagaaaggggcttcagttgggggaaatgtctccatgagatccagctgtaaggcattttctcaattagtgatcaaggtgggaggtccccttgtgagtggttgccatccctgggctggtagtcttgggttctataagagatcaagctgagcaagccaggggaagcaagccagtgagtaacatccctccatggcctctgcatcagcttctgcttcctgacctgctcgaattccagttcctgacatcctttggtgatgaacagcaatgtggaaagtgtaagctgaataaaccctttcctccccaacttgctttttgatcatgatgtttgtgcaggaatagaaactctgacgaagacacagggggctggaggtggctcacaaaggtttgtcttccagggaagtgatggctctgccacctagtttctctgccagggtgccgcggtctttgactgcctcctcgtagcagttagcttgtaattcatgcttgattcctgttaccttcttcttcttgatggcatccttggagctggcacagatcattttggtcttaatgggtgcactctcaggggcccagaagatgaccaccaggtctcataggttgcatcatagagcgcgtagcggcagcatctcgacaaaagtggtgtaggggtcgtccacagtctgccctgcatctcgtaccttgccctcccccgggatgatgttcttcttgtcctcactcaggaaaaagagcactgccttcctgtgtttcttcacttcttctggcttggaggacttgtgaactttcatgtcattgaacaccttgatcagagacagccacgccagaggccatgtttccagaaacgaagacagaaagggctactgaagaactgagccgccacagcagctgctgggatctgactgaaccaatatatagttttgttttgtttttttaaaaaatactttggcttatgcgcattttattggaaaaatttcccagttctgatacatgttctttttgtaaaatatagttttaccatatatatatgtgtatttatttattttctctgtctctgtctctctctgtgtacaaacacatgtgcctcattctcacatgtggaggtcagagggcaacttttgtgtattgattctctcctacttgtggatctggggatcacactcaggttgtcgcgcttgctgtcgtggacccgtagtcactgggcctcctctctgggctatgattatgttcttccaggagatctatgctctaagagttaagttttagagaggaaggcatgatgtgtaactagggttctgtgttcacggtactaatatcattcctgatggagattccgatggtagtacgcagctgggagttctgtggctcacatcgttgctgtcactccaagtcccccttactttggcccttgttttcctagaaccagtcagtcactagattgctcagatgacacaaggtgagaagacacaaagtgtgaaggacagaatttgtgatcttgtttgacccagttttgcatataatgaatttttatttgttgacaaatctttcccttttgctaaaagtggcaaataatcagacataaattactaattaacagcctggttgaggttttagttatttatgttttaattagtgaaacttgtgctgcatcaggctctggtagggttggtatcaaaatcttttttcttttttttttcctgatgtgaagaaaatgtcttcataaccctgttttcaatagccaggcatggaatgacgactgagtcagtgtattggaaggatattagtgggttgccaacattgccctttagccagtcatacttttttttttttttcaagagaaaggatctccctgtgtagccttggctgtcctggaactcgaaggttggctttgaacttatagatatctgctacctctgcctcccaagtactgggattaaaggcatgtgccaccctctaccttcatcccccacatgatgcgtgcttttaatatcagcacttgggaggtagtggcaggtggatctctgtgatttggaggccagcctgtccttatgtagtgagttctacaccagccagtgagacactgttttaaaaggacaaacatataaaggcctagttagtaaaatgatgccagtttttcttctagatgcatctttgaccattggttcagaatgataggggtttagtttcacgctcccacatgtagacttctagttctcccagagccaattcttaagatgctatcttttcaccaccacatgtttctgagagctttgtaaatcatgaggtgactatggctgttgggtttggttttgggccttctgttctgctctgatggtatatgtgtctgtctttatgactacatggcactgcagtgtaatctgagaccaagcattgtcatacagccagcacagtactttagcattactttggctatttggggtcttttgtgcatttatgcaagtttctgattgcttcttctggttatgtagagaatattactcaaactttgatagggattacattgtatctggagattggtttcactaatacagccatttttgcagcattaattctgctaattaattcatgagcatcttgccttatcttttggtgtgttcactttgttgcagccagaggacaacctctgttgttcttaaggtgctatttacctatgtttttggagagaaagcctctcggcggccaggatatcacctagtaggctacctggtcagtgtgccttggagatctctgccagtctgcctggtgttgttagtctcctggtatcatgagtatgtacctagtaatgcctggctttcctctcttccttctcctcttcttctctccttccttcctttctccctccctccctcccttgatctccatcttttggtgataaaactaagggtcttaagtgtataagcaaatattttattgacagagtcattaattttgcattcttagatagttttaaaaattgcttttcaaacactgctagccatttatgaatgtatgtatgtatgtatgtatgtatgtgtaagtttgttactgggatagccaaagctactgagtatgttggtatgctctgctactttactggctgtgtttattagttctaggagttctctggtggagtcttcaagtatcctaaatatgaagaacagtgggggacattatgatggaaaagagaaaggagcaagatatttgaaacaataactaaaagtaaaaaagaaggaagaaagtttcccagtaatgaaaaggttcaaatataaaattgtttgggtgtaagaataagaaataaaaaagcccaatatggtcaagttgcaatactgctgcaggtggggcacagaggaatataaaaaagggaagaaacgggacaaaacattggaaaaagaagagaggtaaatcatgtgtggggtggcgttgctgtggccagctgagcctgtgactgttgctcttggtttctgctgatgctgagtgtgtggtggccaagggtttgctggtggctggtgcttccttcagctccgtagctttcttttgtaggaacccatgcctttgtgctgagtgggtccttttactctcccccacgaccccagattgtactcactgggtggctggacttctagccaagagttgtctccagatttttgcaagtgtgcagagaagcaactgccatgggtctatgtctacatgtagaggacctaactttgtcttttttttttttttttctgtgcatttagatttttcaaggaatcatttattgtatattatcagtgattacatttcacagcaaaattaaattaaacacacactttggacaaacatgaaatggaagtcaaatctgtcatccaaatgccgagctgagtcttccttctgtttttttaggctgcagtagtggatcatgattccagattaatgcaacggattattccttacatgtgacagttgtttccacaacaggccctcgtgtgggctcctctcgttcctgttgagctctttccttttgctctgctctgtcgcccgatgtcatctattcccacgtaaaaggaaactctgagcccagtcctccagtatcaggcaccaattgtatataccacagacattcactggtatgaactgaggctcggtcatgacacagggtgaaagttcctgtcctcagacaccccatgacttcatactctgaagacttcctgtgagtaaaaatctccctgctgaagagatggctcctgttgctggagtgtagcagtcactgcagttttggggttcctgggctcttcagcagtgtgtggaagttagtaagctctagagactacccaccttgtgacctcaggctcagagctatcagacttcagagttagtctcagttgatgagatgtgctcctgtctatcaagggtgggagccctctcttcctagccacttccctacatgggccagccttctgccagccgcaccctacagcccagcagaattgggctctcctgttctctgccaccacatccccagaccattcctcactctgcagatatgggataccaacttgaaactccctcacctgaaattgctccgtgttctcaggtctccagggtagctcagctgttaataacaggttctctctggagatggtgccagctgtgacgcttcggggcagtcaaagtaacaaaatgggatttattaccattacttgtcctggaaggatcaccgtcaccaagacccacccccccccagcctcccacctcccccccccccgcccccagttggatttgagtcttgtgagggctgagggcttgcttgtcctaggggtgggacagcttgtccagccccccccccccatgtggtttctgctcccctttccactgctaggaagcagctttgctgagggcgtgttcagctctttctagtgtattctgctgtcctttcctttacttcctttgtgaatttctgcagcttcccttcctctgtttttggaatagtccctttagctctgcctttctcctttactcctagccatcgtgtgacctgctgtgacttccaggatctcttgaccctgtgaactctggagaatgtgacggtggcagccacacactcttcctttttgggcaggaagcagagtgaagtgcagctaaatgtgtgtcttttgtgtgtgcagtgcatgtatgcgagtgtgtgtgtgtgtgtgtgtgtgtgtgcgcattggtgcttgctgaggctggacgatgatgttgggatgtttctcactttctctcccatcctgttgccttgaaactgggtctcttcagtgaaccaaacacttcctgttttgctaggctctctgacccacctacctcttaggatctgcctgtctctgtcactcagcgttgaggttataggtacacataggcatgcctggattattaaataacttgaaatttttatttattactcatgtgtgtgcctctgtctgtgtgtgtgctcctgtgtgcgtgcgagtgcacccctgcttatgcatgcacatgtgttggtaggatgctgtgcacacgtgtgaggtcagagaacaacttcacggagtttgttctgtgggttctgagggtcaaccttgggttcccaggcacatcatcaggtgtccagtcccttattcccttaggcatcttgccagcctggcctctacgcctggctttcatgtgatttgaacttccgtcctcatgcttacaaagcaaagacatttagctgctttacctctaaacccgtgcttttatttcttaaatatgtccactctatctggatcggttgttgttgtttgctttgagccagggttttgccatgcagtttatgctgcttttagatgaagctcctccttctggtgctccctgaggactggggtgggagtactgagtactggggtgagagtactgaggactggggtgggagtactgaggactggggtgcaggcagaggctgtcattctgggcccctcctgtttgtttttgatgcctttaacttagaagaacatctgagaaagactaagcactttcagctcacttcatggattttggatgatctggctcatttgcatatgaaattcttttatctttatcttctgttatttactgacacagttttctggaaggatgtttgaaatcatgactgcttcttttttttttttttttttttaattaggtattttcctcatttatatttccaatgctatcccaaaagtcctccataccctcccccccactcccctacccacccactcccactttttggccctggcgttcccctgtactggggcatataaagtttgcaagtccaatgggcctctctttgcagtgatggccgactaggccatcttttgatacatatgcagctagagtcaagagctctgggggtactggttagttcataatgttgttccacctatagggttgcagatctctttagctccttggctactttctctagctcctccattgggagccctgtgatccatccaatagctgactgtgagcatccacttatgtgtttgctaggccccggtgtagtctcacaagagacagctatatcaggatcctttcagcaaaatcttgctagtgtatgcaatggtgttagcgattggaggctgattatgggatggatccctggataaggcagtctctagatggtccatcctcttgtctcagctccaaactttgtctctgtaactccttccatgggtgttttgttcccaattctaagaaggggcaaagtgtctacactttggtcttcattcttcttgagtttcacgtgttttgcaaattgtaacttatatcttgggtattctaagtttctgggctaatatccacttatcagtgagtatatatcatttgagttcttttgtgattgtgttacctcactcaggatgatgccctccaggtccaaccatttgcctaggaatttcataaattcatcctttttaatagctgagtagtactccattgtgtaaatgtaccacattttttgtatccattcctctgttgaatggcatctgggttctttccagcttctggctattataaataaggctgctatgaacatagtggagcatgtttctttcttactagttggaacatcttctggatatatgcccaggagagatattgcgggatccttcggtagtaccatgtccaattttctgaggaaccgccagactgatttccagagtggttgtacaagcttgcaatcccaccaacaatggaggagtgttcctctttctccacatcctcgccagcatctgctgtcacctgaatttttgatcttagccatcatgactgcttcttacagtacccctcctccatgatgtttttattttctctcccctccaccccttcctttccttcttactggaggaggcatgatgctttgttcttagctgtgatcctgagcgttgtctgacattgctgtgctgcctgctaagtctaacttgaaactggttgatttagaccatgtgcaaatgcactaggtggatagatttttaaactgtgtggcaaagaaacttcaaaatgcagtgactcagataaggttaacattaatttttctcatcttattggtcagctttcatgcactgctatgctcagcagggtctctcgggactcagggtcccctcttcctttttttaaaaaaaataactgacttatttgtttgtttgtttgtttatgtgtaagtatgtgtgcctatgtgagtttacgtgaaccacatttgtgcccagaagagggggttggatctgctgctcctggaattagtgttgattatgagcccaccaatatgggtgttgggaactgaactcctgtcctactgaagaaccaacagtatgtgctctaaccattgaactatctcttcagccccagggttctttcctgttttctagtccttctactcttgtctatgttgtatagtccatgaagagggaagaagggaaacttaaaaagaaagaaagaagtcatttccctttttaaaggctggcaggaataggtggctgccctggctgtagctaactcacgtagcttcatgtatctgcgagggtggttgaggaatctgctctgtggcatgcaagccaagtgttcagttataactgggggttgcaggaggcaggatttttgatggaaagaaaaaagagaatggaaaataacaaatatacttgcaagttagggagccagacgtgattgaactacagcccatctgagacctgtgcccaagcatagcacagggaagctggagtcagttcgtaggctttgccttctcttggtggcgcagccctgtcctaacccacctctgctcacctgcttcaacttccatctgtaaagctggggtggtgcgcacctttaatcgcagcctttgggaggcagatgcgggtagatctctgtgagttctagggcagccagggctacctagacctgtctaaaacagaacaaaacaaagcaaaacaaaaaccaagcaaaacaacaaatacacattggccctgacccatgtgtaagcattggtgtggtccagccctggctggtgagtacagggctcatttaagcagattgcggaacttgggtcggtactgcagaaggagatgcatgggtttctgtgcttgggcctgggtatgtgtgtctgctagattctgagatcgctatgggtcagaaaggggaagaaggggtcagagagaagggcctctcacatgtagggtttagggcaaggattctttcttgtcttacaaagaaaaattatccagtgagttctccaattgagccactttcctgatattctcatttcattaatattaatattcatagtcatttatagtatgcatattacttacttatccatccagagtagcataactgtgtagcataaatcgagtgtcattttaatagaggtacagggagggaagggacagggaaggaggctagtgaatagtcacttatttagcttagggttctcaacagcttaaggcaaaaaaaccaaaatcttttgagtggcccttgtgactcaatggcagcctgcccagaccagagggagccagtgctgggagtgaacactagattcactttgaaaagtctagaaatgaaaagctgctactcaaggcataagaatgtacctgatggctccagacctgggagccagtgaaatcctgcagcatgtctggctcccctccggctcccatggtctctctctgagcatcccagtggctcctcccattcactcactctggtcactgacttggaagagaccaggatacttcttctaagctgtctcagggttgagccactgctgtgctcagggaggccaggccttaatgtgcttgtgataagcctttgatgttgatgaaggggtggcgcacgcctttaatcccagaagagacaggagggatttctgagttcgaggccagcctggtctacagagtgagttcctggacagccagggctacatagagaaacccagtctagaaaaacaaaaacaaaaaacaaaacaaaccaaacaaacaaacaaacactgagagagagagagagagagagagagagagagagagagagagagagactctaacctatagaatgtacttggttgaccagggagcctctttcaacttgggaccatggcatggtatagactattaattgcttttcttctgtaagtgtacagatggttgtgagccatcaggtggttgctgggaattgaactcaggaccttcagaagagcagtcagtgctcttatctgatgaaccatctctccagcccttaattccttttcaaaattcttggaactgggactatgggtgatagtaagcttgtgttgtgattctatccttttcccttaaaacagaaccaaaccaaaccaaaccaaaccaaaccaaaccaaaccaaaccaaaccccaaaccagataaggggtctgagggttagtggcttacccagcctcccttggtaaaacagtatgcttgctttgtgaaatcaattatgtttaaatcaatattccttagtctttcagtggtgggacttaaacccagagtctcccacatactaggacagtccctaaacttcagccattctccctgcattttgctttgttatctaaagttgctaatctgcttgtcagaaactttagaaagtaagcctgctttgtagaaaggcagcttcgtactttgtagaagtatagcgggaaagggccttcgattgtcactatctgctgtgatcttgtttccggaggaaaaacaggacaagaaccaggtccttggcctgtctgtccgtcttcctctttttgccttgtggcttctccttgtgcctactccttgaggcctgacagggcaatcggtcagggcactgtggtggactccacagcagtgtgggcagctatggtgagaatgtggccaagtgggtgacttgtgttttggggctgggtgtgggtagaagagaaggcttggcttgattgagattgtgacaccctctggggctggcaaactctaacctcacatttctgttctcactaggcgatgggcgttaatctgctcacccgcttggcagtgctttgttttagagaatattaggtcaggccattgtctctcagtagacatttggacaaggtagccttgcaggagagacagtgccatgggcattctcatgtccttgtttatgccattgtgccagtgggaggtcagtcctacctgccaccggagaaagccatccagcaggggccagcctgccgtgcatgagttcagacagtgcggcaccagcaggaacctgcctggaaagaaaacacttgtggatggcacagccctggggatcgcccacggtcttaggcacagctgttgtattgccacttgacaggtgagaacacagccctgtgagctcatgatggtttgaaactggtcctattgctggcctaatcagatcttaatggaagaggcagctaaggtgattcaggatacgttttccccaggtagtcctttcttcagttttttttttttctcaagtctgtgcaggggtgagggaggggttggggggagaagggaagggcctggggagatggctcactgcgtaagtgcttcccataaaagctggagtacctgggtttggtacccacacccacgtcaatgctgagcaagatctctgtgatggctaatcgtggttgttaactgacatacctgggaagaaagaatattgattgaggatagcatccatcaaattggtctgtgtgcatgtctgtgtgggttggtatttatctatctatctatctatctatctatctatctatctatctatctatctctttctcttgaactttccccctttctttaaagattgatttatttttattttatgtgtatgagtgttttctctgcatgtatgtaaggactccacatgcatgcagtgtccagaagtggattactagtaactgaagttactgatggtcatgatctgccatgggaaccaaacttgagtcttctgtaggagcaacaagtgctcttaaccactgtaccatctttctagttcttgggatgcaggacatcttcttgattgttaattggtgtattggggcccagcccactgtgtacattgccatcccttggtaggtgggtttaggcagcacagtaaagccaattgatcaagccagagaaagcgagcctgtaagcagtattcctctatggtttctgctcaggctcctgcttagccttctctgggggatggactgtaaggtggagtaaaccctttcctctccaagtgacttctggacgtgatggttatcatagcatcagaaactaaagcaagataacttgtgtgcctgtaaccctagcattggagactggcaacaggtggacccaacaggtggagcgtgggagcaaaaatggcaagccttaaggttcagtgggacaccctccttcaaaagggaaagtagaaaggaataaagaagacttctgatgttcttctttgggctctgcatacgtatgacatgggcaagtgtaggcacatacatgtctgcaaattacacgcagacaacctgacacacacacagacatacatgcagtggaaagagcattccactgtgggactgtggttgtagctcagtgaaatacagctctgtccagcagagctttggattctatctcccagtattaattaaaagaaaaaagaatgaagcggaagaagagaaagaagaggagaaagaggaggaggaagaaaaaagaggggaaggaagagaaaggaggaagaagagaaagaggaggaggaagagaaagaagaggaagaggaaggagaagaaaagaaaagattattggttcctctttagatatacatggtacttggtggctcttactgacttcatgtagttgaatcacagtgaactctgagttgggctatgtacctgtgttgagagaaagcctaggcaattggaagggtaagcacattggtctgtggggttctttgttagtgctgttttcatttacattactttctttgaaaattaaacacaatctgttaatcttttactttatgtaatacatgagtctaggagtcttagccaatgtcctatgggaagtgtctggagacatattaacttttaaaacttcagtcagttatttacagcataagagctaggaacatgggaactgattgcttgcttgctaaatacctagactgtgaggaaaattcattttaaatggagaaaatatttcctaaaaaagtcgagggaggtagagagctaggtaggagatgaaccttcccagacttttgtctcatttatacttgtcattaattctgtggggaagatacagttgtttttctttctagaaattactcagattttgagtttatcgccactcacattctaaattcatccagagatgattttgaaaacgagagaaaacccaacaaaaatacagagaaaagaaataagtatcttgtcactaagttaaggtcaaaaggctatcaaaacacacccacacatatcacatataaaagttatgtatgcattttatacacacacacacactctctctctctctctctctctctctctcacacacacacacacacacacacacacacacacacacacacacacacgttgtttttgagagtgaatttcctgaggtagctgtgtcctaggactcacaatgtagaccagactggctctgcccttacttggctctccctcctctagaggactgggaataaaggtgtttgccgaccgtagctggctctactgaactcttgcctgctatatttagagatgatgttctatctgttgccttgttaaacttccgatgcaaatttgtctcaacttgtcctgctgggcagaaaaataaagaaaatgattagttacaagattgacactgcccatcaattttccaaactgtgtttgccaaagtggaccagttttgctttaagctcctgacacaaaagatctctttccccccagaacctcatagatggggcagagtagggcagggcagggagccacttcttcaactctagtcaaccgaagtaaatctttcttactactctctcttgtttttgcaacttaagtgaatttcactcttctcagggtatggcacaaggtgtctttctcccttacacatgctgttgttgaccttgctagggtttctgcatgtgcatattgcatttggtccaggtgactctgctttacggtcccatctcagttgttggagtgctgagatcacagatgtgtgccctgaatctggcttgttcacacacgatttggtgatcaggcttaggctgttaggcctgtgtggttagtgccttactacctgaaccgagcaccaccccttctgtctgttcttcacatcatttttgactttctctaggctgttgatgggcaacaatggggcatctttaggagttggacttaaatttcaggccagagtgttctaaagagacagcaactggctattaatgtcaattgtattattaattataataagttatttcgtatataagtcagaaggtgcctgagtttcagtcgtctacactgtagtgttcttatgaaatttcatgctctagcaggtgaggagacaagagggcgaggaagagagggcttactctgtggccaggacagttgctgctaagtaggattagggagggaaatactgaacaaggaaattagtgcctgccagtactctccagtcctgccagcttcaacgtggtgtaagcggcttgcaggtggttgctattgaattagcacatgcatcattgagtgctgggaccatttacctgacctggcattcttgagactatcaagtatttttccaacaccttctgtttcattggtgccttacttattggactttattgtgcctttgacacgaatggagatgggctggggaaggtgctgactgagtctagtaggctggctctggcaaaggctggagggcgcagctgcctggaagcagctgatcattttcattgcctttggctcatcatattaaacatgcttgtacacgcttcagtgtttgtttaatttttaccatagttatggttcagttccacaaggccctcgaagggctatatgccaaaaggcccatcgtcagcctgtggcactgttagataatggagatttgggggtgagccccagaggaaggaagctgttaggtcagggagatagaggaactgtctttgaaggtgatgctgggattccttcctctctgatttttgcttcctgggtaccgtgagcagcgttggtattccccgtgtgccctacctcaccatccataggccccaaaggatgcgaactagtaggctaagaacagaaacctaaaacaaggggcccagatagatcttccttcccttaaattattgttgcgattttgttacagccagagaaagcagcttgggaagtttccactctgtgatagcctcaggatcacagggtttgtggtggaatgctagtgtccagcttcaaagttctttctggcccaaaagttttccctttaaagtgtctaagaaaccattcatgtctaagacaggaaataaccactgcttgcaaaaatcataaacatgctgttctctgggctggggtgtcacagacagccaagcactggggttatagaactggctttggttgcttttctactactactactactattattattattattgttattattattattttcagaacagttacagattatttagtaagtatatagtaaggacatatttagtaagtatttgagtttcttggcttacatttccagggatcaattgtattaacattttgataaaactttaaagcaatttaggattttatgcacataaagtgactgtactgaggtactaaaataacagcagtaatttggccgtattgaagaataatggccaaagtcaagcctcacattcgaaaatggaggaaagaccatttcatattgtaactagaatttctctctctgtggagtcattttgtaaatattgcaatcaaatttcctattggctgtcaccatgtagaaaacaacagttaacagtgatgttattcatagtattgtctagtgtggtgtaatctcatctcttaggatgctgaggcaggaggattaccagtaagagtgaggccagtctggggtacagagtgaagccatgtgccaaacaaacaaataaataaaaacaaaacaactataaataaacaaaaaaaaccccaaacaaacagacaagaaagaaaaggcaaaaggtccatcctttgacctctggggtcacgggaaccattcctttcttggctactgtcatcaaatacaactcaagtccaggcgtgtggagatgagactattttaggttattccaaagtataaaccgaagaaagcaaaacttagagtcatttatttatcattcattttgtttttcttgtatacgcatgtgtgtgagtgagcgtgtgtgtacatgtgcacacatgcagtatgtactcttgcctgtgaagacctgagattgacattggatgttcttcctaaattgttttccaccttattttatgtgtgtgtgtgtgtgtgtgtgtgtgtgtgtgtatgtatgcatatacttgcctatatgtccaacacaccaatgcagtaccatagagtccagaagaggacttccatcctctagaaatggagttatgaaggctgtgactaggacagacttgctgctagcttgggttttagtcctatttggctaaaaccaaactatggtttggagagatggccccttgggtacaagtgcttgccttgcaaacatcagcatcggagttcaaatccccggttcaaaagctaggcatggatgctcttgtcctaccaatgagaaatggagatgggcagatcctgagagctcactggcacactagtttagccaaacatttagaaagtctatctcaagagaaaacggtgaagagagtaatagagagaaatactgatgtcctgctctggcctctgcatactgtatgtgggcacttgcacccataacacatttatgtgtgtgcattgtgcatatcacacacacacacacacacacacacacacaatttaaaaacacactttatgtgtttatgttagaattgagaaatgcaaaatgagaggtttactttagaaataatttattgcgaaactatattgggagtataggaaatacaacatgattccacttttttggcagtcacatacagctctgtgagcaatacagtcccctcaatgtttcccctatagtgtcttttactaatagcagtatatgactgcgattgccctaacatttttatattccttctatgaggcccgatagactccatggctttagaaatcatgctcctggtcacactatacatgtgggtttttttgaggcaagtttctcttctcatacggtccttactcattgctttttgcattgctagtgatagtagaatgttttcccattagatatttcacttgtggtattcagtttcctagtaatgctagggcctgagagttttgaaatagtctctttccagtatcttctgttgtacacaccatgttgacaattcctctcctaggtcagacacagctgtgggtgaatgtgttggctcagccccacacgacatgtagagattaagatgattgaagggaccactagtctctctcctctgctatgtcgtatcatcacagaacacggtgacattgtagagatataagatgctcagatagatgtaccagtctcttcactttgtcactgaggtatgtctgttcaggaggaaggtatgattttcctaagattaagttgttctatttagatagttaaaaccccagactctccattctttctgggtctctggtcacctggacctcaaaaactctcgctttatttcccccacatttcaccttctgtagacagtggtctggtggttttgtaccagaaaacgggagccttcatcagtttaatacatcctcagatgagcatactgggatgtttgcatttttcagaggactttgggttctgtctgtagtgtgcggcttgaggtggaattataaatattaggaaggagtgagacacctgtagcaagctgactgcactaccctaggagtttaagcatcagagatacaaggatactgggtgaggaaaggggggggggggcgggaggatgcaggggttgtttcccttttgttattttccctttagcctgagcgatggagagagttattgggcagaacgggaggtactgagtaaaactggctagaacctgtgttaactctgtgttacagaagtgttgcagtgagcattcatttagaacagcctagattatgcatccagggtttattggtcgccagcgagacatggcagaatttgattttggggtgttttgggaatctttcccgtgtgagtccacaagctggaaggtgtcccatggttctcaaactccacctaggactctgtattcacattgaaactctttcttgtccatcagctggctaaagcagcccctggtcaggtgctgctgacacacctctgctggtcctggtcgacgtgtacagatgcgcactgagtggctacagctaataaggaagggcagatctccattcgcattgctgaggcagagaatgcctgggggagcgaggggaacagatgatgtgtatgtgtgcctggtaacccactccaaacccatgggcttcaaggctcagtagtgaatcgttcttaggagaatctttttgcttttcagagtgagtgaaaatatgtcagcctactgggaacaaaatgcaaatgtttcttggtgcatccagtgtgttgttcttggtgctggttaggtttttctttgtctttcctcgaatccctttcttccccgttggaccattttagcagttgggtgaagccagatagatgagtttaaatgcacaaggtaaaattcatatgctgtaaaagaagctaattatattgccacatatttaccaaaataattaaaaaggcggagctaaatgatatttgtgcctggctagtgccttgaacagcacactctaatggctcttaccgtgatggtttcctaaaccaaatggtatttttcaaagtacttgatctagctgtaaggtaatgtgaaaatgtggagtggttttttaaacgtgtgtgtgtgtgtgtgtgtgtgtgtgtgtgtgtgtgtgtcagaggacgacttgcaggagttggttttctccttccatcatgtgggctctaggaatctaactgaggttttattagctgtgatggtaagcatcttacctactgaactacctactacctctcagctctgtgtgtggtttctgttggtgatccctgcaaagactgtagtgtgttttatgacctcacatcccagtggaaggggatacagattcctgttagaagttagcgggaataccactttcttcttcctgtctgaattcatgggcttcctgccaggtcataacccaggataaagatgataatatcaagtgcatgctggtttgctcagagcctggcaatagcggccgagtgtttcagaaaacctttatagcagaggtgactgtttgacatggagttgactgttctgtgactgtcccctactgcacaatctgtagcaggcagagcaacagacttccaccaccatggtgtctggactcttgaatgtgcccagtagtcggaaaaaaaaaacaaacaaaaaaaaaaacaaaaaaaaaaacccctaatatcataatatacagatagttgcttagctgcccagttgatacatattctgcagtgttctgaggggaatcacgaggcggctgagataggctgtggaagttaaggaagagctccttaaaagaatcatcagctccaggacttcatgcttgccaggtttgtgcagagccaggacaaagccagcaattgtgggcaaagtgtgctcaaggctgtgtgctgaggttggccaggctgcacttggcattttattcaagaatatttgtcatcctgatgggacaggagtcctttacctttcagtcagagagcaggtattatttagtactttcgcggatagatccctaaaagctttagggattcatatggattaccaggggctaaacatttaattgcaaaaccgagagagaccagattgcaaaatttgtaagaaactctcttgcaagagttagaaactgggagaaaagtatttgctggtctgaagttccttaatgtctttgctcagtcagttttgtctttggcttgaatgaacagggaagcctaaggtggcaggagaggcgaggtacgggtgtgtgtgtgtgtgtgtgtgtgtgtgtgtgtgtgtgtgtgtgtgcttgcctttctgtttgctgaaccattagccctgtggtgtttgtagaaatttgtgctttgctggcctaggcagataagggctgtcacaagtctgggtttttaaggcgacagactcaatgcctggcagaggctctgaggtacacaccaggattgggctctgctcagaggcaagaatgtaaccaatctggtctgggcagttggggagggactcatctctcctcactcccatatactttggccctgtttttcaatttgactgcatcaaagccaggtctcccttcagccgagggggacgtgcatcttcgtgactccacagagcatgtactgctggcttgggaactgaaaccacatttggagggcatgctgtgccagggagaaatggaagagacatctgtggccacagatggagccagcagagagtcacaggcaggtaaaggagactcgcccggaatggtgcggttgcttggatatttttgttcataggaagtaaacggaggcactgttcagtcagacaaaaattggtatgacagattctaaatgatttggtttttggatggccggttcctgtagttttattttgaaatgtgtcagttttaaaggaaggatttgacgtcacttattaaaagacatcttggaaccacgattcactcggttgaccagacttcttgtccttctggtctgccacttactgcctatctgttgaatgtgtggagggatttgcccagaagtgtctgttctatgagaatcctgtttgggtaagaacctcactagctcctcccaacccccaaatcttcagtgggtaaaggggattaacggtggcaccaagtctccaacaagggtgtcttgaataaacacccacccctgtatccacttagcttgtctatttcttcctggtttgttttcttagtgacttgccatttgtttaatctctgctggtgctaaattttgtgatgggcttcttgaaaacataaatactgagagatcccttctcacaagcttggaactgcagccctgtgtggctgtgtagtacggtaagagacaagttctgaggtttatactaggttgggcccagcagtcacatgggacacagattggaactctcctgcctcggggaagatcaggcaaagaatgtttcccaaacagtggatgtttgagatatcagaggaaagtctagaagaacactaggcctatgggaacatatgggtgaggacacatcttcagttaagtgtgtgtgcccatgaatcacgtggtgaggtgatggtttccagtctgcgatgtgcctgttctctctgcctactgctccatccagctacatgggtgggcttttggctccatggttagtgcgctctgtggtctgcctctcctgcctgttaagctggtccttagcccttagctcgctccctctccatctccgtcctgactccctccagggtggactgtgccctgtaatcctctgcctcatgcctgctggtttgcttcagggcacctgccaaagttgcttctcgtgttgtttaatgcaggcttcttggccttccaggtcttgttctctgcgctttggagagtgtctgtccttagggtgacagatcctggggatgaaggagtcaagagatgtcgttcaagaagcaaaagcactcttttttgtttgtttgtttgtcttcttgttgttgtttttttcgagacagggtttctctgggtagccttggctgtcctggaactcactttgtagaccatgctgccctcttacttagagatctgcctgcctctgcctcccaggtgctgggattaaaggtgtgcgccaccactgcccggccgggcaaaaagcactctttattcgttgaaatttggggctgttctgatgtaggcaccaaggactttcactacgatcttattcaggacctttgggtgtgacctcagtggggttattctggaactatttgaaaaagttaagtgttaaaaaaaaaaaatccaaaaatgcaaggaacagagaaacactctttggaataattgttataaacagaaggtaaattaacagtttcaaagaaaatgacatggtgagattctttagatacaatcatactttataatattttatagttgcttcccacattttatttagttttctgacatggcctggtggtgttgcttgctgacttattcttgtccgtgctccaacgacggtactgtattcctataattaatatcattataatttaacccaattaaaccctttacattgcataattagtagtgatgttctcacgctgatagcatttctttatcccagtaacagacatttgaggggtcaataccatcataacatttctccactccttctgtcggattttgttgttgttattttttctttgtatttgttttttgaaaacaggattttctgtatagcccagtcaatgttcactgagctcgtagggtggcctccttctgtgacctttctgccccctcacatcccaagtactgggactgcagacctgccctgccacaacagcttctctgacagcttttagatcttaccaaatagcttcgtttctgagaactagaagtagatggcttaatgaccgtgacttgtcacttggcttctaactgatgacggttgccctacactgttagctcaagggatggcaagctggctatctctggggaggctatgttcccaggcatgtctcttgccctctgtctctgcttcccaatttgtgttctctttttgggagaatggaaaaacaaacaaaaaacaaaccagaaacttaaaatgtttttattcattgtttgagaatttcattcaatctattttcatcttgttcctcatcctgacccctccaagattagcctcacgtcccaactccctcctgctcatgtcctttaaaaactgcatttatgtcctactttgggggtgagctttggctctctttattgtggagagcattttctgctcccctcttgcttcactcccgttcactctcactcactaggtagctatggattgcttacccagcatgcaccagtcgctaggccttaaagatggtgtacgacggatgactagtgtctcggctgttttacggtcaagtgtgtttcaggcggctacacgggagaacttaaattgtggtctgtttggtgtggctggaggacggtggcactttccacttctgacatcattgcctaatgtcaggcttctgggcttggctttctgccctgctgaggtgaaaggcgctcagagacttcatatttccccagaggcacacacctgttgctgactcttcttgaatatgaaacccacagcctagagtcactttctttggtttctctttcctctctgctctttcaggtgccattgtggggtggggtgggggtggggtgggggtgggagtgggggtggggttgtgggtttcagggagtgacttggagaagagctggccaacatcacgggtccctcaggtctgtgacttaaatgcattcaggggtagtaaggctgtccgtcattgtccttctgtcatgacagtccacagctagtgtttgtgctggaggtcaggggtggcactggctctggcagctgctgccacctgacacctggacttgtagtgctttgaggaacgtctatttcctcttggcatcaaatggtttttggccgtggccgtgagtgaggaaaggaagtattgtatagtatcatttactttcataaaaatagctttggactctctgggcttcctgtgagtccagtcagtgcctttggagccagggagctgccttcgagggcaaatgatccggcagaatggagcggtaccaggctgggccacaaaggaagaaaagaacacttaagttggctgttctccttgctgtcatgaaaccttacatacctcatctttcaagtgggagtcagagtcctgacacagcgtaacctgtaagagggccatgggcatcagtggcagtcagtgtcaatgaacagtgaaggccagccatccctcaatctgggcaccacctgacttatatgctaaggactgagccggagcattcgttgctgtagcttgccattggattggcatccagctggaagtgatctgagcccaatattcttaatttcagaatcaactttgttatacttactgtatttatactttgttggccagacagccttactcacagatattccccaggggagaagactttactggcgagggtacagactggcaagcttggggaatgtctcgcttgctggaggggctgccctgggcctgcaggcctgtctctcgtttcttctttgaatctctgtgttttctccttgctaaccctgccctctgatcttctttctctattctgcctttctcttcatgctgatgatcactctcatcacaggccagctctgtgcttctcctttagcagagctcgttacaacctctttttctcagccactgcctttccttgttccttttgcagcctctggctactcggtcccaggacttgagctgctccttgcagtagggacacagcaggtgccatgatacctgtggcctgcagactgagtcccttggctggcctgggaaccagctctttcagggctgtggtgcacagaagagagcaatcctctttcctctccaaacctattggtcgaatgagcagcccacatcacctggatactgggaacttgttgctgagtgtcctgatttggagatactgaatcgagaactaacacttgtcctttctgtccctcatttggacactttcttgtgactcttccacattgtgttagaaactgcaagggcatggtctgggacaatagtcagtcagtaaagtgcttgccagggtcaggtcttgaatttaattaccggaaattatttgaaaaagtctgagtgtgctaacacacatttgtaatctcagggcagaggaggcagagacgggagcatccctgggcttcctggccagctagcttagatgaattccagcaagggccctttctcacaaaaacaaagtggacagtgatctgggaagatacttgaggttaattaacctctgggctttatgcacctgcacccaggaaaacacacacacacacacacacacacacacacacacacacacacacacagatacacagatagacagacagacagacacatgagacacacagatgcacacacacatatataaacagacacacagacaacacacaagacacacatgcacacatatacaaagagacagacagagacacacacagagacagacacacacggacacacatacatagacatatataggcagacacatactctatcatgtatacagacagacatacacagagaaactgacagatagacacagatagacaaacacacacacacatacagagacataaatgcagacacaaattcacatacatagaagacagacacagagacgcaggcaggtgtacacacacacacacagacacacacacacagacacacacacacagacacacacacacacacacactaccagatggcaaatacctctggttcctttcccagggatgaccctgtctagttattacctgggtttttttcactttcccctcagttctggccctaactgtcataaatagatgcttatctcattctcagtggagagaaatgatgacacacaagagtccgagtgggtggagtgtccatgtttggacgagaccgtctctgtgttagcagctgcaggctggctcttcgatgactcacatgtgttaatccccgtatcttctgaagagagagcaccctcggatttgcatggggacatttgcacagggaaagaaacagtcctgtggccagggttgacgtgcagacaactgtgcctggtggactgtagtggatggtgcccatggaagccggtttgtaagcagggatagagttgccttttggacggggcagctgatagggctgggtctttgaggcagacttcagtatttgcacaggcaatgtgagcgggtgccagtagttaggaactggggaaattagtatgtttagctgcagagagtcagtggggagacaggcagtggcaggtgacagtggggtagtgttctgagcaaccctatttgaacccataggctggtgggcatcatttggtcaggtttcccgttgggttttgttatcgaggataataaaagaaaaactcttggatatcttcttcacgccttgccataaagcttgagcattctagaactctctagaaactggtcaggtttttctcacaatcccaacaaatgttcataagaaaagccacttactgcccctcgctctacaatatgcaggatgcttacagatttctaaaagacagaacatgtaacttcagatatgctggcacatgactgtaatctccgcacttcggaggtcaaggcaggaggattgctaaatttgactatagtgtagtcctcagggtctcaaaaatcccaagctagggttggaggtatgatggctcagcagcccagagcatgtatgtaagtgattttcagaggacttgggtttagttcccagcacccgtgttgaacagctcacaactgcctgtcactcagctccactgggatctgacagccctggtctctgtggagatcttactcacatacatataaccttccacccacatacccaattgaaaacaacaacagcaacaacaacaaatctttgaaaaaaaaaaaaaaccctctaaactaaaccaaacaaaaacaaagaacaaaacaaaacatgtagatgattcagaaaatcacatgtccttttattttttaaaaatagtatttctaaattgaggcggtggtggtgcaaagaggcaggtgggtctctgagttcgaggctaccctggtctacagagtgagttccaggtcagctaccactacacagagaaactcttgtcttgaaaaaccaaaccaaaccaaatagtgtttctactttcttctttgtctttcagtgttttgtgttttgtttatcatttgcggtcttggttaagtaactgtccttccttccaggaatcgcccaggcaatggccttctttcctgccatcagggtaggtgctggtagtgggagtggctatctgaaggactcctgctctaagcagttgactatgctggtttctcctaagtctctgacaggcccatcttgctgctgctaagaggttgcctcaccgggcatcctggagtgttgttctgttcttccgcagagccctgtgagctactacttgattcgtgaaagcactggccacttacaccagaaagcaactccggccttcagatttagctgcttcctactgtgatgtgtgcaccctgtcatgagagaagagagagcctcgttggcttacaaccccagcttcttcccagggttccaaagctatgattcctgctttcccctcctcctcaccaagagctgtgatgtgttgtgtttctcctctgtatacctccatgatgctttcctgattgtgaggaaaggagtcattttaacctcaagcttgactcttaggaattcccttcccttccttattccaagttaccgccctcgccgttgcaaaaacaggtgatccttcaagcacatggtgagtgtgtcgggggcacatttctcagcctctgtgcagttggggatcttacctttccacgtgtgctgtagacttgactctctgtaacttggttttgtgaatgataatgtccttcagttccattgtatactaatatggtagtgaagacatgactttagattttatttatatctttgttactttgggaaaatagtctgatgtgaaattactccacccatgaaataccatccttgcctttgctttttttggctttgcttatttttacaagagtttttcctggcgttgactttttgttgttgaatcatatcagcaataatatgaacattctcaacatatgttgtcagcatcgcgtgaagagttcttttcaccctaacgtaggatttttgctaatgatctttaatgtgattaaaagccaagatagaatttcatagtgagacatgaatgaattaaagaaatcctagaatgttttgtgaggaactattgtttcttagggtttctatataagtgaattcagctagttgtggatcaaaaattttggggaaaaattgcctttctactgtatatgtacagacttttttttcataatattattccttaaatgagacagactgcttatattatgatagttagtatgagtaatttacagataatgtaaagattgtcagcgggtgggattgttacagcatcttacataagggacctgaccctctgggttttgatatctgcaggcaggcttggaaccaacccctttcagatactcaggagaattgcatcccaagtaatgtcactctgatgagaacatgagagggaaggctgatcatgtggctcgtggataaagcacttgccccgcatgcccaaggccctagctttgtaggtagagtgctctgagccaccagatgaacaaagatgtgagaagggagtgtgggggcttggtgaggctgtggggttcacgagtacagacttgggatccgtcttctgcagctatgatatccaaaggaagctccggatataaggaaagggattttccttatcactcatttgaagtttaacctggacttgacctgggagggaaaccaaacctggtctgtgggcttctttcagtcttctctgattctgttcaccacccctaagcatgtctgctgcagaaggcattgggtttcgttccagggagatgccttgggtcttgcttctttttgatttttttttttttgatgtaacctgtgttttctgatatatgatttctcttctctcatggcaggggtttaattggcaacactttgtttcaggctgggtggggacaggggctatgaaactcagcacatgaagtgatagcagaaatgaggagggctgaatgtctagcctggcacactcagggttagtaacgaccagctcatcagcatgaagcgaagcagagcacagacatagatagagcactgtttatggattcttcttcattcatatgtgtgatctctgatggaagcatgggccagaaacaggacagaatgggaagtctgcaccagatctgtagacttgtttgcaccattgttatcaacgttaactccctgtcaggatcattattccgtggttatgtaaaaggctcacattatgggaggtgacatgaaaattttgtgtgccatttttacaacttattttaatgggtgtaaggtcatttcaagacagtttataaggacatgaaacaaaagtgctcatcactttctatttcgaggcaggctattataaagaggtgagaaggctatcagagaacagtcttatacccactgctgttaagtagagattgcccgttagcagggcagggcgttcgctggtcttagaaatccgcaggtgaagtcaggcgctatttcagagtcagaaggacacagcgtaccgtaccggacctctttcttttcttgacatgaatgaaaagcaaagctatggcttccgctgaagggcagtaaagaagagctggcagccaaggacagtgctgtgctgagtctgatggaggagcgccaaggccctcccacttggtcaccctggtgttggggtgtggcttggcactggcttttacctggtgcttggcactgttaagagtgtaggttcattagtttggactgacagtcataatatgatgttcaaagccaagagggtttccccatagcaggataaggagactgtgtaccttctgtggctcagtcagctgacctgggcttgaaagtttgtgtgcttttatatttgtgtatatgtttacatatgtgtatatatttgtgtgtgtgtttgcatataggtgtatgtacacatgcctgtgtttatatttatatatttatgcatgtgtgtgtgtgtgtgatatgctggctgtgtttcttccatagcggatgggtatctgaatgtctttccttctctcccctgctttgctgtgctgcgtgtgtttcagctgtttatttgttctttattctctttccacgccattcctttctttccctgctggtgagaagagacctagtctcacagccagttgcttcggggctataatagagttagtggtatgtaccaaatgtgattacagctgtctcaacaccagatgaatgagagtgtgcataccctggacagataattctgacagaaatggcctattggtttcacatgagctaggaccgaggccaccgtgtaacctatcagaagaacagatctgtgaggaacaggttcccacaggcccgaagagtttttgggaaagagcctgtcatgagaggtttttaggagttccttcagataaccctagagaactgatggtcacgtcattttttcccattctcaggggttaggggtagccccagcgctttgcccaaaggttgctccatctttcatcggtcctgcagagaagccagggtggtggctaaatgggccgatgtgtggcttctttgctttcgagctttgatgtcatttctatttagctcagtgagattgttttagaaaatttcccacagtggaaagttctcttggacatatgaaagttcaatggtcactttcaaaatcagccatgtgccaagaaataactaaaacaatggattgcgtagtgcagcagccttgggacatggaaaaatttaaaagatgtatgattcatattattaatacaggttgtaagacatgaggccttgcgttggaaaacagaaaagggcctttctgtttttgttgtttataatttctctttctgggtaaaataattattcttattttctatgatgattattttgcctgtatgcattcagtgtttgtgaaggccaggaaagggtgtttgctcccttggaagtagagttttcgtggttgtgagctgctatgtggttgccagtaactgcacttggttcctccccaagagcagttaggcctcctaaccactgagccacctctccagctccaagtgctattttcttttgaacttatgtcctatcttagggttttactgctgtgaagaaaaaccatgaccaaggacaacatttaattggggctggcttacagattcagaggtttagtccattaccatcaaggcgggaagcatggcagcatctaggcaggcatggtgcaggaggagctgagagttctacatcttcatctgaaggctgctaggagaagactggctcccatgtcgttaggaagagggtctcattacccacccctacagtgacacatttccttcaacaaggccacacctactccaacaaggctatacttcctaatagtggcactccctgggccaagcacagttcaaaacaccacatggtcttgcagtattttctttgctgtactttatatagattttgttctgtttggtttttatgagggaggattaaaaaagttaaattctacagtagaatgttacataaagaggtaattgatatcatcctacatgaatttgttcagacatgctaaggtttgaaagaactatcagacctttgatttggactcttttcctcgtttacattttcaatgctatcccaaaggtcccccatacccaccctggactctttttttgagtagtcattgtattctcccatatcaatacttttgatagggaaaggtaatttaaagttactgtctgcatatgaacttggttacctttaacctgtgtgtgacagctcagtgggtaagcatgctggcttccaggccaggcaaccagagttcaagccctaggaccaaccctgagtgtctccctgaccctcacagggggtgacttggcttatgcccttgccccataaatgtcacaaaggctcttttttggaggattttctcccgaagaatatttacaaataataacttaccaaagcctgcagtcatttggtctacttctggttaagaagacaaactgtagcaagtgcagacccacacaactatgccaggattccctggtccctttctgaagctggctcctgctgtagatgggtacctcttttctctgggattatgcggggtcaggcttccattcttgcttgttgctttggctacttagctctgcctatgggaacggagatgctttggtttacgatggacagtggatatggagtgtcgtcatggaactgctggggagaatgttaagtggtagagccagtttggaaaagtgcacagtggttcttcactacattcatagtgttatataattcctttgtggctctcctcctgggatttatgttatctccaggaggagtgaaaatgtgtccatcgacgtaatttacatgcggatatttagagctgaaaagttaataatagtccaaaggtgagcccaatgcagttgcctgtgaacggatgaaggctgcgacgtgccttatccacgcaggaaagcatcattctgccacacacgatgagatattgacgtccgcttcagtgcagaggcttgcaaacatgctaggtgaaagaagccagacccaacgcagcaaattctgctgatttcacttataggaagtatctagaaccagtgaatctctggagaccagagggagatgggagtagctgccttgggctgggcaaggaagcctgtgaatgactgctatctgcaggagtgaagggaggctatagcattgatggtggggtggctgcagagtctgcaaacacactgatatctgttgacttgggctctgcatgtgtacttacgatttcctactacgtgggttatagcagtaaactgggttttgactaagtgacatgactggagccattctgattctttactgtctcaccccatcttattccgttggaggatgaggatcagaggacagagtgcttagttgttttttccagagtctcaagtctatggtcttctgagctacatagataggttccttttacttggaactcctgtggaccctggtagggttacatattctgtgagaatctttgtgctaggtacggattctgtttcagaggaggaaagaaagctattagatccatactaaggatgcaggcatggcagtacaaacacctttccttctcttttgcacgtgtgtggagaacacatatgcaaatgatgtcaagagaacaaaacaaccatctaaaacagaagtctggaaaatatgagtctgtgtggttattgtttttttccaccgtagcagtttctttctcttttcctttgtggtttttggagacagggtttctctatgtagccctggctgtcttggagcttacactgtagaccaggctggccttgaactcacagagatccacctgcctctgcctcctgtgtgggagtaaaggcgtgtaccaccaccaaagtaaacactgttgtgagtatgcatagtggggtgtgtgtgtgtgtgtgtgctgtcagacaccatcaaacaagaaaagttagcatctctctagttgctttggaacattcaaaagctctaagctgtgactattaaaaaccaaaagtacctcaagagttcttaactgactgcggagtttaacttcctgtctgaggggaggtggagttagatttagtcagatcctctcgtgggaaaaaatcaaagggactttaaaaaagaaaaaaacaaaacccaacctaacaggacatcccagtgtgcagttcgcgggcggcttttgtgttgatttccttcacagtttccctcatctcagccactgtaggtgatgagcagcctggcagccaccacatttcgttggaaaaagtggaggttggatctgcctgggcaggtgcctctccaggcttgcaggagatcccccggtaagtttgtcagtggccagactgcagttgctaagggaggctttggacagagggtgttcgagttggcagagcctcactttctctcgataagtctgatgtgtaagtcaggaagcggctgaaagcagggcttatctgtgacaggcagaggtggcctgttcctccagagactaggtctctgtggagcggaagagcggccacacatcaggtgcttttcttctttggactgaagctgttgaacgcctttgtgtccaaggtttgccactttattcgaggcagctggttcagtattgagtgcttactcctgtttcatttttattaatcatgcattggtgttttgccagcatgtatgtatgcatgtatgtatgtatgtatgtatgtatgtatgtatgtatgtctgtgtgaggatgtccgagtccccggaattgaaccagtgctctcaaacacagcagccattctccagctccctgactgtttactcttaaagagaaacttttcctccgtggcaggctactgatgtagcccaggctggccttgacctctaggtcttccagctccacctctggtgagctggattttcggtgtgaggcaccaagtcagatgctgaggtgtggactgttgacagatctttctaggaaggcaacattctaggaagtacagatgtagttcagagctgagaaggagcacaaggaagcgttgcactgttggtggattgttggggtgtctgtttactacattggggtgagtgggggaaactgggggcttctgtttcttacaggtttgtccttggaaaggcagagcttccagggggttggtgtcctgacctttttcctaattaaagtccatttccagagtggcttagtttttctgatcgttgcagacatccatgtattcttagatggattcatggatatgctggctctgtggtctgtctgagggaaaaaaaaatcctaaagatgtgttttcatgtgctgtaagttctttgagttaatactttccctagaaaagaacagaaaccaaaccagataacaacaaaccataaaaaaaccaaacaaacaaaaaacaaaataaaattaagggtagtttttttttttttaaaacacttctcttcattgcaattcttccctcctttcaatattttggttcgtagtaacataggaacactgcactaggtgtatcctataagcatgctaccgaaataagagggccagcttgtgttttcttagagatgagctttcttggccaacagctctggggtgttcgtgtgctgcaattatctacattgcccctgtctttgttttcttactgaggagctctaaggtcccaacatataatcatgagacctttcagggctgtgacgaacgctccctgaacagaggtagtcacagtggcactgtgacctttctgaaatccctttaagtctggtggacttctcttttctcctgccccagatgtcagcctacaccttgtcttgctgcagagagtctggagcagctgctgtggttgcagtcagagaccaaccagaagaaaattatgggccggagtaaacaaagttactagatgacaaggtcagatagtttaaaaactgtcctggctgagttctgctctgtttaggtagtactccttcctttgctctggctgctatagagactttgtgaagataacatttaaaaaataaaaatatttcagggatgttattttcataaaaatagaaaaccagtgtttacctggtcccaaattctataggagttcagcatcttttcttttaaattaagctgggctcattctagttttgtaatgcgttatttcttcagtgatcttgatagaagtaaagataatagaatcagtggttaaagtggtattttgatggaacacacagtcaagtaccagatgatgcgcctgaggtttcccctgctcagggaacaactttgggagagcctgcttagcttgccacccttcccactctcttattggctgctgagactccatgcctagattggcatttcctttttagatggatggagcagacgatccaagactccagctgtctattgtagccacctgtatcctgaggctctttccagaggctctgatgtggctgaactgagacagtgactttgtagctttgccatagctctctggagtgtcctggatggagcagtgtggctgggcctgtggagacgatgacttttgtgccaactgaactggcagttagttccaccctagatggataagaaggcattatctcccccatacccaggtcaccacctgaggaagcagaagtctgaagtgctgtggggcgagcaagtggattccatgggtaggatcaggcaaagacttagcttccagtgtgtgctgatgttcagggcgtggtgtgtgatgctgagattgacagctgagagggagaagctcaagaaagtgatcttaaggaatgggtgactcactcactggaatgttctgatgaagcaaggaaaattgggagctttagaagttagatttacaccaggaagtgtgtgtgtgtgtgtgtgtgtgtgtgtgtgtgtgtgtgtgtgtgtgttacagagattaagagtgaatgagagaggggaggaagggggagagggagagggggagaagaaagggagagggagagaaggttggagggagatttggaaacattggcaggaagttcccctgtactctagtggcttcttctggtgcttgggttggcagcctgcaagtttgatttcccttgaatgttgaggtcttctttaattccttttagttaacatgtagctacctggtggtacaggctgtaccctgggaagcgctaagagtataaaattgcctctatggggcatgggctaaaatctggggctgggtaagaggcctgggccattgttgtctgacttgccagatgcttgaccccatgatggagctcaggcttgagagcatagtgcaggccctgaggtgcctctgtaaccctgctggctaaagggaactgagaagttggttctgaagaccaggtagcctatcaattacaaaggcacaagaatgccagtgatttggggagaagaaaggcagaaggtgaccagagaatcgtcatcaagaagaccctggagcaatggttctcaacctgtgggttgagacccctgggcatcataagaccctttcacaggggtcacctaagaccattggaaaacacagatatttacattatgattcataagttgtgtaaccggtaggacataaatggattgataatggacttggactgctgatcagtgtctaggaaaagcaaatcagacatatcaaataccaaaagtacccaaagacatgtaagctacaggctctcacctcctcatctcctgtgtatttttccttggtatcacttgaatggctgctcatggacatggtcctggatctgtttaatgttttcccatccgtttctctgacccgtgcttagagggcaccaggtgcttcctgtttcaatcattagcaggttcagcacttgttggaaatcgatgttaggtactgtgtggtaatttgataggatctgggtctagtgctcccccattcctgtctcagcactttgaccttcatctcaacagttcagtgacctggcaactctaagtagttttttcccactgcaccaggacttgcattgtttggtggaggaagatgagtcatagcctagttctgccattgtgtgaggtgaaatgctagtctagggctaaagaacacaggtcaggctttttgtgtaaatcagaataatcgaactggggggggggtaggtgggggtgacgggattatgggccagggtggccattttggtgaaattactctcatcttggaggaacattttattttaacggatgtttcacttcaaacctaattcttaataatgctttgaacaatcttaaggagtcagactccttcaaacaaaaatctatacagaatcaaaattatatgggacagaagaatgtcctcccctccccccctttcctcccatccccataaccagggttactgccttgggtgttctgtgtaacccttttgctatgagtataaaaatataaagtacaaaagttcctttttgtatcaaataaaaatcgttgtgtgttagtagcatgcaattaaatcaaagcaaagcaaaaacaagccacaaacaaataactgaaaattacaaatattaatatcagggcctacacatcttagcgtactgggctgctgtgagagcatgtgtgcttttattattacgctgccaccgtagagggtgggtgagaggatttgtgtgtgtgtgtgcctgtgtgtgtccctgtgtgtgccaatgtgtcttgagacaaaccttccaatcatcctttcctatgctggtgcccgttttcttctgttgtgtggatccctgattttgaaactcttagcgattccaaaaccaattcctacataaaacgggggagtttgaataacttgctttaattttgtttgacttttaaggtggttaacctctaacttaaaagattgacatccttttgctggtctgtgagatagaggtttacgtctttggactcagaccccacattttccctctctttttggtggctgtggacacagctgccatcctaaaccacacgagaccagtcattatttaggtaccctcaatattttattacatttttcatatactggtaattaatttcacatggatggtaagcccggaattctttaaggtccatacattgtggagcctgttacagtcagggccaggaggctgtggagtgaaacttgaaactaaatagcagttctcttggcactgaatgcagtgaagcctgtggctggagggcggcctcagtgctaaggctacttgatgctcttgcataggaccccacatggggtggctcttaaccatccataactttcttccctgagacccaacagcctcttctggctttaaaaggcacccacacaccgatgaacctacatatactcatacacacaaatacacttaaaattcaatgttagtggtgcctctacctcccacccccaccccccggcagggtttctctgtgtagccctggctgtcctggaactcactttgtagaccaggctggcctcaaactcagaaatccgcctgtctctgtctcccaagtgctgggattagtagtgtcttcaagatgaagttggtaaggctcattttgttttgtaaagacatgtgaaaatacaaatttcttatctaagcccagttgagggaaggattataacaaacgaggaccacttatgataatggagtctttcaagttgatatagaagaaagtacatgtggttattaaaggaagatgagacttttgtttcaatctggcaccgtgcttaccgccatttattatttgttgctacgtccctattcttcaatccagatagatcccttaggaattttccacgtccgagcactgagcctgtaattttaggctgggttcatttaactgtagatgctctgcatggcaggagctacacagccatacaggagacacgagctgtgtgggagatgtgatcgaggcgtggtgcccaacgtggtgttgctgtttttagagttcactttcatttgctcagaaaggatctccatctctgtttgctggcaagcagagagcctgggcacctagctgcccctctagttctctgcctcatgacctagttgctttctggtgtcttgtacaaaaagctttatttagtctgcagagaggtttatttctccaactaaaggagcgctgtcaccgtagtctaggagcatgatggatgcccagtgagtgctgttgctcagatactacaggaggctgaccctaaggtgctaggaagaaagacaccgagcacagattcctccagctagctttgcacatcatcatcatcagtgaaaatactgccagatagccatttgcctgaccctccacaaagcagctcctcttactgccccagctctgacccttttctctcggttggtacaacaagctccttgttgagaacttagtgccaaggttagtctcctggcttctgacctggcctgttttcttgctgccttctgatctgcatgctttcagcttctgcttggtccatggcatttaccccttttctgatgtttgtcgctgctgggtggttttgctgatccccttttgtgataactcaagagagagactcagccatgcctggtagtgtctgctagttgtctgaattagttaagatggctgtaaatatgcatcagctgggcatcatggtgggcgtgcacttgtgatgccagcacttggtagggggaggcattgtttcaggccagcctggtggacacagtgaggtctaggcaagtcaggattaaataatgggatcttgttgaaagcatgcaagtgagaatgaaaaaaaaaaacgtgtatttattatctaactctgagtcactagtgtataacaggaaaagtatagtcagggtgtttttgcatgccctgccagagagcagttctggtctggggtcctatgatgaaaaatccctagcctgttgctatgctctggggaaaaaaaaaaacaacaaaaaacaaagaaatgatctgctaagcacatattgagtgcctgctgttttcttggtcttaagaccaagtggaagtattatagtgttttttgtttgtttgtttgtttgtttttaaggctttaaaaatttatttatttatttagtgtaggtaagtacactgtagttgtcttcagatacccctgaagagggcatcagatctcattccggatggttgtgagccaccaggtggttgcagggatttgaacttaggacctttgaaagagcagtcagtgctcttaacagctgagccatctctccagaccacttgttacagtgttttaaatatatgtattttaaagataagatttattttatttatgtatatatgtctatgtttaaatgaatctttgccatatgtctctagaggccagaaaagggtgttggattccccccacagctgaagttacaggtagttataagaagcctgatttgggtgctgggaatggaactcaggtcttttggaagagcagcgggtgcttttgacctttgagatatctgtccagccctgggctagactgttttatcctcaagtctttgggatctcttttggtgggttcctgttctatggtcagttcccaggcaacagcttttaggatagcccatgctccagttgtttgagacccacatgaagaccaaactgcacttctgctgcctatgtgtggggagttttaaataggttttgttgtattgttttgctttgtagcccagggtcacagcatacactttgcagacagtgcacagagctagtgataagcgtttgtcctgagtaagaggagcaggctcatcagtgatggtaaggtagggcctcatctcatgcttgagtgttggctttgaggtctagatccgtcctgtgaaaaggtagtgagtgggtgtgagtgtcactgacatcaacatcctgatagtactgatgtgcccaccagcaggcagattgcagaggacaggaaaaaaaaaccctgcagtgctaagcaacctggtcaagagggcaccatgttgctgttcaagtaggctaaaagtggaaaaataattagcatgtgaaaaggcttgtttgtggaaatggctgtaagttaatggaagcaggttgatttttctgagttggaacacccattcaacctcaaaataatgttttcacattttgtcctaccaaaacaccaactccccccaccccccaccccagccctggttttccagcctgagtgtggctggagttgagctcatctgctctgtgggcttccagctgtttgactggcacttgaaagccactgagaggcattccaaagcttgagtttctttgtagcccaaaccaacctggaccttctgatccgaaggctgagatgacaggtgtttaccactggaaaagtaacttgtattaacctgatgcaattgttgactggtctccttggcttatcacctcagtctgctaacctaggcctagttctggaagcttctagtctccatacaatctaatctaggcctagagtgttttcagccactgagacttacggctgaataggctcaccctttttttttgtttgtttttgtttttgtttttgcgagacagggtttctctgtatagccctggctgtcctggaactcactttgtagaccagactggccttgaactcaaaaatccgcctgcctctgcctcccgaggcagaggctcaccctttcttattctttctgagctctggctggctgattcaactcagctgttctggctcaaaactcctcttcaactgactggtccaatctggcttctctctcagcctattctgaatggccctgcctggcctcatactatctttggcaatatgttctaatcttctggctccttctcattctctagctcattctgtcttcatcagtgtctagtttgttctctttctgcaacctgtctctgtacaactgtcctgataaaactgcctccttctttctccttttctgtgctgctgctccctcgggtcatttccctttcctcttgtgaaacttgagcatatcctactctgtcaaatctttctctgatttgacactttgtctgccactcaattagacaccacttacaagcatgggtgcttccttctaaaaactaacgttactttcattgtttgggattaaaggtgtgtgctaatggctgagccacaccattactagaaacaggatatatatgtatatatacatacatacagtaaataacaaaattttggggttcacagtgtgatcaaataacctgcaacatgccaccatgcctggtttctctgagcctgagggctgaatccaaggttgcttgtatgctagcaagtgctggacaactgaatcatactcccagctagctgcttggaaagccaggtgcttggaaagccaggtatgtcctcacagtttattctgcttttagaataattctctattcaggtgatcaagtacatcttgtccaagaattcttccctgacttctaaatatgagtttccttcctctctgatctacatctttcccaagggatcaagttcagatatccctggatatattccccaacactgcctttatgagatatgctgctgatctgtgctgttgaaagctagtctgtctctgccatgtagggcctgggaacatcttttttgcttctactgctatgtgtctgagaaccttcttttaggctctcagtttaagtcttgtctgttcttactaacttgattcctcagacccatcccagttcctgggttatttgttggcttagggattttttggccagtgaacaataattgactcagagttgtatggatgcaggcctacgtgctggtggaatccagacatctgaatgaagtcatatgaggaattccagcccactaatctttattgttttgttttatagatcagcaatatgtgagaatttaatacacattatggctagtttttgcttttgtttatgtttgagaaaacatattatttgtattttaactcttaaaatatttttcctcctctcatttatttgcttattgtacattatttttagtgtgatgtgtatgtgtgtttgtttgtgcatgtatatgactaggaatggatatggaggccagaggacaacttgtgggatcagttctctttttataacatatagactctggggattgcacccagagtgtcaggtttgatggcaaacaactttatgcacatcttgctagtctgcacttttacttttcttttagaaggttttacatttacaggaaaattgtaaagatggttctgagagtgtactcagtcccttctctacttagttaatatcttaccatcattgctacattttttaaaacaaatggaccattagtatattaatcatgaagtcattatcagaaatcccaagtttccttaagagttattattgatttaaaaaatatttatagctattatttataacatatcacattttgacttgaattgtttttgagtgtgctcaggctcagagcttttgaatccttacatgtcatactttgtaaacacattgacaaaacagatgaaaacttgtgacgtgggagtcagtctctgatgagccttctgggacctggtgaaggagaaggctattttaaaggctgacttatgtctaaaatctctgcattactttgcagtaatgaaaataattacttgctagtaccttaggttttattacacatgcgtttgagttacttataatctcctcaaacagaaaggatcattcgaaataataggtatggaatagcccttgaccaatcagatccaagagcaaatgaccagaaaagaggcccactcaaaaatgaataactgccctgctaacttttgagtgccctataaatgtctctagacattgtcgtatgattcagttggtagtcctaatgtaaggcagtcatagcagccaggctctctgacagtgagtactgtataaatgtttgccatggttgatgtcttttttcatttgttatttctgatcaattaaaaacatttagcttagtgggacatcagacggtaagtcactatgtgttaaaaatgaggttctaggccagtgaggtggctcaggaggtagaggcatttgctgtgtggcagccctctgacctgagtttaatctctggaactgatggtgggaagatgagagttaactactgcaagctgtcctctgacttctacttgtgtgctctggctggtacagccacatacacacaacacacacatgcagacaacacacacatgcacacacgtgcacatacagagacaaagagagaccgagagagagagagagagagagaggacaggcagagagggagaaacagagggagaccgagacagacagacagacagacagacagagaataacttaaagaaaacctgagaacttgtttaaaaagataaacataagtttttcattcttttatgatgcggttgcattttggtgtagggatatggctgagttggctgagcgttgtccagtatgtaatccatgagaccctgccttcaatcccgagtagcacacacatcaggagaggtagctcatgcctgcaccagaggatcagctactcagtgtcatccttggctacatagagaatttgaattggaggctagcctgtgtgctgcgagagcctatcttaaagaggtgggggggggggcaggggtgtattttgaattcaaattttcttagagactcccactgcagaagagggatatagatctctaggttgactgctgctctctgcactgtccctttggttcccgtgggaagaggagacccctgaaaggactaggaggtgtggaatttggaggccagtttctcccaaaccccattcagctacctgctgcctgctttgagtgatcgcagcagcatgcttggagcctgtactttggttcctgccaaatctccctcatttccccatgatgatatgttattagtctcctgatccctgttatttgttaagttaatctgcgctttgggaatctagtaagatcacagcattttgtttttgtgacttcattttgtagtatatgccctgggtgggtgcagctatgctggagttggtgaaacccaataacttactgtctacaaacatcattttatacttagccttcctgccctcttcagggttccagaaacagacacctccattgtttaagcagtccttctgctatgttttctaaggtagccattttcctattaacagaatgtgttttttttagtccttaatccactgaaacagaacagtgtgtgggagcagagggtgagatgaatgccccatgtagcatcttccatctcagcccttctgtggaaacgtgggcagccttactgtgctttgaatgactctgttgtgtttctcagtaaatacttacttgctaatattggttgattatgaagttcttcttgttattgttttttcttaaacccaggctgacctcaaacccattggtagttgaagatggcaggaacctcggatcctcccgcctctaactagtgttgggattacagacctgtgtcaccacacttagtttgatgtgacagtgtggactctgcccaaccataggcattgctgagagagaattagatacgtattttcttgtttggtttggattttcaagacagggtttctctttgtagccctggctgttctggaaccctctgtagatcaggctggcctcaaactcagacattcgcctgcctctgcctccccaagtttgcccagccttgttctggattttgttactttcattgtcattggttcctttctggattctagttacttatttccaataacttcctatgaacctacttttgggataagaagtttaattttaggttgtagggatggtgctgattggtcctatcccccaattggttcctgatctgtcagtaaagatgccatggaccagttactgggcataaggaataggcaggacttctgggcccccgcaggcaagcaggcagactcaaggagaagagagagggttttggtcatgctttggaaggacaaaaggtgacccgtctgtcatgtgagatattggacaggatggccacaggctggttctacaggcacaaggttgggattcttgagcttggactaacaactgagcagctaaaattgaaaacagatttagggttgtgagctaagagtattgggaagcgtacactagccacgggagtttaataatgcccagcaattgagccaatgaggaaagttgaacttgagcaacttttgtctgtggttttgtgtgtgtgtgtgtctgtgtgtgtgtgtctgtgtttttcatccatggatcaaatactctcgggggggtgggggtgctggtagtgcagtccatttctggagctgaggcagggtagcaaaagctacatgcaacactgaaactattaatatggattgttaagtgatcttcagtagactcagtcaagtttagtatgtttgatgatattgttttcatgcagtatcttgtttgtattatgtgttttttgttttttaaaaaagaatatttaccttttatgtgtgtagatgttgttatttccatgcacatctgtgtactacatacatgccatgtcacgagaggccaggatcccttggtattagagatatagatagttgtgagctgccatgtggttgctgggaattgaacccaggggccctcaattgagtaaatgcttctataagcttgggctgccggcaaacctatagggtactttcttaattggtgattgatgagggaggactgagcccattgttggtgatgccatctctgggctgggtcatgggttctataagaaatcagatggagaaagccatggagaacaaagcaggaagcagcactcctttatggcttctgtatcagctcctgcctccaggttcctgccctgtttgtttcctgcccttacacctttgataatggaccatgatgtggaagtgtaagcgaataaaccttttcttctcaccttgtttttggttatgatgttccattatagtaatagtaaccctgactaggacgattcctatcacatcttcatattttctgtgtttcctggtgctacttccaagagaaatgacaaagacttgattcttcaccttagtatctcctttgtaagataagccaaagtatcatgttagccagctcatctcatgaccgtggctgatgagagaagaaggaagaactttccccctagtctacaggaccggtctaatgcatggcagaatggaatttagtgtcctcaattgaagtgacactcaacccactgtctcacactgtcctggggaccttgcaggatttcagagtgactacagttttcccttgtggcctggctcacacagaacatgactaatattaggaagtggggagggacccctttatagagttttctaattttgtccttcattttcagctaattattcatgccttggggggtaaaatagcttagtaggcaggacaatattagttttaattgtgagcttagtccagagggctgtgcttgagtgaaaaccatccaggagttggggaaagagcagatggttctatttctggctgctgagaggggctttgcagggctgtaaggaaagatgggcgtgttgattgcaggcacagggcacttcctgggatcacatccattatgccactgcttcctcactgatattaaaagaaattaaaagcacaggccagattcttaaagctaccatcaccaccaatcattgtggaaacaatcctaaaacagttgtaaatatctacttcattaagctacaacaacaataagaaaacccaacccaactcatcattggtgatgatttctaaaaagtcatctttggaaagagtaaacaaattagctgtgtgctttggatctgtagggaaccctccccagcccctacctccatgttttgaccattgctgtccaggtggtgatgtggctttgtgaggccgaggaacacttgggaggccaagcatagctggtgcaggtaggtctctgggtctgggctttcagttctgtcgtgattgtctgaaaccatcagaaccatgaaccaaggtaaaatgttcttccttcaagttgtgtctgacaggtgtgctgatgaccacagttatgctaatgtagctaataaatggcttattattattattattattattattattatgtaggaatgctgaagaaggcctggtgtggtcattggatgctagaatccttctattcaaatgtagacagcaaaaggcctactaggaagggcaagtgctgggcctcctcagccttacaaccttcttttcctctcagcctctgctgctcttctttgcctgtaaatttccaagaacatttgtcatagatttaagtactttttctgtttcctctccaacaaaatatggaaggtgatttcagaagagtggaggccattgcatgggtctcggtgacctttacaacccagacaggatgtgggccagcagaggtacacagtttccaagggaaatttcgccctttgttttttgagattaataactgggtgggatagaaagccaaatgacttcattgttgagcatagacttccaggtcatgagatattgcccgtgtgaactaaactttggcaaggtgtggtagactgatgtgcgtgcacacctcaataatttcagaaatggagcagaagatacagggacatgccattctccatgtgatttgctttgccatttaattttatttaaatgctgaggcccaagcctagggcctgtgtattccagggaagcattcagccactgagccaatcccttgatattaatacatactttaaaaagcacatcaagggggctggtgagatggctcagtgggtaagaacacccgactgctcttccgaaggtccgaagttcaaatcccagcaatcacatggtggttcacaaccatccataatgagatctgactccctcttctggtgtgtctgaagacagctacagtgtacttataataaaaataaataaatctttaaaaaaaaaagcacgtcaaggaaagagctacttccgtcctttctctactaatagcactccgtggcagaatgggactgcctagatctttttgaagtccatctcttcatgtctgtttggatagagggtttcttatcacaagatctagctagcagttttaattataaatgacaagggcagatttagtttgaagttgatagagggagagtctattatctctgaacaagtacgaactaaggtggttgaaggttgacttggcaaggtgacttccctttctctgtcaagttactgtttgcttgcattaccacagggtctccagtctcttaccagacagcttccaaggccttcctaactcatcttgtgtgaacttaggtgtagggtagaggtgacttcaggcgggtagagatgcagtcttcgttggactctacccatcagcatcatttctctgtgtaaagaagtatggggaagagtgaagggataagactgtttcttcctctaaggattaaggtctcattaggagagctgatgacgcaggcatggacatgtaaagtgatttgtagtaagcaaggaattaagtcctgtctaaattccaaaggagtggacagagtgctacactgctaagggagaggctttctttaaagactccgtgaaagctaataccatttgggcacaagtggtacacacgtgtaatcctgtctcctcaggaggccgagtcagcctgattcttaattcaggctgtctgaggcttcagggacttcaaccccagcctgggaaaatttggccatgtctcaaactcgaattcaaacaaactcttccagagcctgtgtggcatataggaggcccagagttgaaccatcagtggcacctacatgttggcctcaaggaaagacgtgggggttgatgggaatccggatctgagggaaaatgctccaggtttgaggggctgacttgttagggccgacacagagaccacaggttttgagcatcgttcagaggtgcagaattaatttcaaggtcaggggcatgtgtgggtgtgggtgtgggtggatggcgtggtgctcatgagagagctggaaggggaagttggggaggacttccctcctgaggctggaagtctgggcatgattatcctggctccagtgagtgattaaaatgagtgatggcaaagctccctgcatggattttaatatttaagattctgctgccaaaggctgagctcactgctcttcagagtgtgactgtgaccaagggatgaagtgcccccctgttgggtcagcaccatctaggctgaatcccagctaacacctgctgaaggcacttcccatggacatctgcttctcccttctgtcctctagcaaaaggtaaaaggagccttggaggggtgcggctgtcacatttctgtcttccaggtctgcacctatggaatcatcctgtggattatgtgtggagacccagagcttgtaattaagccctgctgggctcgaagctctggctctctgaaggctcctgctgctttctgcttctgcttgagacctgctctctctctctctctctctctctctctctctctctctctccctcccccctctctgtgtgaatgtgtgtgtgtgtgtgtgtgtggtggcggcggctgtgtcagttcccatgtcagttccctcttgctgccagacgtgtcccattaatgctgattttccagcctagcagtcctttaatctttcagttgtggggttctgttgtggatctcattgggataaaatgaagatattggtgggctctgcccttcttgaaagtaccagggatgagtccgtttccttttcctgtccaacaggctgcttcattccttggctcatggtcaatggcactctcaaaagcagcagttataggtcaggttctaatacattgctgacgccaattctctcctgccttcctcttatgcatataaagagccgtgtggtgacgttgggcatactggaataagccaaaatgattgccctgttccaaaatcagctgattgtcccaaatgaacacatgctgctccatgtctcacactatgcttcaggtagtgaaatgctgtcaccatcaggatctcactatcagtacatgaaggtcttttgtggggagactggaccaggtagttatattgttttgtcttccatagtgggaacttctgatcatttctttgtcacaagaatgtaagcacaaagaatttaagatggacgctcattcctcattttgtcctgtatgtctgggtttagtgtcagcatgcctttttagcaatcaatttgttgttgttgctgctgctgctactattttaaaacaacagcacagagagttgttcttaaaagtttttgtgtatgctgggcgtggtggcacactcctttaatcccagcactcgggaggcagaggcaggcggatttctgagttcgaggccagcctggtctacaaagtgagttccagggcagccagggctatacagagaaaccctgtctcgaaaaacaaaaagcaaaaaagtttttgtgtgtatcaggatgtctgtttgtctggtgatgggggaagggaaggaccatctcaagttgttttaacattagggacagcaggatgctggcatctgcacacattatagatgtgggttattaactctactgtgacagaaaccagagaacgtccttgccatctacttagtctactatcttctgaagctacacgttacagtggctgtgactcagtagctttctctcagtgctgttggctctgagagcatccgacagtgttcaagagtgtttgggaagaaaacaagtgaacagctaagcaaacagtggaactcaagtgattccaaattcaggggaagtgcagaagttcagaggttagatagcaagcattaaaaaaatgaaccgtatgcttagtgggaatctcatctctggaatggattcacttaaaacacattttaaagattaatttatgtttattttatgtgtatgaatgttttcctgagtatatgtgtgcctgtgtaccatatatacacagtgcctgcagaggccaagacattggatttcctggaactggagttcatatggttgtgagctgtcatgtgggatgggatcagaacctgggtcctctgcatgagcagccactgctcttaaccatgagccatctctccattctcgcaaatgtattttcggtaaattgtctttcttgtggcagagggtacagattttatgtgtattacaatttccttctgacccaataactcagatggtattatcgccatatgaatataaaaaaagaaaatggtgtcttaaagtgatatgtggttcagccaggcatggtggtgtacacctgtaatttcagcacttggaaggctgaggcaggaagattgctacatttttgaggtcagctcaggctatatactgatttataggccagccagaaccacagagagagtctttctctttgaaaagtctaccctgtcaatcaaaaccttgataaaattaaaatagcagggcttgtggacaacattgaaaatatgaatatacctgttcatggcaccacaggaagtcaacatacatgtttaagatgagagcatctgtgaaccagagatttgttctgaaaatacctctcagacataataatcactttggtctgccacttttttgttagttgtttgttttttttttgtttttttggtttgtttgtttgttttttcaagacagggtttctgtatgttatagccctgcctgtcctgtgagtgtttgaagaccagctggcctcgaactcagagagatcagcttgcctctcctcccgtgtgctgggattaaaggtatgcaccaccatgtctgactttttgttagttttatagatatgaattaaattctgtggagaaaacaattttctttacccacccccccccgtcatcagagataacacattgttaaatagtttaattagtttagaatgtactatcctgtgctcgcttcggcagcacatatactaaaattggaacgatacagagaagattagaatgtactatcctaaaatttagaatcctgatattttgaatgctttttggaaaacacatatttctggaagactcgggtttctggaagtacagtatccggtagacagataggtatcctggcagtgtgataatgccctatttcaggtacctaaatcttttatgttcaaatggataaatcctcccagcttctgtttttcaaggaaaatatttccttcaagaaaataacttatttgttgggccaaagccaggaggagaggtaagaatgaaaaggcccccgtaatatgcttccttttcttgacataggaaaggctttgcatggtgttttatggaaaaagaagcatcaacattaattcctacaaatagtatatttaaccaacgataaaattatttctgtgtcaggcaaagaatcactgagcagggtcccaaagaagacccagggctgcttgcctgattttgaaggggtcgctctgggtttgccgtcttaggtatttgatttatttactttttttgtttttgtttgtttgtttgtttgtttcttttttctttctttcttttgttttttgtttttttttctgagacagggtttctctgtatagccctggctgtcctggaactcactctgtagaccaggctggcctcaaactcagaaatccgcctgcctctgcctcccaagtgctgggattaaaggcgggcaccaccacgcccggcttgatttattttttaatttctagtttggcctttcacaactgagaggttcgaggacccagtggtgacttagagcacggcttgtaatgtcccatgtagttggtgtctatgttgcctctccctctccctccaccttctttttagatttgatctctggaagctcaggcttgctcctgacttgggggaaggccttgaacttcttatcgtcttgtttcttcctggagagttttgggcttacaggcttgtaccacccgcacccgcgtccccaaacccatcctgtttggtgctggagatagaccccagagctttgtgtgtgctgggcaagtacatccactgccttcagaaatactacctataatactgtattacttctatggttttataagggtttttgttttcattttgtcttttttgttttatctttttgccttacctaaaaaaaattttttaacacagtaccagtagtttgaatatattctttttaaaacctttgaagattttttttgtttgtttgtttgtttgtttttttcttttttttttggtggtgggggttgacgcttcaagcagtctaggctggtcttgaactgtctgctgaggggaaaaccttgaattccagattctctcgactccgccttcacttattaggattataaaaaaacaggagctaccacatctagctcatgttataaaaatgatttcaatgattaaatctaattaattttattttttttctgctgagatacaccataattgaatatctgaaggggctacaagtgcatttcaagtctatccatccgtatccctagcacctttgtactttgctgatttgggcagagtgagcgtaatgttacagccagagtcaaagggcttacggatgagctctgctgtgcagtgtagctggaggctggactcagagggagctcctgtgacctctgagttgctgaggcctctttgttctctcgccccagtgagtgcctgggtgggactgggggaggcagacatttaaaagaaggggtgagtgttgactaagaaatcaggcttcgcctcccagaacacccactgtgactctgtgcaatgtttgactctcagcaaaaataccacttgtattctgaggccttttgtttcaacgacataactcaacaaccaaaacagcaagtttcctacaattgaaaagaacagaggccacgtagaggccaagttttgccttctaaggctaaatgcacttggttttaatctcttcttcctcaagagaagagccaggagactggccctctggtatttctaggcacggcttcagtaatatggtttctttctaagtaaggacttttgaatcctccttgttttattacttctattgctccactatggaagaagggcaggctgggacagtttactatccgtcagtgtcccgtatcccgcttccaggagccctctttctcttctgaggctgctcatgttgtctgtgggaagctggatcatatttgtcgataaaccctgcgcatatcacttgtatagcccactgcaatgtgaatgctatgcaaatatttgtttagggaggaaggacaagaaagagtgcttgtacatattcagtcagacacaagattttctgaccactttggacatgcagctggttgattctgaagatgtggaagtctcagattgggaggactgactgtgtcttccactcgtgatggaagctgaggacctggactgaggtgtatgctgcacctcttgtcagctgcacctcttgattgttgtaaggagtaaaagaagacaatctaaatgaaaagacattgtgtagaaaaacaaacacttgcacattacatctgattaaagtctagaatgcaatatataaagatttattggacagccacaggcacaacgcaagcaaacacaactgtggagtgggcaaaggaatagctgtctctctaaggaagatacacagatggccagttggcccaggaaaaggtgatcagtagcattatggacatcgaaattcaaaccacagggattccactttgtacatactagggtgggtgtgattgaaaaacaaacaaacaacccctaaacgtggcagagaacaggacttgaaaaggctgagaagtgttaggcttaccctgctggtggaaatgcactatgctcttggagttttctgtcagctcctaagagagttagttaggtgtcaagttaccacataacagcaatttctgtatgagttatgcatttaaaggagaagaaaccctaaggccacctcgaaaataatacacagatgcctgaaacagctacccatcataagtagtagtagtagtagtagtagtagtagtagtagtagtagtagtagtagtagaaactactaaaattggcctggcagctgatgaactgccaataaatcaatataatcaataaaagatggcacagagtttgctcacaaggagacatgaggtcctggcgagggccatgctatgcatggttgttgaaagaatactgctaggtggaagaagcctgcagaagcagccacacatcatcacactctatgggatgacgtctctctactgggcaagtgcacagggatagaaaggagattagtgttgatgttctcaggggacaggtagggcagggaatccagggatgacagctcatgagtatggaggcggggggtgggatgggtggggggaggttcttttaggaataatgaaataacatgtctgacacgagtggtaattatggcacaactttgttgaatgtacagaaacactagcacgttaacgcctctgtgtgtgtgtgtgtgtatgtttaaagaattatctacttaacgtatataaatatactgttgctgtcttcagacacaccagaagagggcattggatcgcattacagatggttgtgagccaccatgtggttgctgggaattgaactcaggacctcagaaagagcagtgagtgctcttaaccactgagccatctctccagctgcctgtgtgtgtgtttttaaaagtctgcatttatgagcgagtcctgagatgatgagatgagatgagatgagatgagatgagacgagatgagatgagatgagatgctgctgaattattgttggctaatgtgtttttcccatctgtacattctgcaacttcttactatttaagtaagataaaggacttctttgcaggtcatattccatgtagagatctttttcttttttgctctctttggtttgatttattagatggggcagttcaaaaagttgggatagtcccgtggaattcatctgacgtcatagaacttatgcatgcttccctttgggagaggggttgtggtgtgagacttgcgggagtgaggtacactgataaccacacctggggtctcttaccaggtacataacatgcatttcagacagacatcagttcttggtgatgtagatcagtggttgtaccctctgcaaaaagtgttgatgtatcttgaagccctgtgctcctgtctgaaccattcacagatgagacttgggggcatttcataattttcaggtttaagaagtgtttgtgctcatgtaaagtgtagtgttaataaatattgttggtaaataatattagactatttacttatggagtacgctatgaatctgaaattaatctggttcataacttccccctttgtaagttggctttgaaggatattctaacttcatcattagcagtaccaagattatgtcacagtctcctagtagctagacatcatggtgaccctctgagatctttgtttggctatgcaacctggttagatttgtctttgatttctgtgtgtctatacactctgtggtttttttgctggcctctgactcttcttatttccctttgaccttcagtagaactgtggctctgactctgtatgccccagtaggcgatcaacctggctggtgtgtgacttgctatggggggaggggtggcacacagtgtgtttcactcacatagagggaagcaaggtggcatgtttcctccactcttcctctgtgtctggtggctgcccgggacacctctcttctggtcagggcacagaataatttctgaaagtcaccacctttggcctgatagcttgaggtcatgctttctttctccaggtaaggtggccacgctttgagggatttactgtaggtttaatggggagattagtattcaaattgtgtttacttatacgagacttacaaatggttgttgctttgctctctggtctcattctgctttgaattttttgagacaggtgattgtgttcagaatatagcattttttttttttaaattgtagtgttcagaataagtcatttcagcaaacactgggaattcagctgttagagagctttgtatacaactgtagttgccttggttcaactctttgattaagattccactttaaaaaaaaaaaagatttccacttttagctgtgtctggtaccacagtggagtgataacaggactgaagtggtgaaggcaatggggtggatcaggagttcaaggtcaccctcagctgcatatgagccaccccgggctctgggataccctgtctccaaaccccaaataataaataaataaataaataaataaatttatttttctgaagaatttaccaaagtaaaagcagtcaaagcagtctagccttctaattttataacttggcttgtaaacataagttgttgttgttgttgttgttgttgttttttcccccttaaatatctttttaagctgaaagaggtttgtgcaacactcttggattttggtgtctgtagtgtgggaagttggaggtaagggtggtttctgtgtttttttcatcacaggaggtatggacggtttctgttctgggtggttgtattggtctggtaattgtggggcttctgcctgtgtgtggccccatagcccacagcatctactccctggagccacacatctctggttacagcaagcatagctgttcctggaagctggagaggcagggcaccaccatccagtgctgttttggcttgcccttattagtagtagttcttggttctcccactaactggcctctgatttcttcatcacagaatactcttcgcatgaatcaggatcctccctgcatttataaccactgggctttggaatgggagccgatgagtcatgcgatctctgagcaacggaatgagatgttcctacttagatcaatcagggtcgatgtcctcctctaatgggctttgagctgcttttctcgcttgccttcagggactatttttatacctgatttccttgcttggaatgttgctagaagtcagatttttatcttagtcaataatgagaaaggatcttcaaacacgtgaatggatgggatggcaaagagagtcagcaggtcatcttgatgtttgtgactcgaattatttgcacaagtatgaagacgtaatgtgtataactggttcatgctcttttttttttcctttgaagtgtacatattaacagttgatatgaaattttggtaaatgtagttcattgagacttacagaacacactaaataagcccattcagtaattttcgattggcaatctgtatcaggaactacaacttttatgttgaccagattacatatttcttgacctcctgaactcacctcaatgttatcaacataagtaagcattggtgtataagagggaagaaaacggggtgctttaagtgcttgggaggggggaggggggagtctagaatctgctttgaggaaaggtataaaatggcacctaaaaccttttttcgttcattcattaatttattttacatctccatcacagtccccctattctccaggtccccctctctcacagcccctccctccattccccctagagaagaaggggttccaacccaccctggcacatgcctgtggcatgtagaatgtccagagagggtgagaatggtgtgaagactcgagggaaggagaacagcacatgcgtagatatctggggcaggaagggctgggtctttacaggtggcacaaaggccggcgcttagagcaccctgagaagatggggcagggtggtcaattggtttgtagccttgtaaatgtgttaatttggtttttagaaattttactgttcagccagctgctctttagagagccagtctgagaggagaaagaatagaatttaggaaatagtgagagatggtgttggctataggttggaggaaagaaacgacaatatcttaggatgatggatgtataagttttatctcctgttgctgtgataaaatgtgcccccccaccgccaccccatgaaagccagaacagggaggatggaatttaagcatgcataattatgctcagttcattttgtgtgcttttacacagttcatggtcctagactagggaatagtaatgcccacattgggtgggtcttctgacatcaattaatataatcaagataattccttgattagtcctcaggccaacctaagctaggcaatctcgcattgacactgccttttcaggtgattatagattgtgtcaagttgacaattaaaactaatcatcccaggaggttacagtggaggtgtgcattgatagactgtgctgaggagaaggaagccactgttacagatactgacaggtccaggcaggaataattgaatgagtgaaggtggaccagtggatttgagagaacatcagtcttcattcaatgtgttaatgctgatacaagtctatgctgtatttctgtggcagtgtcaggaagatgcttggtccatatatgaacccttccatactctaaagactctatgagttgtacaaaatagagccatagcagacaggttaacaggagaacacatgcataaatgtattatgtacacatgcacatgacagcaacacaaactataagatgggaaaaatgcctgaggttttcacttgcacaggacctgtgtgtgaattcccagggctccgttgtctcctgcctgtaatttcagaactaagggatgaacgcccatgagactgaggccattctgaactacacagtgagttccaatctaaactgggctaaaaacaaaacatactctctctctttctctctctctctctacacacacacacacacacacacacacacacacacacacacatgtatgtgcacatacgagaaatagctaggtagggcaagtgataaatacattaatttccaggctacaaaatatgaatagtgcttaaaaatgctatcattaaagaatacatctaaaataataaatttattcataatatattttaaataaaggttatatttgctatctgtcttcattttttgtgaaaaacaaaacaaaacaaaacaaaacaaaacaaaacaaaaaccaagtgggcaagaatgtctagaaagctgtgtaaatatgtcaatatttcacttcctccttcaggggagagaaagtagtttacattttcattttgtttgggtaaatcttcataaatatggttagttgtacagtataggtaattttgcaaatcaaaaatgaaatgataatactaatctttaaaatttggtggaggaagttatacagtataagacttggctctcgactttggagccaccaagccagctgatacactagcaacattgtgccataggaaagctgctctctgatgcctctgaatagcttacttaactgcacccagtctgagaaggagtgacatccactgtcccccaagcagtttcagcagggagtggcttaggaagacaagtacgctaatcatttggggtaacagtgtggcagcttggtgcattcacaaagacctgatttgcacatgtctacttgactgggctccacctaactcaggcctgagggttaaggaatctgcattttaagaaaattcttcatgccgggtggtggtgcacacctttaattctagcacttgggcggcagaggcaggcggatttctgagttcgaggccagcctggactacagagtgtacagagtgagttccaggacagccagggctacacagagaaaccctgtctggaaactccgccccccccccccccaaagaagattcttcatctaatacaggtgttcaaagagcgtgggaatctgcagtacattgtcctttatcagatgatgacagattttatttataattaacccttgtgtgcatgtagatgcagattatagtagcatttactcttgtagccatttactggcctttttctttcccttctttacagcaggaatatcaaagcaggtagtttaaagcatgcaggtttgtccaccttttggtattgtgatacattgtagcctacaaagttcatgctggagaaatatacagtccttatcaaaaagaagaaggaggaggaggagagggaggaggaagaaaaaaggaagaaaggaaggaaggcaaaaggaaagaaagaaatagaagagcaaagagtctcgctatattttaagtgagtttaccattttgggtttggccccaattttacatgcatccaagactatcaaaacacagttcctggggctggagaaatggctcagctcttgcaggattcagttctcagcacccatgtggtagctgacaatcatctataactccagttccctgggatcggatgccctcttctgacctccttgggctccatgcatgcgcattgtgcacatacatacatacatacatacatacatacatacaggcaaaacattcatacacataaaataaacttaatctaaaataattaaacaaagaaataaatacacagtccctgaacctggcaggatggctcagtcattaagaacatttgctttgaagttatgagggatggaagttcagattataactccaaggtaactctcctggcttccatgcacacataagtgcatatactcacacagaaacaaacaagcacacaagcacacccacaaatatttagataaaaataagcccttaaaaacccaattcttaaagtaggaatatgggttctttgttaagggctattgaaggtaaggtggggatgggtttgaagtgaacacaccagaatctggcaagtaaactgttagtaaatgttagttttagtatgagaacacacgatttgtggctcgagcccatgacttcctaatcaattaattcatctcattatttcagtttccagtcttttcggtatttcttcaatcaatgtcacatggcctgttacatttcgttcttattaatgtcaattttagagagggagagtgttctcatttcatcttgtactccaggagtattcctgaaattcttcccttagattgacctcagtggcattataactgaatttaatggggagtaggaaagtttctctgggttttgtgaagaggaattttttttctcaagtcaactttatagatagaaaagtcagggctggtgacttgcttggggacctgactaagggggaagggcaaccaacagcaaggaggtcactgtcactctcggcaaggaaatagtagctttcatggattgtccactcagtgtgctcagtgcctggccagaaatgctgtgtagccatccctgtttgtaagagcaggtgggtgtcttagccattcaccttactggagggacaaaaccccagaattatcttgtaaataagaaggtggaaaggtgcctttaatcccagtacttgggaggcagaggcaggtggatttcagagtttgaggccagcctggtctacaaaagtgagttccaagacagccaggaacagagaaagcctgtctggaaaaaaaaaaaggtggaaaggttttgtgtgtgtgtatgttggtaaccagccccattcactacagtgaccttgaacagatatgttcctctttcacagtaaagccaattctgattctaaaatttaggttacccggtgctaatattcctaaggaacatattaaaccttggctgttgttgagcacaggttgaggaagaaggatcataagttcaaggatagcctgggctatagggtaagaccctgtctcaaagtgaaacaagagataggttgaaagtttggttggaaacaaaaagactctctttattgtttttttttttttttttttttaatttatttatttattatatgtaagtacactgtagctgtcttcagacactccagaagagggagtcagatcttgttacggatggttgttagccaccatgtggttgctgggatttgaactctggaccttcggaagagcagtcgggtgctctaacccactgagccatctcaccagcccatctctttactgttatgtggaggaatggttgcactagagcaccctgcagtctcctataaaattacacttcggtggccagagagatggcttcacagttaagagcatgtattgctcttgcacagggcctgagttcagttcttagtaccaacatctacttgcttgcaacttcctgtaactcccagttctgggggatctgacacctctggtcccctgcactcacgtacattacccctgccacaaatacctatattattcaatcaatgaacagagatcacactgagcggtgtctcacatctataatgcaattactcagggggctgtgctaggggcattatggggctacataatgggttctagattagcttgaactgctgagtaagattctgtctaaggaaccagaaacaaaaggcaaattaagactaatcacactgacatggcaatgaaaattgcttgtgcttttcaccattatataaaattttggtagcatgtatataatattcacagttttaactgtatattcatattgcaatgtgcaacaattacaatcatctttcccaaacttttttaatgttacaaagcttaaactctgtatcattgaacaattaatttctctctcacctctcccctcagcccctggaagctacagtatcgatttttatctctatgtgtgtgactgctttgatcgtggatttacagaacagctgtgctcatgtgacaggaacatgaaactcgttacaatgacccaagcgttcatccatgtgtaacatatctcataggatattgtttgtaaggactctgtaatagttcatgtcttgctaattaattctattgaagaacttttgtgttggtttgatccatttgctctcatgaatagtaagtaccttttgtgagcatgagggtataaagtccaagagtctgtttcagatcctgtgttttatttcttacactgttttgagtttgctggtgccgttgttgtttgagctttagcgactgggttgtattatgtaacccagtctgctgggcagccccttgtccaagccctagagtcatggtggttggttcactgtcatccagcagaaactgctaaatctcgattgaatgattaaacatccagatcttattgttaagggtcactcattcaaacaaggaaaaaatctttcattatgaattatagttgacacaatctgtgagatggaggaaggaaggaagagattatagtgttcccagaatgcactggctgttgcatagctttggagcagaaggacacacgtccttggcagctcatcaggaaggaagtgaagaaggaaactggacatttccactctttgaaaagccacattgctatgagcctggatgactgactgaggtcctgctctcgtgcctaaatgatttaacagtgagagtgttctgaaggaaaccccagccctagagagaatacatttgttgtctcctaagagcgatccaacgataaggcttctccagtctaagaaggtggaagtggaaatttgatagggttactggctataaggtcacatagttcagaaaggcaactgtactggctagttttctgtcaacttgacacagctggagttagcacagagaaaggagcttcagttgaggaaaggcctccatgagacccaactgtaaggcatttcctcaattagtgatcaagggggaaaggccccttgtgggtggtgccatctctggactggtagtcttgggttctataaaagagcaggctgagcaagccaggggaagcaagccagtaaagaacatccctccatggcctctgcatcagctcctgcttcctgacctgcttgagttccagtcctgacttccttggtgatgaacagcagtatggaagtgtaagctgaataaatcctttcctccccaacttgcttcttggtcatgatgtttgtgcaggaatagagaccctgactaagacagcaaccatgaaaagaaggtccttcttgtaggcttagatttttaaaaacctactttaataagggttcttaactggctcaacctcccttgtagcccaccactcactagagttggtggggaaagaaaggttaataggaaatggggtctgtggaccaatttagaaatagttctttggggctctttcagtcttggttgtcagctattagttgagcaccactctagggtcagcaacagcagttcaatcctgaagaaacctcagagctccaccaattggcaggagtccgaggaagctgcaagaagccactagagtatcttgaagttctttggagagttccttcgtatgaagccatgacaatcaaagattagcaactcaagaggctcctcccattgtctgcggtcatatttatatcctttgtaaacatcacaaatcctctcacatgtccgtttcaggaaaacatctctcacctgagtctgcttcagcaaaatatcccttcacctgtctgacccagcaaagcatcatatgacatagcggagtttcagaagcaaccagaaatttccaccttactttttaatcttcagctgtgaaacagagctgaactttttttttttttagatagggtttctctttatagccctggctgtcctggaactcacattgtagaccaggctggcctcgaactcagaaatctgcctgcctctgcctcccgagtgctggggttaaagttatgcggcaccaccgctggctacagctgaactttttgatgccttcaagaggcatgtgttgggaagaaaaagaaagagctagttcatgcagaagccagtaaataaaattgccattctctgtgatggtgtatacaattttcttccatgtgcaccagtgttgtgcctccttgtgtgtctgtgtaccatgtgaatgcctagtgcctttggagaccagaagagggcactggatccactagaggtggaattatagatagctgtgaactgccttgtgggtgctgggaataaaacccatgtcttctggaagagcagccactgctcttaacaactgagccacatctccagcctctataattttttttttaatttatttgtttagttttttgagacagggtcttataatgtagcacaggctagtctctttacttgcaacaatcctcctgtcttatcttctgtgtgctgggattagagacttaccacatttatggggtgttggggattgaacccagggcttcgtacatggtaggtaggcactatatcggctgaggtagatccctgagaactataatttttgatagtgatgtcaaggataatatattaatatcagcactctagcggaaagatttgagtttgaagtgggatcagagtttgcctgcactatgggtgtcatcttgtccttgccccgacctatcaggcatttccagaaataaaaaaaggttttattagctcatgggaatactttacatatcattttgtgccacctcaaagtgcagaggtctgtgctccctgggctaatttctcaagaaggttcattgaaagaaatcttttctcttgacttctggaagggcacacagcgtccttcctgacactttcccagcttcttagaaatatttatcttggacagaagattgcactttagtggacttgctgctttgaaattttaattattttaaattacttgaaaataatcatttttagtgattcttctcctcacgtggtgaacctgtggaggcctgaggagtctgtctttccacctctgtaaggttccagggatgaaactcaggtcatcagactggcaaacaaagtgactttaccctccaagccatcttaccaacccctcttcatttggttttaatttaaggctcaatataaaaaccttcacctagagaaaagaaaaaaaattctgaataccatttaaaaatttgaacgcatttgcagcaggtgacatgccattaaataaagcacaggaacaaatggcaaatgtgtcttgctttccctcaggtttgtcttgcttttctgaaagtgcttaaagtcttggtccatgacttgttcgtgatttctcttgtatattattattattattattattattattattatcattattatttatagtttctatctttataattgtcattttgtctgttggtacttgagggtttttttccccctgaaagttgtaagctgtgtagttttgtccccctcttgctcagtgtttctctactgagtcaacttggagatgtatggtttccatagctgcagttgttttatacctagttacatcaacagactggaaagtaatgcccactggaaaatcagatagaaatataagcagtttaatctggtgagtttctgtttaacaaatatatgagcttcactgtaaaacagagtcaggttcatttgcttctaactctccttttgacctctgcaggggacccttcttcttagctactgacacctaagcatctccctccagtcttgatcctgcctacctgtctgtaattacagatacagatggggcgccttattcttagaattcctatcagcatagacagtcagacctgccaggcaagttgtgtcttggtcaccaatctttctgcttccttacatgtcaaatgggaggtagaagaaaatgcacttttttataggacagacaacttgagatgctgtagtatgatttcttataacactgaaaaaatatagaaattaacacaaatgagtataagaatttcttagaatctctttagaaatacagtggtattttatttcttggttttgcagtcatgcatcgtatagtcatacgtacatataatgtttaagggaaaagctattcttcaagggtttggtctctattgcttccatatccccctttcttattccttttctcctcagccctgcagcctttcagaggtttatcatggatggctctgaatccatctatacctatacctatacctatacctatacctatacctatacctatacctatacctatacctatacctatacctatacctatacctatacctatacctatacctataccgcccccgcccccatttcactaaagtcaccttcaatcatgtcacatgcttgcacagtgaaagcacatgccttataccactctcatttcatctgtttgcattcattaggacttgcctgcggctcttcacctttttataaatgctctttctggccatttacatgcctcaaacaacaatgacgaaatatctttcctatataattctgaatatatatctacctaacatagtagttacaattgcctattgttttcaattcctgtcttatccttccttgtcaacaataatcatgctttctttttgtgcgtgtgtgtttgtgtgtgcacagtctaccaaagcacatgcatagagaagccataggatggcctgggtgccattacttaggagctgagaccttgagctttccagtcaatctggccaatcagccccaagttccaacctgcctctgtctctctcatgctgggatcccaagcctgtatcaccatgcttggattctttttaatgtgggttttgggagttgaactcagttcctcatcctttctgcacatgtacgttacttgagctatctgtcaagtccaaaaccactgccttcttgaaaatgctaatgatgcttgattttggaatcatgcatagtagacactcggtatagtggtttgaatggaaatactccccatagcctcaaatgcttgagtgattgattgccagttagtggaaccttttgggaaggatgagggggtgtggctttgttagagtaggttgagctttgaggtttctaaagcccaagtcaggcctagtgtctttctctctgcctgctgatcagtaaatgtcattatttggtcttttgtatagtgttttctataaattaggtatgaaactaactgccatttactgttactagccattgcaaagtttcttttgtttaatcatttactggggcagaagttctataaaaggacctaggctaaagtaatcatttacactgtaaaattttctgtttcttttggttgacaatattagctccaagtgcctgacaaggaggtgtatgagtatccatccatcttctagggattgaatggaggaaagttttagataaaatgttgccaccatcattggcattcacaagacagtcaatatccgcactgggctccttagctgtcaggccgccagttagcaggagcgataagccatttctctctgtccttctgaagggcaccaaggctttagttacagtgaatacaaagatattctagagctgagctgaccttcttcattgttgggtgcagggcacctgcagtgtggctgatccagattcagatggtgctggaaatgaaatacacattggatcacaaagtcttagtatgatgaatggtgttagatggcagtgcacagtaaagcattgagtatgtgctgaaatagcattttagatgtagtgggctaaataacaactgaacctggaaacagcacgtatactaaaatgagctttacttttttttttttttttctttttaagtgtggctagtagagattttaaaagtttatatgtcagggtaggtctaaggtgcagggttatcgttcctgctacttcttcagctgaggctggagaatcgtagcctatggtagactgtaaatccaagaccagtctgcacaactagtgagacactatctcaaaacaaaaaacaaaacaaaaacaaacaaacaaacaaacaaaaaacagtataaaaggggctggagagatgactcagcggttaagagcactgactgctcttctgaaggtcctgagttcaaatcccagcaaccacatggtggctcacaaccatccgaaatgagatctgatgcttcttttgtggtgtctgaagtcagctacagtgtatttacatatatataaaataaataaataaatctttttaaaaaaagtataaaaactgggctggtgtgggtggatggagagaaggctgagtggttgagaacactgaccacactggccacttttgcaaaggacccaggtacagttcctagcacccacatgtcagctcacagctggctataacttcaattctaggggtctgacaccctcacacagaaatacaagcattcataataccaatgcactaaaaaccaatttaataaacaaaaccaaacccaatcagggctggggattcagcttcttgatatgtgtcctggtcttgactatctgatgaggtttcatgttaaatctctaacatcttcaaaaaaaaaaaaaaaaagaaagaaaaccaaaacaaagccataaattctataatgttactaatatgacatttctctagacagcacaatttttgcaataggatttggggtcatgttgtaattggcatcagatggctagaacctatctagctaatggctgacaggaccctcatggatttagcatctagactgaaggaattgttttctgtttaactgataatatgggatgtctagggaatatattcatcattcatcagtttattctagatgggaacaacggagacaccctgaagtctttcaggcttctgtggccatgaaccctctcctggttaagcccaaggctgcatcttaggtgctttccttttgtttatccacctttcattgtcacctttcctgttgctgaaagaagagcgtaccttccagcattcctaactcatgtagtggttcacttctcccaggcacttagtataagcagaattcagttacaccctggataaggctttgtacccagtcaccattccatccacattttgatctgtccatccacctatctacccaaccatccacctactcatccatccgtccgtccgtccgtccgtccgtccatccatccatccatccacccacccacccattttcccacatgtccactcattcatgcactgagtcacccacccatccacctatccatccatccacctatccattcatccgtctatccttccatccacctacccacctatttatcccggatagaggattctgaagtgagatattcctctgaagatatatatcagtgtgattttttttttttaaagatttatttattgattatatgcaagtacactgtagctgtcctcagacactccagaagagagatcttgttacggatggttgtgagccaccatgtggttgctgggatttgaactcctgaccttcggaagagcagttgggtgctcttacccactgagccatctcaccagccctcagtgtgatttttaaatagaaaactcaagtctgccttctcttgccagagatttaaatgtgatgtgcctggttggtctgacagggaggagaagtctcagcagttagggaacagagaagtcatcctcttattatttaaggagaaaaaaccttgcagctagaaattacatatttttgcctatttaaattcatgataaatattagctgtcaacttaaacatttgagaattccttgggcttcttgaagatgaacctttgacttaaagtaatagacgtgatgttgtgagtttcgtggctgagatctcctaattatatggtaggcattatatagggatgttaagataaaagatgtgaaatgtacacatatacacacacactcacacacacacacacacacacacacacactagataaatgtaaaacaaagatgaaaaatgttttatatatcagctatatagaaaaataatattgctatttacaaatggaacaagatgtttgttactggcagtattgttccctattttattttatttatttatttctttttggtcgaacacacttttaatcccagcacttggaggtagaggcacgtggatctttgtgagttcaagaccagcctggtctacagagtgagttctagccagggtgttaccaagagaaaccctaactcaggcagaaaatattttattaagatttttcaagacagggaaaatatttgtatatttttagacagagcctctttaggtggtccagtctggccttaagcttaccctcatctgcatattccttcctagtgatggaattaccggcttggatggccaagacggagcctccaagcttttgtgagtattgcaaaattttcgaaaaaaaatgtattgtgatttttttaaatttatgagggatttaaagaatcccttacaatatggggaaactaatagaataaatgaattggaatgagactgatctatgatgactgagtcttgtaaggatatatttctgttgttgacaagcagaactcatgccaaggctgacagatcactgcagtgttgtccaggtttagttttttaaaacagtttccatacatctcaaattatttgtagatgaaaacagatactctgccttgagatttcctagttagtaagagcaacagtaacaggagggatccaattgtataggaatttttcttcatgagtcaatttaatctcttgatagtcattttaaaaagtcagtgaccccactgctctcttcctgagtaacctccttctattccgtgctatcacaattgattaaaacaaggctcataacaatctggagggaagcatttgtaagcgtggtggagctgcccctcccaccagagtctttgttctggtatgtttgcaacacgtgtactgtgcttgatatttcccacgtggcaaactttctccttcagcatcagaggctgttcctaggttcctggggccacgcgaattctaggtgagccctctacctgtgagtaagctgaatctccacccccaaggcttaaggctttaagaattgatttctttccaaaaacacacctctagagagagggtttaaggcagtgtcaggcccctctaaatctcacacagtctttcaagataagcttagggagttccaggaagtaaaacaggaaagggacagttttgtgtttctcattgccctgacacccaacaaactcagcatttcagcagtcagtttggatcattctcaaggctaccctttccatatcaaggtgttttcctttttttttttttcttctttttgttctttgaaagtatgctcagtattaaaggactctgcttgggggagttccttgtctaggaaaagattgcatgttacagattattagatgatacctactatttctgtatgatattttaaatgcatagtctgtgaatgaatgacttgatttcatttagacagcacagaagacatcagagtagaaggcgcgtccgtgtctcatcatggtgtgttaagggtcactcatgggaagagcccagagaatgagggaatgggctgtaggctgagcattcttgttgcttctgtaattactgtcatgttctaggatgtgttaaatctgtgaatgaggctttaatttataaagcagatccgaggtctaaagcctccagccacacattccttatagtccacatttcttttctgaattctcaaattttgtggagttcaggttagggtgagctggttgaccactattaaattgcttcaaaatatgttaggaggatgctgctttccttttaagcccttttatcagggcttgtctgtctgtaatagatacagaggtgtatgtatgttatatatttttgtgtgtgcacatatttgtgatgcagagttaatgttcagtgtcttcttcaaccactatctattttttcggagctggggtcttttactggatccagaatttacctaattcacctagatcagggttctcaacctcacgttgtggtgacccaccaaccataaaatcatttttattgctacttcatgtaattttgctactgttatgaatcataatgtaaatgtctgctatgcactatggtcttaggtcacctctgtgaaagtcgtttgacccacagagggatcacaacctgttgagaaccactaagttagactgtctggctgcaaggcgctgggacccatcccacctctgcttccccaggacagggattaccggcacgtactaccatgccttatttttcacacgtgttctgaggatctgaacttgggtctgtattcttttttggccagcactggacctactgaccatctccctttcccctcatggcaaaggtctattaaaagatatttatttcattatacattttagcgggcgaactgaagtcattttaaaccccatagtctcattggtgtttcctgttttacagattacagcaataaaattctaggccaggcagcatcgctggcccttggatttgtatgagcatgtcaggagtatttaagaagagcaaaatatttagaagaatttggaaaagcagccttaaggggtttaacacatttttcttctcctaattcaaccccgtgcttttttccctaatggagagaggtcattgatgatgagatttgctaagacagcaaaggctcttagaagggaattctaaaattcctgtctaatgaatacattgctttcagtttgggaccctgaaagaatacacattgaggaggtagatcagctgcatgcattgttcttactatttcagtctgtatgtgatcagcttaataagatgaggggttatattgtatgtttctaaattttttttgggggggggtcaggaattaaaccaatcaattggtctgtttgatgagaattgtaatagaaactgtttgaatctttttctaagcattgttttattttttttattttgtgtgtgtttatgtgtgtgtgtctgcatgtgtgtgtgtgtgtgtgtgtgtgtgtgtgtgtgtatgtgtgtgtgtatatgccatgtgaatgcaggtgcctatgaaggccagaagagggtgttggatgctttgaagctagagttacaggtggctttgagctgcccaatgtgggtgctgggaactgaacctaggtgttctagaagaacagaaagtactcttaattgctgagccatctctccagtcccctatttttcctaatatttgcatttctttattttgtgaatatgtgtgtgcgcacatgtgccatggtgtgtatacagggattttcagggctctgttttctcctttcaccatgtagtagttccaaggaatcagagcagacgaccatgctgggcagtgagcatcttcacctgttgaggcatcttcccagacttagcctgagactattgaagttctttgatctttttctgtggaactggagttgatcctggatcctgaggcacgctaggccatcactctactgtgggctacaaccccagtgaggctcttcaagctctgtgtcattttataggaagttgaagggtaaatgataacagcatggcagattttcagttgtttctgagttaccaatgaggacatggagagcagttactctactaacaatggcttctcattcttttttttttccttagaaagtattttatttttaattgtgtgtgtgtgcatgtgtgtgtacaggaataaaagtgttcaaggacccccaaagcccctggccccttgatttggaggcagttttgagctgtccagcccaggtgctaggagcacatcttgtgttccttgggagctcccttcctggctgttcacattttttatattttccatgactgaaaagcctttcctttactgaaaatttgtagatcatggggttagagaggagaggaggggagaatgggcaaaggagtgggcagtctatagatgtgttgaatacaaatctttcaagttgtttaggggaaataaatacaaaagagtatctgtacattttggaatatttttgaatgcctggatgttatctttgatggccaaacactccatttcatgttgggcaccgagatatagatatgtgttgatttgactaaaaagttctaggctatgttaggggaaacactgctttgttcttataaacatctctttatgtgggactttattttcaaattttatgttattctacagtagatggcatagaaaggtaaattggtagttactcctttctgtggtcaacctacagagaaaactctgtacatcattagatactttaattactccccagcacctcacccttctggggattggaggcagagctttgggtgtgtgcacattcactactgctgggctatatcatgagacttaatatgatcatgaaagttgaaacttttgaaatatgtttaaaaataaaatattgttatatttctgtgaatattttccatttttcttatctttattgtaaaggattttgttttgttttgttttgtttgttattgttttaatgagtcaggatttgtcttggctgtcctggaattctttctgtagaccaggggatatcattgactcagagattcacctgcctttgcttcctgagtgctaggattaaggctgcatgccaccactgcttagcgttaaagaactcttaaattgtctgaacattatgaaagtaagagaatatttatttgtgaactttctatttcttcttcataagattaaaggatggtgggtacaacacaatttacaaaagtaaacctcctttagagtcatggaacatattattatgttaagtgtttcaaacacagatgtttaaaattaaattcttttcagccaagctggtatagtgactgtttataggtagatgtacctagtatagccttgcacgctggctgtattgtcagctctgtccttctgaagtttgatggtaaaggctgggacattctgtgtatgtaagcaagtctccttgattaatgactttgtagcatcgatcagataatgtataaagctggaattggggctgatgactttcttccctgtcctttctgagatgcaggtcacctttcagcaccattaacatcaagaatcttcttagtgtccttctatactgtcccctttgagccttagggttgctctccaatttcctttatggatctgcaaactctctttctagaactgttatatttatcacagggatggcctttcagttacaaattttccttctgtcttagttacttttctattggctgtggcaaaacattgtgaccaaagcaacttataaaagaagacattaatttggaacttagttctagatggttagaatccatgaccatcatggctggtaccatggtggcaaataggcaggcatggtgctggaataccttacattcccatctactgactggaagcagagagagctacctgagtgttgcaggattttccctgtccaattacattagggtaacaggaggcctgtgattggacagagaaaagggaggcagagctaagagttgcagggacagagagtgtagagagtgagaaggagaaagaaaaatggaggcagacatgaaccagtgtacctttaaccaaccacaaatagttatgatatcagaaagttagaacaattggaataaagcttttatcattatcaattggttctgaaatgattgtattagcatcttgttaattgagaatttattgatgcataaatctgattggttatttataagctttaagagtttctattctaccaggtaaatgggttttgtattagctgactgtggggtgggtggttgttgcatgccaatgagaggaacttgggaactccagccccaccagaaaattggcaggtagagacagagccagcagggccaagagttaccagcacatgtgcgggaacgtgctggtacctttttaaaatatttcttgcaacacttgagaatggcatgagcttttgaaaccaaaagactgcccccccccctagtgacattcctccagcaaagctacccctctgagtccttctcaaacagttccactaactgtagaccaagtattcaaacatgtgaccctatggggaccattttcatccaaatctgcacactttccataagctattagaacacgaatttatcacaaacttgatgttttagccaatcatctatatgaacaatggagtaaccaagataaagttaaagaacaaaaccaacttgagaggaaagatttatttggcttacatattctgagtcatagtctagttaggaaagccaaggcaggaactcaaggtaggaacctatgctacttattggcttgttcagtttgctttcttatatattccataactacctccctggtgtggtactatctacaatgggccaggccttcccacgttgattattaagaaaatgtcctatagacttgcctataggttaatctggtggaggcattttctcaattgaggtttctcttcccagataactgtagcttgtgtccaattgacaaaaaagatcaaccaggacagatagttgacttatagaagaaaaagtttatgttggcttatagatctgaagatcagagttgatgactgaatagacctttagtttctgtaccatgtggcaatagccaggaatgggtggcagagaaaatgggtggagagccaagggaggacgaagagaaagtagggggacctcttatccccttcatagacattctgccagtgacttaagtacttcaacaaggttcccctattgaggtttccacctttcccagtgcatccaaaggggacgaaagccttttaatacatggtcctttgaaggggaccttctttttccaaactataatactagatgtagtcagtcttatttattagtgagatgttcctctttaccaaatacaggcagtccctttgtggtgtgtgcttggctggcagaacacacaggtctcttcctgtgatgatgttgcctagaagtgtgctgtagtaggtgaggcacttagatggacccatggctttatggactattctgaatatagactgctttcagaactactcacaggtagttaagatattactttgtaggtgttcaaccaacaatgacttctgttagttttaatagaaaagtggagagtgcttgaatcatataatgggaaatgataaaactggactgttgttttcctgtttgttcatagttatgccatcattttgacaaccaaaaactaaatgccaggtaccttatttacttttctactgctttgacaaagcactgtgacccaggcaacctataagaagaagcatttgatttgaggctcatagtattagagggttagagtccatggtcatcatgatagggaacatgggtcagacagcaggtatgattgctagaagagtagctgagagcttatatctgacccacaagctcaaggcagagagaacgctaactgggggtggtataggctttgaaaccttaaatcccacccccagttacacacctcttctaacaaggccacacctcctaatccttcccaaactgttccaccaattagagaccaagtgttcaaatatatgagcctgtgggagctattcttattcaaaccaccacatcaagtctttgcggaaaagtttcacttgtcagcataacaatatatcttacaatatagttaatatttatttccatcttgcagatgaggactttgggggtggatgactcttctggttcttaactcagaatcccatgagaagtggatcagaatgtgatctatttggccctaatacacattgcttttgctgttggtgctattgtaccatgtagtctccttacatacttcatttacttggctcattttcaagcaatttgaggttcttcagatgtttggtgctagttgtgccttgcccaatggatttgtaattgagccagagttgataatgtttttaaattcttctggtttatatgctcattaaaatgtttgtttaagagggctggagtggctaagaccacatactgttcttgaagaatggctggagttcagtttctagcacctgcatggtggctgtaacctcttgtaacttcagcttcagaggatccgatgccctcttctggactccgtgggtgtttgcactcgcatgcatatacccacacatagacacatatatacacatgattaaacatggtaaattaaatattaaactgtacttaaagtttaaagccactgtgactctgttgctccccccattttgtcaagaaaatgtgttggataactgactagaaatcttatattccccccctttttttttctagaaggggtaggacttgtgtgaagaaggagtagctatggagtcttaagtttctgttgagtaactttttggtgggatgtgttggtctagcttcattacctgaaaggatctttttgaccctgaaagggtccattgtcatggggattcaggcaggagccttaagcacttgcacgtgtccacagtcaagagcaaagggagaattcgtgcacaaatccctactgttcagcttgctgtctccagtttcctatagtctaggattctaagtgggatgctgccattcccctgaggagcaggtcttcccatatcaactagcacaatcaagacagttcatcacacacattcccataagccagctggttctatagactccctgatgcagacatacttcccagatgatcctagattctgtcacactgaaaattaaaactatcacacatatttatcatgtttgatagtatacttaaaatgtaattgaaagtgttacatgtaaggtaacatctatagtgtagcacacaaacgtggatttcataccaggactcttgggtgagatgactgagtctcactttactgtagaagttggtggtccccatcagtgggttcattaatagctatgtgtcccttgcctcgtgctgtatacatgtcaatcttaagctgccaagggaggagatggttgtatttattacactcaccatcagtacaaacattcatcctgttcttgtcttttctttctctcccgcagatgaacacaatgatgtacagaagaaaacctttaccaaatggataaacgctcgattttccaaggtatccaagatgctggtggattttactgtgtggtcagtgcctccttctgactttagcatagctaaaaaagatgaccagttcctttagcatggttaaccatgaaaactcaggcatcctttctgccctgtgcaacagtgataggcttttcctcctgtgagtatggctaatagcattatccatcctctctctcctttacttgtctgctctttatcagcatctgcaaccagtggaacataatcattgctatgctcagaattgggggagagggagggagaggtgtggagtatggtaaaatgaggggtttcacattggctttaaatgtgaaatagttatagaaggtaggaatcccccacccccaccccttccaagtcttatatgggaacagcctttgggttgattgactctaagacaggaacttgaagaagaaaggtttctttggttatctttaaactagtctggaagatccctttaaagagattggtttattttattttagatgtattgcctacttgtatgtatgtgcacagttttcatgaaggcaacctcagaggtcagaggagggcatcgggtcccctagaattggagttatagatggttgtgagccataacctgggtgcttcaactgaactgggccctctgctagagcagccagtgctcttgtgtgggtggtaatctttccagtctcttggaagctcttttagtcgaaagttctgtgtttacaagttgtaaagtcagggccaccgacactggtgtttcctggagggaaggagaggctgacttacggtgactttaaatagtgacacatttcacagttgccccatgtctcacaggtcaggtacagtggcacatgacacttgggaggctgcatcaggaggatcacttggcccaggagtttgaggtcagcctgaacagtataaggataccccatctcctaaacaaaaccaaagtgcctatctccagactcagagatattaatttatttattactttattattactcaatttattatttatttattactcagagatattaattatttattacttgactgcagtgtttcttaggttttacagctttttgttgaaggttgttttatcttgcccttgagagtagaaggggtgtgaaaacggacagatagagtagtgaggattgcaggattttgggtcagggagctgacttagtgtgcaaagacaccttctgccaatcctcacatcttgagttcaatccctgggactcacgcggtcgagggagtgaagcaatgtcaccaagttctcctctgacctctataaattcatttccctctcttccccttgcatattgcatacacacttatacatacacatctgtcaataaattaataagtaagtaaatgcaatagaatgagtcactaagcggtatgtgtatacctctgtatgtgatcgtccgcaaaactgtgcagaatcatgtcatattgtttcatatgttatatataaaaagaattcagagagtgagccactatgtggttgctgggaattgaactcaggacctctggaagagcagtgagtgctcttaacctctgagccttctctccagcccaagaattcagagagtgacggaagaacacaagtgcttcacgactgatggcttcaggtgcctgattgtcttacagcattgctaggtatgtttggtaaatgttaaatggtttgattctgtagtggcaaggagcccataacacggacttgacagtattcacagttctgtctctgcatgtgttacattctcagcaaggtttagtgacagagtgtggccagagttgttccctccctgcaatctcctgagagctcatgtgggtgggattatccagcctggttattactggggtcatggccattttctatgctagaactagtgaagacgcatggttttcagcagtttcacgcacttattagggaaaggagtgccctagttttaacattgaaaggccattttcagagacttgggacaccttgaatgaggcaacctttaaaattgggtgaattctttttgccttactattgagaatggtgagcagaagatagatgaatgaaagaaggaagagggtatggaataatagaaatagctgagaaagaataaaggaagaaaaatcactatggtgatagtcttggcagtttcagggacccaaataacacagattctactaggaccacccttggttatttaatgaagctgatatttacatatgtgtattcatagaaaggtgaaggggtctctttaactcagaactgtgttgttcttttgtagcatcacagggggttgtaattccatttctttgtcctaggatgttcagagttcctgctgggagagtcaaagttactggacagagcctagtgagctggcttttgggctcccgcagagactgtgcggtcttgatttgtttagagaaaagatcaaaggagggatggccttgaaaacttactttgtcagactgtttccaacaggaagtcatttatctaagatatgatgaggatgtgactggaaggaagggaattccatccatgttcaacagccttcatccacgttctgttttccttccttctgctgactttagtctactagtgggtaggagagggcacagtacatttgtgggcttggaattcctatgcagtttaatactcattgggattgaaaagcttgcatttccatttttgtgtagcctcattgagcaatcctgaagctagtctgtctgactttccatccatccatccatccatccatccatccatccatccatccatcattttaatctatcatccatcattttaatctatcatccatcattttaatctatctgtctatctatctatctatctatctatctatctatctatctatctatctatctacctacctacctaatctatccacctatatacaacctacctgtctatatctcctctatacacacaggttgttaaaagaaaataaacttattatttttcttgtttacctaggcccttttgcatatattttgatgaactctgaaacatatttattttgtgtgtctgttggctctcttcactatgagacctccacatagacaccaatggtatcttctgccttttaggaatttgttttaaaaccgatatattgtttgatatttcatttcaggctacccccctatctagagtgtctatgagacaccatcttgttaattctacacttgatcttagccaaaaggcagagaagtgatcatcttgttaattctaatgcctgcatgcatccagaattcatttactcattgtattcactgatcaatatcttccgtttctaagttactattacgtatattagaaaaactttttaaagttctaaaaatgggaaaaaatattagtggataccttgtttggctcagtcctctggattagctctaccttccattacttagtactttaatttcttcttcttcttcttcttcttcttcttcttcttcttcttcttcttcttcttcttctccttctccttctccttctccttctccttctccttctccttctccttctccttctccttctccttctccttctccttctccttctccttctccttctccttctccttctcctcctcctcctcctcctcctcctcctctttccttccttccttccttccttccttccttccttccttccttccttccttccttccttccttcctcttcttcctcttcttcctcttcttcctcttctttccctattattattattatcatcatcactataattactattactattacttattatttggggatgggcactcctgtatctcaggctggcctcaaacttgctttgtagctaaggatggccttgaacttcagcacatatgcaatcagacctcatttttgagatgctgtggtttggattggccctaaatcttcatgcatggtaggcaagcaccctgtcaacctagctccatcctcagccctacattttgttatttgaaagtacattacagcttgatacattgtagaaagtagatgatgaaaattatctcatccatagataaatctgtgttatttgggtctctgaaacttccaagactatcatcatagagatttttcttcctttattctttctcagctatttctattaccccataccctcttctctctttcattcatctgtcttctgctctccattctcaacagtgggggaaaaggaattcacccagtttttaaaggttagctgaaaaggaattcattattgccatagagcaacttatgcattttcgcactacatttgattcccttttctgcctgtagatgcgtagctctttgaattctcctttgaagtgattgtggtactgtatgtgttcttccagtgaacaatgtattagtaaagacttcagaccaggctagtgctacatttgcctgggagttatcatcccatctttttgggaccttgtctttgaacatgtggagcactatgaccagctatgggctctttcccctttcttcttttccttccaagctttgatgaagtagctggtgtggcctcagaggcctggttgcctccttttcttttagaggatgcttaatgttctgctcattgttaactgtatttcttttgaaaattagaattgtgtgtacttaagatgtatagtgcgagtttgatctctgttgactttcaggcccttggcctgatttgctcttaatttctttgtttctgctgccaccttctcaccatcctagatccacattgcctgtgttttcaaccgggcagctttcttttctttttctttttctttttctttttctttttttttttttttttcttttttcttttttttcgagacagggtttctctgtataaccctggctgtcctggaactcactctgtagaccaggctggcctcgaacttagaaatctgcctgcctctgcctccggaatgctgggattaaaggcgagtgccaccacacccggcaaccgggcagctttctacagcctctgtgcatgctttccttttcagccccgttctagtctgctcatgggcctcctccttgcctgagttgaaatgccatttagtagtggataccttttttttttttttttttttgagcttaaagataagggtagatatgtttttgtttgtttgcttgttttttgttttttcgagacagtgtttctctgtgtagtcctggctgtcctggaactcactctgtagaccaggctggcctcgaagatatgtttatatattaaaagattatacctttaaagtagctataattcaaatcacacttccagagtgtactggctggcttggtgtgtacaagctggagttatcatagagaaaggagcctcccttgagaaattacctccatgagatccagctgtaaggcattttctcaattagtgatcaaggggggagggcccagcccattgtgggtggtgccgtccttgggctggtagtcctgtgttctataagaaagcaagctgagcaagccaggggaagcaagccagtaaggaacatccctccaatggcctctgcatcagctcctgcctccaagttcctctcctgtgtgagttccagtcctgacttcctttggtgatgaacagcagtgtggaagtgtaaactgaataaatcctttcctttccaacttgcttcttggtcatgatttttgtgcaggaatagaaaccctgactaagacagtttactaaagaaatgagtgacagtaacacagacatttttttaaatatgtctaaaactatatgttcagaaaacagctagagacagttttattggaaagagatatataataatatattaattttataatatataaaataataaagatatataaataaaaatataataatgttttgagtacaaaatacctagtgttatttcatgaaaatagatacaataggttgagattcttactgtttttactaaaaatgaaaagagtaggctggagacatgacttagcacttaagagcccttgctgctctttcaggggccttaggcacaatgtgggtactgggaattgaactcaagacctctggaagagcagccagtgctaagctatctctccatctttcagtagaattcttcatcctgaccctcaactacttaattcacagggaatgaaaaaacttaaacttgacttaaagctccatgattttttagttgtctccttaattaaggatgaagggcttgatcatattgaatgatatggatctaaaactatcttttcctaggaagtatatgtggctatacagaagctaaaaacaattccctcaccggaggacacttacgtgtatgtttcatgttggtgtatcttcccaagcagatgtctgcctattatcgatgtatatagctggaagtgcttgttaatttgcccgagtccacaatgcttcagagccctggggtcctgaaaggcagttcacactgcagccagtcatggtctgatgttttatagaggtgaagagcaaaggagaaactggctgcataaagggttaagaaacgctcgctcctgggtgtgctgctcatttatttacggcctcaggcaaacctgggggcagttttaagaggaactgtgttttatgtttttatccattaaacacccctggtcatcattgccttgtagtgtccgggagtatagctgtgcaggaatgttaacaaaaacccatgaggcaccactaatttgtgaattccctgctctctgctacacatttccaaatagaaataagccctcttgagactgttgcatggtgtgtaaaaccatgcaacaaagttttggactttctagttgttggagtctgatttgcatgtggctctcccaggggagacagggaagctgttgggcaatgtgtcctgacttggagcctgcgctttctttggctcactttcagagctgctcatctggcagagccgagagactacaaattacagaagctctttcatcagtgcagttaggggaagaatatgcaaacttgaaaatgcagaaaatgcatgtttctgctttcctccttttgaaaagacaaattcccatgggtaacaattgcagactcgaaatctatatccactgaacaggaggcagggctgtgaagcatggagcctggattctggtgtgagttgctgctcacatgcagttgccctttaaacagtctgggacacggatgtgtgtgctctgctgttttctgctccttgaatcttgggagttaatagtcataaaaatgggatctggaaaagaagatgctacagaatgtgtggtcagagcagctgggagcaccatccccctggagatggttcatctccttgtgagtactaccagaggcactgcaggcttccttgagctgaaccatgtgctacccattggttttgatactcatttcatgtcaacagagctaattattttaagagctgtatgtacttcctcctcctcctcctcctcctccaccacctcctcctcctcctcctcctccatttatgagtacactgtagctgtcttcagaaacaccagaagaggtcatcagatcccattacagatggttgtgagccaccatgtgggtgctgggaattgaacttgggacctttggaagtgcaataggtgttcttaactgctgagccatctcttcagcctcatatgtcctcttcttaaaaagacatttcaatttttattaattcccaaataccaatgagaaaaaataaacaataaaatattctctatattcttgaccaccatctttaggatactctggtggtacttttgtaagctagctagctttctttcttgcttgcctccttttgcctaaattctaattgatttatttttaattaaaaaattaggttttgttttatttcgtgtgtgtgtgtgtgtgtgtgctcacatgacatggagatcagaagacaatgtgttgtatcacttcttccctttgaccatatgggtcctgaggacagaattcaggttttcagtcttggctgaacatgattttggataaaagcatttgagctattagctgaccccatgtgacattttttaagaattacattttcatttaagtgtgtgtgtatgtgtgtgtgtgtgtgtgcgtgacagagcacacacatgttgtcatgaaggcgtccatgtgtgtgtatacttgtgtactggtcacagagtttacaattccttaagagactcactattgactaaccctatatttcctttggatgtggccctgccctacttggtgattgcctgtcattcatcttacgactcagtatgcctgtagacaagacttacttgcctggtgtgatggtctagaaaattaccagtgctgcacaggccaattcagattttcaacttgtcttttaaacaggaagccctgccaaacagcgagtcttgatttctgcatggtcatgctgtgctggcacagagcagggagcacctgctgactgtccatgtgtgacggatgcccatcagacatgcttcccttcatcatgtcatcacatgtgtgaagcctgctccctacagctgcctctacctctccttttgcttagcaatgattggtagcatctttgcccagatgcttttaaatgcagtcgcactcatgttccaggaaatagtactgatgttgcagttctcttgtcaaaatggtgggcccagggctggtactgagattgtccaaagatggactagtagaaaaggatgagagtgggggccagtcctaattaggcagtctaggactacagccatcatgcttctgtttattaggctttgaaagaaaaaggagattcttagagtgatggcttggtggttaagaacactggctcctcctacaaaggtctacagtttggtccccagctcacaacaattctgggagatccattgcccagttttggcctccatgggaacagcatgcatgtggttcacagaccacataaaggcaagagacccatacacataaaataaagtaaaaataatttaaaaagtaaaatgggacataagtgttatcttccccccaagttcaagattgcttttctgtaccgttttgtgtttattagtaagtaatgaaaatggtcccataaggagactggagagagtgacgtgaactcagcattttgccaggactaaggcacaaaggggatattcaccaaatatttatgtgattgggttattaaactgtattttctctgccaaagaagttgctgcaagtcagtctttgcacagatttaaatgtgaggttgatgttcaagatgaatcagtccttatttttattaaaagatgacttttgacatttctagacttgttcccagagccgatgtttacagcccacatcacaaaaaacaccagagatgctttacagtgggctgctgggaaatggtgccttagtttagtacagtgtggtgatttatgctgttgttctgagaagttgatatctatctatatattcatatatctatatattcatatatctatatctataatctatacctatatctatatctacagctacatctataatctatgtctatatatctgtatctctctagatttcaatctctactaatttatatctctctatatcatctacatttctgtctatctttatcccaatcctgcaattaaaatgcttgctcccctgtttactgcattgtatgccttggtaatatttattggctcaaatgttgagaagatggacttggagccaggttttgtaagatcagatcctggttctgtctctcacttgttatgccacctttaggtctcagtctcttcagttgtaaaatgggaatgttgaagctgttccctttagaccacttaggaggaaagaatatgtataaacaatgaatctaaatccatacaattctcagaacttaacctatgcacacagtaaatgctgactgttattgtgttagaacattttactatgtcactgtgtggttttgcatggtcttcaagttaaaatcatttttatatttacagaggagcaacatattatcttataatttgtgttaatgctatgaaatttggacttcagtgttcatgaaattagaacaaagttgtctttcagttggcttactcattcttgtatgattaatgactgttttcccattacaacagagctgagtagtttcaacagagaccacacagccaacaaagtctaaaatatgtactgacctgtccttacataagaagtgttctgccctcctgtgtagaacaaggaccctgcttacacaccagctacttgtacatattgggcggggacatgtcctcttgggtactactagtcctttctgtatttatgtggaacatttggaagttgcatgtgtcagggatatttagtgttttgtaatgacagtctaagtgtgcgctgagtgtacacacttggatatgtgtgtctgtgtgtgggtgcatgcatgtgttaattttcttttcttgtagtgctgggggttgtatcctgggcattgtaattgctaggcaaacctatcagtggactacatctctggctcctgctcaggctgagtttggactttctgtgtagaccaaaaattgtagttctcctcttgcatgctgggatatgtgccgtggttgtgggttccatgtatgtttttcccccagcacattttcagtccgtgtcctattgctaaaaatatatacacacaggtgtgtagagtttcttactctcacagacagttccttcttcaaggagtcaaaagtatttaaaactcccaaagacggtgtgactaagaagctgccgagtctacagagtgagatctaggatagccaaggtgcaaagggagaccttttctcagaatgaaacaaaactgaaatcaaaaaccaaaaactcggcggataaactaccaagaaaagaacctgccttttctagtgttttgatgctgaggcagctcgttaacattttcctgggagacagtgctctggacagagcagagaagaaccagggaacggccatgcctgtgcttaaaggacaggaacgaactagtctcaagtagagtattttaatatttttcaccattttaattgtaggaatgggtggaaactagtactgtggtttaaagattgatggcttgctgacagaatacttgcctgtccttgggggaatggttttggtgctgggtaactggatccaggggcctgagagtttgacagagcacagaagcttgcttgttgattgagacagcatttttctgtgtagccctggctgtcctggaacttgctctgtagaccagggtggctttgaacttacagagatccacctgcctcccgagtattagttaaggccatcactcacacataagttttacagcacagattttgatgagttccttgtgagagtctaggcaccatctcttactctctccagcggagccccatcaccttccttgtctgccattctgcagggatttggggttctttcttagagaattgactgccagtgtaccacacccatgtgtgggaacatggagggaagggcacacattcacagcacattctgtatagcttgtcgtcagtgatcgtctgagattgagaaacagaaggaagaaactgagctgtcgttaccatgagccttctgtttaagggaaaggggtactctggtcatccttgcgtttatatttgacttttacagggacagaactgcatcttcatggttttttttcccatcagaatattctagaggagcctttcttaaacttgttgcctgttaaacaattggactatttggacgtgagggaaaaagagtgtgccattaatggcaacttttagaagtcttcgtttgcaatggagcctttctggcatctgtgttattcctacataggtgtctgtgtgaattgtttttgaataggaaaggttcccacaagtgaccatttctgtgaatttgggactgggaagatactcattccataaatcccctcagatattatcgaaaatgtatggttctttcagagaagattattttatgtgtctgaatgttttgcgtgcatgaatgtatatacaccatgtgtattcctgctgcttgaacagttcataagagggctttgggtcccctggatctagaattgtggatggctgtgagtcaccacatgggtactgggaaccgcacctggatcctctgcaagagcaacaagtgatttcaattgccaagccatctcttctgcttcaatagtactttttataataatagaaagcatgaaggttttgcttgtggtataactgataataatactgggttaaccatttgaagtttttgttttgttttgttttgttttttcgagacggtttctctgtatagccctggctgtcctggaactcactttgtagaccaggctgacctcgaactcagaaatccgcctgtctgtgcctcccgagtgctgggattaaaggcgtgcactatcatgcccagcttccatttgagtttttaacaaacaagtgagtgtgtaaagaccaggtaacatgactaaagtttgtggctagtgtacagcacaacctgcttgtgtcaaaggacactgatagatatcaacaattatctgatatggggaaataatggaatttgcttcactttataataggcttttacatattattttgttgtacgttggaaagtgaatgctagtaggtggcggtcccctagataactcattctgttctatggacttgacctcttatctttctctttgctgcgtaagacatgagagaggattgagctctgtgtgagctcaggagaggagcctcgaagacaggctgttaacaagggcttgtccaccctttgctttgttgatagttcagaagtctccagtgtctctcgaaagtggcatctgagctcatctagtctgcttgttgctgtagttggtagagataatctatgtgtctacaacacggtggcaaaccgaagagatagctgtatttcagagacagggtccagcttattccccactgtttctgtggtgggccacatgttccctcctagagcctatgaacttttaagatacatgctaagaattcttaacagattgcacactatagttattcaaaaccgagtaagaattcagtaggaggatcagggaacccttcttttcttgtctcaaatttaaagtcttgcttcatatagtttttttttttttttaagtgatcacaaaaagatagttcttgattatgtaatatctaggactggcagggaaggacttttagctctatctttcatatgaagaagtgacaacatccaagaccattatagatttattacatcatggtttatgatttttagtacattctcacatcacattatactttttggtatttaacatagccggtgccttaagggagcttaggtaactgattaagtctcgttgggtagttcttggtcagactgtgtttgaaactgaggctcttgtttttttctgtgcaggaatttccttgtgtttgtggactgtggccaaacacggccaaaagtattttaaatgttttcatttttcttacatttctatatttattagcatgcacatacacgctctcactcatggcgtggtgcccctgagacagatggtgggatttcttctctctttccactgggtgcattctggggattgagcttgggtcatcacggtcaccagagagcgtatttgcaccttgaaccatctcaccagccccgatgtggaacttctggtcctgaagtcgaccttagttttcttcttcttcattgcagagtgggaaaccacccatcagtgatatgttctcagacctcaaagatgggagaaagctcttggatcttctcgaaggcctcacaggaacatcattggtgagaggacatctctgatcattttcctcagacagggtcttgtttccctcaggctagttacaacctaactgtgtagctgaccttgaacttctgatccttctgcctctccatcctcccaagtactgaggtgtccaccacaccacatttgggcagtgctgaggttggaacacagggctccatgcatgatagggaaacactaccacttgagctatgtctctagcctataggagaggatggccatctctgagaatgtggctgatggagtgcctctggcactgttgagattgggagattctctctgggtactaaattgtgaagcctgagtactgcatcctctgtctgccttcctggccgaggctgggcagcttcaggctaaaccgatatctctcatgagattccctggcccgtgaggtagaaggaagatgactagcttgtcatgccctaggtggcacactcttctcatgtgacttggagtttgggacaatgtctctttgctctgttgttcctacatgggcaggagaaagcaggcagactattctgctgtttttttctgcctctggagaagtttaaataaaaaagctttgtctgacagaattgattctcaaatgtgtctacctgcctgtgaagagtaactagagcaattttgaaaatgctgaatccatgtcacagcctaagtcctttaaatcactgtctcatgtgggggcaggaaactgccaggcctgtttgaatgtctcctagatgattttagtaggcatgctggtaaatgagcccatgtttcaggatgttcttagtgaatttccatcctgtggtacccaggctggtgacatggatgctgacctgctattctgcttccgtttctgtgtcagagtttgtcaacacatgaagggatagggactcttacttggtttttgtttgtttgttttattttgttttgttttgctttgttttccagccaaaggaacgtggttccacaagggtgcatgccttaaacaatgtcaaccgagtgctacaggttttacatcagaacaatgtaagtaacatttagggatctcagctgctgcaggcattgttgtttgctgggaagcctgctggttgctgtatatgtcagttgatgcttggcagtgtttcctcttggtgggagttttgaatttgttctgtgagtgacggataagtcacatgccttttccgatgctctcattgatctgtaggataaataatacgcttttgagttttgcattgatccaattcctaaaatgaaaattttatccttgtttatattgctgtataaatatacttaatcaaaaggtttggagttcgatggtgacgctgtcccacgaatttaattgttgtgttattattttgctctgacaggtggacttggtgaatattggaggcacggacattgtggatggaaatcccaagctgactttagggttactctggagcatcattctgcactggcaggtggggaccttcccagtcaccttgagataggcctcgtattattttctctgttcattttctacagctgtcaaatcgaagttccacaaacggcttggctggaataggaggtgtttattgcctcaaactcctcgtgtctgcaagtctgcaacccaagtgccagcagagctggatcttctcagcagctccttgtctttctcctaacttcgagtttgctgtaaactgcggtgtgctggcttaggcaagcttagtcttcatgacacactctctgtgttggtgtccagatttccctttgttctttgggaaggtcatcagtcatgctgtgtttgaaggccaccctcctctactgtgcttgcaccttaaatagttctgtgtgcagcggccctacttcacacagggctcaattttaaggtgctgatgttctggcgttagcatatggatctccagagaacacgtctaatttacagattcccaatggacagtgttggcagcctgatatagatttttggcagaggagaaaaaaaggtgtttcatatttcattgagaaaactgctttgctttcagcctcataggaggttgtaggagtagcctaagggatttccaaatgccgttcattcagattccccaaatgttaacacttacccgcatttcctgagcttactctggcgttctctgtctgagtactttggatgctctttccttttataaaacaccaaatacacttcccaagcttcggtctaaaaacatggcttaaaaaaataaaaaggaactccactgtatagccacaataccattaacatacaaatataaaatgtgtactattaccatctgttactgtgttatcacaatcattaagtaccaaaatgatagatagttgtcaaagtcaggaagatgattttgggatagtggagttatctataggtctcatggaggtttgactcacctcgtcagtaatatacccctgggagcgtagctcagtggttcagtgattgacagtaggcatgaggttctaggctcagttcccagtagcagtggagtggagggagggaggcaggatgataagccaggaaaacagtaggtccagatcatgagcgatgctcattgggtttctctttggtatctcttcaacctgggacactttcggagcctttcttttcaccgtgctgatgtttttgaagaacactgaacttcatacaatgtccgtgggattgactctgcccaccagcacgttggatcgagcttgttccttgtatagacttgttacaggagaagtgttgaattttctcagtcaccgtgtcagggtcatgtgctgccaactatctctctctctctctggccatatttacttaggttaaagtggtatttcccaagtttttctccattgtaaggtgactgtcccttgttattaagtgtatcttgttggggcgtacttagtgacagtataaatgtctagttagtttcccaacttgaaccattagttttagcagccattcattattattacccaaatcattaagatccttgccaaatagtaagtttctgatgccattgttccttctacaattattagctagctctgtttataaaaaaaatcggtttttatcagtgtgtcaaccatccacccatccatgcatccacccatccatccatcaaccacccacctgttcatcaacgtattatgggcttttatataagtttattaacttttactaatattattcatcttgatatggcgattgtcttagattcaactccttctgatcctttacattggctaaaggtccttttgatagatctctgtcattctctgaggcctttcttatgcatatggatacatattgctttaggataatgacaaactgtcagttcttaagagtataattattgctatcaggaaaattacttaattctttgcgttataagcaggtgtgggtctttctgcacaggtgaaggatgtcatgaaagatatcatgtcagacctgcagcagacaaacagcgagaagatcctgctgagctgggtgcggcagaccaccaggccctacagtcaagtcaacgtcctcaacttcaccaccagctggaccgatggactcgcgttcaacgccgtgctccaccggcacaagtgagatgtcttccggtctgcaaatcttacctcctctgtgtcttttttctacttctcttccccatagtcccttcggctacctctgctgcccacattgctcatgttgaaaagcatcaaggaaagcaataccatgcagatcaaccaccgggtatctctttcggacttcagggctggagtgcaaagcccatggtgtctcctacacatttataaactaagaagtgtaagataattgacatagttcactcccactcatctggcctaaccagtaacacacacaaagagttgtgtgtagcttttcttctgatagcagaaggacaactctgtttattgtgttacccacatttacgaagagctatacaattttcttatgaaatctcataaactagattctaacttgtatgtaagaatttaatacaaaagtcgccattataccccagaagaataaacagcctgaaataactttctagtaaaaaatcatgacactgtatgaatacagagctataaaatggagtagaatcattatagttgcatgtaaaggtgccagcattggactgtgctagatatacaagaacaagctcttagagcttccatcctggaggtactaagagctgaggaagagctctcctgtatagaccggtctgataaccagttgagctgacattgcaactgaacatgcggtatggggcagttggttaaccatgtaaatatgtgccttgacacaccagacaagtaattctgcatccctcagagattaagtgccaaaagcaggaaaagtggattgtgttttgttgctgttatgaattattaattttctcatttaatcccctgaatgttcttgcctgctatatacaaatgaagtacaagcttctgtatttatgttctacatttcactaagtttatctctgtataatataggtttggctttctttgtttcttacttttctttctttttttaatctttgctggtagattgttaggtggggaagtagccatggctgaatttaggataaccttaaaatgtgttatccttttccccttctcctccttttctttataggattctgttcttcatgtagtattgtttcaaattagtgacagtgagaagaatgtttgataccaaagcaatgcttttaatatttttcacataggatcgatgtgtgctatagatttaagttttggtattttgatttgttatggggttaaagaccctttccctctcctgttctcccgctctttttctgtcatcttgaagatcctgtcctgtactgttaagaaactgttgcatttatccattatcctttgcctttttaggctctttgattcaacaaatggatataaagtgtcttgcactagacacaaggatagagcaggagcaaaacagacaaacatctcagttccttctaactggagacagagatttatttagaaaatgtaaattatagctgggcatggtggtgcacatatgatctcagaacttgggaagtagaaagatcaggggttctgggtgatcctcggccacctgtgtaactattttgaggtcatcatgggctacatgtggaagactctgtctcacaaaatgtgtgtatggggatgtgaagatatagaaatggtagacaggctaaagaaaaagacgatagatgagagggaagaggcatctgatatgggggaggctggtggctgtggtggctaagggacagaggaagaggtagaaaggagaacgggggtgggggaaggggagaccagtctcagggtgcatgtaagatacaagagtgaagtgcaaagaaagggaccaacttttaggtctgtcaagccagtgatactgtccacgatgtgaggctggaagaaagacaagatgtaaaggaaaactagttttcatggagaaagatgaacggaagggaaccagccccctttgcacctctgcttttaggataactaagtccagttgcactagagtatctgtgtgctcatcttagtctcttctggtgtgtagaggcatcaagtcagggtctccctctgcagcccaagctggactgaaactggctatgtggatgaggccagcttttaattggtgaccttcttgtcttagaacccttagaactgtaatatcaggagtgtacctttgtcctaattgtggaatttagtctattaaaatcattaaatttgtgaagcaataaaatcatagaatccattaatttgtagaatttagtccattaaaataattgatttggtaactcatatatttaggttcgtttttaccactgtgttggagcttatttcacctcctgtttctgtatcattttcttccccggtcttctctgtatccatacgtctcctttactcataatatactgtctgggaaacactgtacactcaactgtgccaagaacctgagattttcttacttattgttatcgttgtcacacatgtcacttttagattttacaaacttgagatgcaaaagatacaatttaaaatagcactcacaaattaaaaaaaaaaattgaagtgcaatgaattacggtgctatctacattgtttccattatatttttctgtcactgatttcagaccagatctcttcagctgggacagagtggtcaaaatgtccccaattgagagacttgaacatgcttttagcaaggcccacacttatttgggaattgaaaagcttctagatcctgaaggtaaggttgagatcttgattctgctatgtataagtttgttacataaaaacctgctgaacttgattctgctttctaattttgaacacctttagcagtgatgatgtttttcttttttacaaaacactatgacaattaagggatcctcattttaccatattggccataattatatctttgtgttggttttcctacttttctgtgtgtagtatgtgtggctgttgtgcatgagtggagtgggtgtgtgcacatatgtgaatgcatgtgtgggccagaggagggaatcaggtgtctttaccacttcccaccttgtcttttaagacatgggcgctgtcagctgggctgactggcaatgagcctgtggggtccacctcccgtctcccacaaagcactttattgcagtaaatcttttgtcctgtttgtagtctttagacagcaggttaatgatttcaccagataagagttaacttgtatcaagtaggattggaaaagtctaggaatacctacttgctagagaaataattcagaattagtttggtttcttggaatgcatgtacgtgtgagcatttgtgtatggtttgaagactttaattgcaactttaggtttgaattctgcccactctattgtgtgagtgaagcctgtgccatattttaaatggctacatgagtagctcttagagcattttgagacagttttttgtttgttgttttaaaatttgttcttgaaggcagggtcttagttagtatggagcctaggcagtcttcaaactcatgaacctcctgcctcagcctgtcaggagctgaattgcagtatgcattatcatgcccaccttatggaaaacttaagaaccggaggctgaataagtcttcacctctgtccatattttgtgatctgcagcagcaatttcctgagaggcagcattatggagatcacaaatgaggcattgtttctgggtacaagaacagtcactttttacttggtatcgagcagtccacacgtttctgagtcatcttttcttctgcttttagatgttgctgtgcatctccctgacaagaaatccataattatgtatttaacgtctctgtttgaggtgcttcctcagcaagtcacgatagatgccatccgagaggtggagactctcccaaggaagtataagaaagaatgtgaagaggaagaaattcatatccaggtgctggctcatttttctcgaaacttttgccgtgcctgtttgatttcccccaggtcaaacttgtgcagggtgttttctgaacatgtgtgtgtgtgtgtgttttttttttctgagttccgttttttatgaaacagggaagtgttttgtttctcaaggtgagtagcgtctggggctgttgatcgtggtgctgtgtggtacgctaaaagctctactatggagtcaactggatgctgagtggtggattctgtttatgctgagaggccaaggcgttgacctggtgtggggaacgttttctctcatgttgtcctgggtaatttttgttaagtagtaattttctttctgtttggggtccattaatagagaacttttgcccccaatatcttctcataaggattctcaaaataccagccttactttccctttcccctggaagaggcactgtactataaatcattcatcagatttttccagaaatgggctaacagatgatttcaccagcaaataaatgagattttcctaaggagatatgaataatggatttttttctttctccattaccctggcttgactcaacccatattttgtctctttgtgatttttgtctaaaatcccattcttcttcattcataaaaggaagaccgttcagattttcgaagtcatgcattttagcaactaagtccagatgttcacacaggcgctggggagatggctcagtcagtagagtgctctatgtccatgcctgaggagctgagttaggatgccctgcatgtacatagacatcgggtttggtggtctccctgtatcctgatgctgggagacagggatgggcgggttagcggaactcatgggtcagccagcataagtgagtcactgagctccaccttcagtgagagacactgtctcagtgaaggaaggaaggtggtgagtgattggaaaatacactagatatcaacctctggctaccacattcgtgtgaacacacatgcttacacaccacatagatatacacatatgaggaaaaagagggggtgaggattgcaaatttgtgagaagtgcattttggatgagtgtgtgccctgcagcttacatgtcaccctctggtacttggatggggtcagtgacttggcctcttgaccactgtggttaatgttacctccttggcaaaggcaacacaaagaatactcacttgctaagcccgtttctctgtcattactatagatttctctccagatttgctttgacattctcatttagcaaatttgctttcatttttttaaaaaagttactcaattttccaattataataatcttgaacatatcatctttttcccctatttttatgagattcaaagagtttacttactcttttagattttgggtggcatgtagtaatcattttatttttatccatttagaaaaaggagaaaaacaccttattgaataggaaaagggagagatggagcctgattgtgaatcctggtttctttttagttttgatcatcaaataatgcagaaggaaaacccttaactactgcaaattgtttaccttggctcctggacactgctttggttcaatgatgtactttcactgggtgactaagatggtgttctgggctgtcctgtaggtcttgcctcttgtatttacagtcatttcttcattggactgatttatttttgttaaaaagagaagatatttcaattcttagtgttaaggctgtcctctcaaaaaggaagggccattaagatggttcagttggtaaaagtgattgtttgttctgaagcttgatggtttaggttagatccgtagaactcacataatggtaggagagtgcactatataattgttcaccagcctccgtatgtatgtatatactcatacagaaacatagcaaatcataggaaaaagaagtggattttacttattttatggtatttagctaaaacaatcacttctttagcatgcaaggttggtatggtaagaatttcagaaaccactttctatttgttaatgactgagtggtttaatgctcacgctgtttattgtatgcttttattggtaacttagaggctaagttccattaagtgagggaatgatgtggtcaagtcttgattgtctcctcgttggcttgtcttgctgtccactgttctctaaggaatgctgactgccagccagccttctctctgaatcctctttctcccaccatgctgagtagcattgggaggtcagtaggcaatccctgagtttccctttagaaacacgccagttgaaaagctcctgcgtatttacatggagaggctttgctgctttccacccctcggggggatgctggtgcctacacagatgacctttggctgatgactagcagtcctagttttgcatgttcttcccattgtctagacttttgcttacctcaccttctgaattatcttagcactgtgacttcaggcctttaagttgagagaatgtagcttattttccttcctatgccctggcattgtttgcgtcttaatttgccagtgtttttacttatgatgactggtttctttaactcctataactcagttgaaaacattcctttgatctctcctataaaacaacattttctgggcttcaaccccaagttttcatgaggatttaatacctcttatgctttaaattgcagtcagagtaggcttttcttcattcctgattcttatgtgtgttgaattccatctatgaaggatcttctacctatatggtctctgagcatgccttccccttttcctacacttaaacagaacctttgagtttctccctaaccaattaagatccgtctctatgtgcccacagtctttcttgccctgtcagtatttttgtgaactatgtcaagaattttaaatagtgacttaagaccgtggaaaggatagtgagggatttcaggccgggcgacctgtgggtgtgaacacatgagagagaccattctctctgctgcctgagaagtggcttggcagataggactgtgggtgccaagggttagcaagccattgtgggccagaggagagacgggtggtgcagaagtggagaggtctgcatggatttgagttgaactttgaaggtaggactagtttgcagattaaacacgggagagggaagaaagaggggtgtgtccaagtatatcacccaggtttttggctgtggtgcctaggtgcatggagcctggggtaggtgttggcaagttttggggtgggtgaaacaaatgagtgtttaaatgtgggtctggtttgatatatctttaaagatgctgcagatgttattgctgctgaaagttagaagagagttttactagaaataaaatatctatcgaatctagattattttttaaaaatcaaataggaatagatgatatcacttagttaaggtatatcgaaagaagggagaaagaagttcaggagggttactgcttgcagatgggcagggccactggattgggaaggagagctttggaagtcaggatggatcggctccaggcacagccactgggaggcttctggaagaaccacgtgagacctggcttctcttgtttccagttggtgcctgttattccggcatagctgttatcagaaacattttaattgattggctaattgtatgattactctaaaaagtaagtctgggaaaatggctttgtcagcttttcagtcatttgggggcaaatgttgagactgttgaagcagactgttaagactttggtggtaacatgtgtaggcatgacttttaccattctcctcatttatgtacatgtgggatagtttacacacgtcttgaagaagttttgtttgaatggaaacaaaggaacagcagagccagtaggcttgattacaagatcattaagtgcataaagagaaactagtaagttagagaaagatcggcagacatttattttacaagtcctaaccctcaaaccacatcccccaaacagaacagctcacacactagagggctgttgcctcaaaacaatgaaacatgaaatcccatccgttccacaggttgtatgtgcgcccttgttcactgtttaatacatggcaccagaatgcagggtccctaaagaattctaagcaggggtcaaagcagagtgtcaggctctctattctgtaaactgcaaccgttgttcaagggccagcatgttcttagttctccatcaaaattctctatgtcttgaagtcaaatactggcatttggagttttatttttgtccagtgactcatgtgggatatttttctctccatgcctcttccaatgtggcgcttgtgtgtgtactctattttgtatttcttggctgtcagtgtcctctgattaattcatggcttcattcactcagctcctgaaaactgggggttgtctcctgagatcctagtccctaccttggtttctccagacattgctcatgtggtgagcgtctgtatgttcatggttgctgtggctttgtttccacagagtgcagtgctggcagaggaaggccagagtccccgagctgagacccctagcaccgtcactgaagtggacatggatttggacagctaccagatagcgctagaggaagtgctgacgtggctgctgtccgcggaggacacgttccaggagcaagatgacatttctgatgatgtcgaagaagtcaaagagcagtttgctacccatgaagtaaatatctgtggccgagagccatatttttccagggccgggcctgatttttaggggtggtggtaggtggagtgacttcaccattggcttggtatttaccaaatgatgctctgtaaaaagatcatgatgtagtgcctgcattatttacgtgggctttgttagaaaactggagtgatcgacagttcatgagaatcagatttcaggcagtcttgtgacattttgtgtatttttttagaactgaggattaaatcagtgtgaacattgttcctttttgaaatattgagctgtagttgcaaatcaacatagccaactagtatcccaaataatcaggtttctcatgctaccctaaaagccagtatttttatttgttgtctgattaagccagtgttatatccagtgttcctgcacgattttatgcaagggcagctacctgctatttagagatagaatcatgatttttcactctatgggaaattctttacggttaagtgggttcttgtgtgtgtgtgtgtgtgtaagcagctcctcttctccttcttcttcttcttcttcttcttcttcttcttcttcttcttcttcttcttcttcttcttcttcttcttcttcttcttcttctctatttttacattaacaacataatcatcatttacttaagagatagcttagctgttaaaggtgcttgctgcaaaactgatgatccaaggtcggtccctgcaactcacttggtggaatgacagatccacctcttatgagctgtcctgtgattccctatatgtgtgttgaaatgctgaacatggtgtgtgtacatggacacattcacgggtgaatggggatacacacccatgaatagttgtaaaacttttaaaatctactattatcatccataacattgttttctttgatctagctttctcttgagttatggttaataccaaatctctcatttcagagctttccacctttggtgaaagcctcctccgtctttgctttgcacaggttcctttctctggggcgttgctgttgggcttatgcactaccagtttgttgtttcatgtcttcgcagcaagtgactcactaactaccacaatctcctttgctagacttttatgatggagctgacagcacaccagagcagcgtggggagcgtcctgcaggctggcaaccagctgatgacacaagggactctgtcagaggaggaggagtttgagatccaggaacagatgaccttgctgaatgcaaggtgggaggcgctccgggtggagagcatggagaggcagtcccggtgagtggagctcaaggaccgagagcctgactccccagaccacagtgcacagtgacactcaagtacaggcctgcggggctgtgactaaaatcagtacagggcaagccttccactgtcctcacaccgctctgtgagtctcatctctgtcaagatcatagaggacagttggaatgcagagggtagtaagaggggaagttatattttgcatgggtgatattgtaattttatatttgttacagtgataaaacaccctggccaaaaaggcaacttaagggaggaaaggatttattttagctaacaattccaggttttggtctcattttggggacccccgaggagtgggagcttgaattcagtagtcatgtcactgcacagtgaggagcagagaagaatgactgtgcccatgctagtgcccaactggctttctttactttcatacagtccagggccccaaccagggagtggtgctgctcggtttcagactagccttcctatatcaattaggttaataatcaatgcagctccccacagacaaggcctcaggttaacctcatttagacagccccctcattgaggctgtcaccacaggacagtgtgccacgggcctacttactgttcagtggtctgtaacagtttaaagagcaggcttataccatggtctgtttcactttccacgttgtgattcgcgttccggtgccgtttccaccaatttaatacgccaggaattcctgagtgtagaaacaatgattctgttttgaatacagggagctgttatttatattcctgactgcccttaatgaactccagttatgaatcaaatcagagctttcccccttagtttctatactgatggactctctgctacttggatggttagggtacacaaggctgtgttttcctgcccccgcttccctggtgctcagagtgggtgcccgtgccaggggacaagcccgagggaatgacactctgtcctcctggccaggctgcacgacgctctgatggagctgcagaagaaacagctgcagcagctctcaagctggctggccctcacagaagagcgcattcagaagatggagagcctcccgctgggtgatgacctgccctccctgcagaagctgcttcaagaacataaagtaaatttgctgcttgttccttttctacttccttgtgtaggaagagtgctgagctgacccggggcctgatggcttctctcggtgtggagttgggctacttcttccctgttgctttttattcagaaggtgttcgttgggaggtgacattttggaaagagacagctttgcacacatgtccatgtctttcttctgaaagtgtgtgacatttgtcacatttggcaagggtgatttgtttgttttttgtttttttttgttttgttttattttttttataaatctttttaataaagattaatttatttattattataagtacactgtagctgtcttcagatgcaccagaagagagcatcagatctcattacggatggttgtgagccaccatgtggttgctgggatttgaactcaggaccttcggaagagtagttggttctcttaaccactgagccatctctccagccaggcaagggtggttttggactcacaagtgcatgagaacctgaacatatgggcaggaatacacagtgtgggtggagaaagaaacagggatatatacttatacttaattaggattaggatatatacccaatcctgtcagggagactgttacctcttttttttttctttttaaaaaagatttactttatttattatatgtaagtacactagctatcttcagacaccagaagacggaatcagatggttttgagccaccatgtggttgctgggatttgaattcaggacctccggaagagcagtcagtgctcttaaccgctgagccatctctctagccccccgttacctcttttcagaagagcatgaagtgctgagtgaggaaccagcacatggtggacagtgtggtttggttctgagatgagtggttcggtttttatagcagaagaaaggtagaattttgttgatcagtgaaacatctagatagctgatactaaggctttagggtcacatgaaacactacccaagaggcatttcaccatactcttgctactgtttaaaccaattactctctacagatgtctaatgactgttctcttcctgtggaagagggaagtgaaggtgtccatatgcttgttcttggttgctctcttggggagctaatcagaatagcttctatgagtcatacagccttttcctcattttgcacattatggaactacagaaaatgacctctgattctatttgcttaaactctgggtttttagagtagtcaggtctacatttttgtcttttttattttccagtgtctcattgtgtaccactagctgacttggaactttctatgtagaccacgatggccttgcactcactgcgatcctcctgtccctgcctctttagtgctgggatacctgcatatggatatatttttattttaattcctagaatagacacagattttcttcttttcctcctttccttcttccttctcatcttcttctacctcgacttgtttttttgggaagaattaggactgaaaatggcacacattgtcacacatttacaattggttttgaagttgcactcgcagactctggctcctaatgaaatgtaagggtgtgttcaggtttctttctttagtatggtacttagggtaatggttgggaatggcaataccatgcctcattaggttccttaattactatcgtgaagaagcggatttttaaataggtaaatgaggaagagcagatatcatagtttatcttttcttttttcctctagagtttgcaaaatgaccttgaagctgaacaggtgaaggtaaattccttaactcacatggtggtgattgtggatgaaaacagtggggagagtgccacagctcttctggaagatcagttacaggtaagaccttgagaagtaggatgcccttcagatccactctctggtcaaggtccatgtattgttcctcctgggcatccttgtttgtacagaagggtataaaaaagtagactcctttaatcatcttttcgttactgtaatgaaggtcctgaggcaggctacttgatagagaacaaagtttacttagctcacagttttggaggctggcagttcagacagcctgacaaatgttctcccttggctatgtctaatagaacagaaacatgtgtatgtgtgtgttgtgtctctgccttaattttttaatccattagaatttatcatgatcggccacctttgtgccctgatttagaacccccctaaaaccaaaccaaacaaaacaaaacaaaacatcagatttccccaccctaaccagaaacaaagcccatcctcaatctgaatttccaccttcttgatactatttatgcaaatcttttttagttaaattcttgtttgaattcatggtggggtggggtggggtggggtgggacacaaagcatggcacctgtttttggttgtatctcccagttaggcctcctcattgtgtggtttcaggcttagctaggcattccttgtttcattcgagtccttgcagtgaaggcatgagattgttattctgctcccttgtgtataatggtgacaacatttaaaagcaccagaactcattcaagtgactcccaggcttcccccagaacagtcacttgaagaattggtgaaggcaaccatagcctggaaggtttgaagcatagaaagtaaacatgtagattgtggttgtagcagtggttgaaaaaaaaaaatacaacaaccctcagacacatatacccaattttcaaatacatgtgaaatgttgcattcccatacaaaccttacagtgaagtaggaacaggaattctagttttttttttttcctcatctctgagtaatttaagtaagtctaccctatgaaagttagtttttttctcatatatgtacttaaaagtattttttgtagattggtgttttggaaaactgtagtaattgtgtctcctggctgggctgacagagactgcttctcccttccctagaaactgggtgagcgctggacagctgtatgccgctggactgaagaacgttggaacaggttgcaagaaatcagtattctgtggcaggaattattggaagagcaggtatgaaactcaaccactgtccactgaggacaaaacagtgacaaggagcccatcgtttcagtatggctgtggaatgtggctgccctcttctctagtgagaattctggaactttggcttctttaaaaaacacagaaatattataagaatatgttttttttttatcttaggttgttccccctcccccagtagctgattatgatttgcctcgtgctctggtggggatgtgattttgccagctgcagatattttctgtgattgtgtggcctttgtaatcctgtggactcttcagagggtatatgtcatagtcagggtttctattcctgcacagacatcatgaccaagaagcaagttggggaggaaagggtttattcagcttacaattccatactgctgtttatcaccaaggaagtctggactggaactcaaacaggtcaggaagcaggagctgatgcagaggccatggagggatgttctttactggcttgcttctcctggcttgttcagcctgctctcttatagaacccaagactacaagcccagagatggttccacccacaagtggtggtgacactgtggacaaaagttgttaatatcatagtggataagaaggagaggggggtagagagagagaatgagaggggagagggagagatccttaatagggaatagcatataaacaaagaaatgtgtcttgcaatttagaaggtaatgagtccaatttggtgagggcttctttctggctcacaaaggatcctttgttacattcttatcaatttgtagaaggaaaaagtagttcttgatcactaattgaggaaatgccttacagttggttctcatggaggcatttcctcaactgaagctcctttctctgtgataactccagctgtgtcgagttgacacaaaactagccagaacagtatataaatcctggggccctgagggttgttgggttgttctttgttggtggtcaaggttagtcctgcacaaagaagaaacaacaagaagaaattagatatcctgacatcgaaggacttggcacccgtaatcagcaggaaatagtctaaggataacgttgacccctttctggtccctgactttgttcatggatctctttgctctctcccctctattcttttctccctcctatctagtgttatggaatcgaacgagttgaaggcgtaggtagaagagggtggaaggaagaagaacccacaaagtagccaaagaccagctagctacactcttccctttttttgaaaggccttattttgaaaataatttatgaaatttggaaataatggtttgctaatcactttaaaaattaaaaaaaaaaaaaaccaagggaaaacaagtaatctgaccatttctatcagtttaagttttatacaaatgtgtatgcattattgactgctgctgcattcattaattcatctttttgcttgcttacatattttttggcttactttatttattctgtcctcatactcactgtgtaactaaggatggcactgagctcccaatcgatccttctgcctccagcagtaaaggtggcatcgtccccgattcctgtgggggctgtggggagaagccagggccttcctttacatggtagccatgcagcctaccggctgagcaacatttccagtcccctatttattattttgaaagtcaaatttctattaatgttatatccatttctgcagcttactcattaagatcatggtatgaggctccatggtaatagtaatttgatttctgttcattatttacaatgttagtgcttaggtctgttcctgtcttgacttacttttcatggtttaattactcatgggcttttgttgagggatctgtttgaatgtgtaccagcacaattcccagcatacagtttgtgctcagtaaataaaaggtacaggaatattctccatatgctgtgaatattaaattataatcttcctcttaacttttaaccagcatacaggatgaaactagtgagaaaatatttcctagcattgcttttggataagcattcagtggctccgtgtgcaaagccgtctgcacagcttttctcttggtttggtgtctcttcgatcaccttttagctttacacaaaggttgttatcaaaacagagtacaaagaagtaaaaaatttctccccagtgccaagcagctgtagcctagaaaagaagcagacacaaggttcccacagcgtccatcttggctctgttgcatttccatccagaaaaagcagctctgttctctgcatggggtcaggaaccagatgggtgagatcctggggcttcgctgaggcagaggcagatagttcattttaaatactgttacaaatgattaatccgcatggtggtcaatgatcttcctcctcctcctcttcctcttcctcctctttaaatcagggactacataatggggctgtgactcagtgcttgtttaatgtgtatgaagccttgggttaaatcctcagtaactcataaagtgggtgttgtggtgtataccacaacttaccttgcatgccgagacataagcaggaggatcagaatttcaaggttatacttagctggctagcaagtttgaggctaatctgggttaaaagaacctgtctcaagacagacacccaccaaaacaattgtataatttattctgcttcatgacatatggatggtgcattttggtaatgtgtatatcaccccagatctttatgttcaaatcaaagcatcccatacagtagtttatttttctaaagtaataatgacggacatcagtcattatcagaacaagattggtttgccttttctgcctttccagtttgcttattgcttctttgtttcttgtcagcttgacacactgtagtgtgttattagagaagaggaaccacaattgagacaatgtcttcatcaggttagcctgtaggcaagtctgtgcgggcattttctttaatgattgatgtgggagggcctcccccactttggggttgctgcccctggggcaggtggtcctgcgttgtagcaggaagcaggcagcatgagcctggatgactgaggcagctggcggcattccttcctctctgctgtaattcctgccctgtgtcccttagagacggagcctttcctcctaagctccttttggccatggtgttttatcacagcaatagaaactctattaaagtttggaaataactttaggattaaaaaaatgtttagaaaacaagggatttttgaccaactgtatcacttgaagttttatttatttcatgtatgtgactttactgttgctgtcgtcagacacacaagaagagtgcatcggatcccattacagatggttgtgagccaccatgtggttgatgggaattgaactcaggacctctagaagagcagtcagtgctcttaaccactgagccatctctctagcctgtcacttgtagttttaaataggccgtctattcattattgtctattgctaggacattttatctctctcccactctctctctctctctctccctctctctctctctctctctctctcttgagagagaagggtatgtctgcaccttctgttttgctccctggtcatttatacgcatatcttaactttactaggcgaggagataggatctgcatttgtcttttatttttctaattttcactttttttggggtggtggtggtggtggtagactatagaggtaaggagtagcttgaaaatacgttgattaatgagacaactgagaaagaattcttcccattgcaagtccagaactaaccctttgccccttagctatacagaaaaaaaaattaaaaaaagaaaaaaaaaggagagtgtaatacactctacttttgggaatagggctgtcttaagagcatctcactccatcacttaacatcttccaaagaacacacacttttggctgtgagttttaaataattttgttgttggctttgggacatcttcatccttcttcctttaatgtaattgcatttgaactttgaccatttgcatacttttccctcctggtgctgtggacagacagttgatttaggggtgggagtttatgacccagctcagccatttagtagcttactcacctcaaacatgtaacttgacgtctgtttccttctctaaaatgagcagcaggaacaagaaaatctatgagcttcctttgaattaaaacctagagttctaatatgatttttttaaagctcagcataattggatttagtatcctttgtctactcaccttcttgagatctagggttagttgctatatgggattattttctcctactgtaataaattccctagccaggtttggcgtcacatgcttgtggtgctcaggagatggagataggaggattgcaagttcaagatcagcttgatatactagcaagaccccactcccatgccccccaggggctagtgatatgaggcttattcgtattgtttcatgactatattctactaatgattcgagctggtagctccaccactgagttgcacccatagtcctgaaggcttgcttgattcagtgttttagagttgtgaacatccaaaagtacggtgctagctctggcgaggaatccctgcctgtcacatcacagtacttagcactgcagtgggagtgtgcaccaaagggggaggtggtgtggagacacaggaagccagaggtcaggaggcgccagccttactcttttgtaacagtgattctcaggaacttatggaggccccagaagaacagcatatctctcttctgcgggcagcaccatctgagacttcctcctagcttctatatcttacagattctagcctctctcctgccacactggagaccatgctcttcctacacaggagccctttaaggacatgctaaactctattcacaccttacgagttatcactatcgattagacctaatgacaggttaatctgttgtaagttatagaggctatgcttttgccagtccttgaactcgggtatttgaggttcttattatcccgatctacatgtgagtcacagaattgtcaggtgattgaccatgtctctttccaacttttgttgttactcctagtgtctgttggaggcttggctcaccgaaaaggaagaggctttgaataaagttcaaaccagcaactttaaagaccagaaggaactaagtgtcagtgtccggcgtctggctgtaagtgtgtccctgtcggcatctgttgtaagcctgtgatgtgtagtgttttataactaagagttaatatacttgaatgaatacagattatagcttatttcccattactacatcgcttccagccatggtactgtaccaggagccttttattattgcatagagaatggcagaacacactgttggcgggattacaaatctacttgattatacttcccgaggaagataaactttcttgagagaaagaaaattatttgtggaagttggtcctgactcttcctcccagccccatgctcccagaaataagactcaggcaaaatatatttagatatcttggccatatagctagactcttctctgagtagactgtaacttagaaaaactccttttttttttttttttttttttttagacatggtttctctgtgtagctctggctgtcctggaactcactttgtagaccaggctggccttgaactcagaaatctgcctgcctctgcctcccaagtgctgggattaaaggtgtgtgccaccacgcccggctaactcatttattttaatccacattctgccatatggctggttacttgtgctcaggtaccagacttctgtcttctcacatcttcctctggcaaatctcccacctggctctatcccagaatcctttctcctcccgaatgccctacctcctatttcctgcctaagccttaggccatcagatttattattgacaggtgtcatgtccatatagacctaagatattctctatagttgttgtgtgataaatatttgacattctagatattgaaggaagacatggaaatgaagaggcagactctggatcaactgagtgagattggccaggatgtgggccaattactcagtaatcccaaggcatctaagaagatgaacagtgactctgaggagctaacacagagatgggattctctggttcagagactcgaagactcttctaaccaggtacgtttttgatttgggtagtatattataccatgaaaaaattgtgtgtacaggaacagaaaaatgcagtctgagatccaaagtgtgctttattaattgacaatacgaaagattgagccatcagtacaatgtggctgaactgtgaaaacatcatgatagaggaagccagtcatgcatgatagttatgaactatgaattgtgcaggacaggcagaacctggcaggtgctcagtggcctcgagcggtggtgattagggagtgggatgctgtgaacagatatcaaggttctatttgggctgattaagttgtcttggagtgaatgagaagacaagacagacacgggtatgggctattcaaagatagtacaagcttttattcagaagaaaagccctcagggtttctagtctgggaatgagagcacactgtctacttataggctagggtagttagctacaggatagaaagggattgatctgggcaaggatactagaatgttttcttttgtcctgtgctaaaaaaggttaaatggtgacatagaaaatgtcaaccagcatcttgcttgggcagccatcagtgcaggcccatggcatggccagggcaagaatctagaaaaacaagtgactataatttagaaacagagatgactttggttcgggcagttgtcattattcaagcagaatggaggagtattacaagctggcatagccatggctgatgttgacctaaagtctgtagccaatacccacaccaatacccactgcagtggacttttccctttgcttctgtgcagttctggctagtctcgaacctctaacctctgcctctcctaccaagtcctaggattacaggagggtgttaagttttataaagcagtataatcatcggcggggatatattggcaggcccatgctgaggtgtcttcctgaggagacaccatgcaacagacctagtataaagaagacttactgtgggggaagggagcagggacctggagaagcggcaacagaggtgtgagggcaaagaactgtggggctggggggagagaagggcagagagaaagagaagagagaggatacgtgggtacagggaaagaagatggagagagctgctagggtagcagccagtccctccttatatgcctggcttgctcccttctctctcacctggtggactttgacacaggctgttgctaggtagctgttgggcgaggcctaaaggaattgtcaataagccaacagagtgtggcaccatgcgtggcttgaactgtttatttttatagggagcgttttatgtgaataactctcagcagcggctttcatttaaagccaacgctgggcgtgacttgcctttcaggtgactcaggcggtagcgaagctcggcatgtcccagattccacagaaggacctattggagaccgttcatgtgagagaacaagggatggtgaagaagcccaagcaggaactgcctcctcctcccccaccaaagaagagacagattcacgtggacgtggaggccaagaaaaagtgagagatgtcccagcctcaggcctgcctgtaactcgcactaatcactaatcaaatgagagtttagacatgctcattattatgtaaattcagtcatgagctcagttactggctttgagtctctggaagattctgcctcccaggagctaagcagctaaattgccctgagggactttactcatcctctgctaaatttagagactggtgtggagtaacccttctgttatcaatccccatctgtttctcagaggacgattgttttggggtccggctcctgctttcttctttctttcatacctttaagacctgacagtttggctttggataaattccttattctttgtgaatctctttcctctgctcatcactgcaatagcagttcaggaagacaatgcatttttgtgacctcacgatctctgtctgtctgtctgtctctcctcctcttcttcctcttcttcctttcctttttatcccccccccccccaccaaacccatccatgtatttaggttttctttgataattccttttatcaggtttcttaatagatgctttctgttttgctgaaagagctcttttgggttaaaatgtcccttttatctaactgattcgaaagaaaactggagattgttagaagaatgagatttcagctgcattcactgggcctttgctgtgtcagagcctttaaaaaaattctctacctgtaggtctcgactcctttgggggtgtgtgtgtgtcatatcaaaaacccttcatatcagatatttacactaccatccataacagttgcaaatttataactatgaagtagcaaagaaataattttattgatggaggtgacggccacatgaggaactgtattaaaggatggcagcattaggaaggttgagaactgctgctttaaaatgtagtgtgttctaggcactggatctggtacgcctggtcacagtgagccttcggctcggcctcaagcttgctctcatgctccctcttgcagtgcgatcccagggttcagggacattggcagttattaggggcctgaataaaaagataagctttccttccataggatagctttattagaggaatcaggatgtggggcgtatctgatgattctccttttgaccctcagcctgttttctgcctcctaacggtgcctcatgcatgactggcgcacctgccgttgtgagcagcagcctttactttggccagagcagcaggcagagaaggagatgctgtcgatgtcaacattagcagcaatcttccatttcctgaactcttgttagctgctgggcgcatctggcactgtgtgtctccagggctggctttggaatagacagggtgtatcctgatgggaggctcatttaaacttgcctgtagtgaataatgagccttctgctgcaagagacaaaatgctgtgaccaaggtgacttcaacaactcattatcgtgtcgtatgacaagaaacagtccagaagtggcccagctgtggcgagaggatgcacttaagcagacttcccactgccgtccctgctattgttggcttggttgcttttcctcacagtgctttgtcttctcagcaaactgggtctccgatgtcaccagccaggattttgtcccttgcttgttcaagtttataagctgacggcaatggtactggaggtccagatgaaccgggtcatgtgtccttcccttatccccagtctatgcagtttgtacaaagtatagagaggggttgtgagtcatgagtcctgaccttcgagggtggattgaggcagacattcattactgaattaattcctcggcagaggcctgagtgcatgctgtccacggtagcagaaatctcatttgtaaattttttttatgccccatgtttgcctcagaacgtcctgtgtgctgtctttgtagagcccaggcatgcttttgtaggcagtagcagggtccgatggctgcccactgggagttccagtttcctagaacatggaagtagacagggatgcttaggtgttgcagaagctgacagtttcctaagatacggtgtgcacatcccaggagaaggcatggaccagagcagagcacaaggctggaagcccaagctccgagccccaggctttcttgtgacctgctgtgggtcctgggcatccgaggagattctccgtgtgtgtgcagtgctggctcttctgcatccatgcagtgtcctttccctgttaaccttggctatgaaggtttccagtcttcctctctgccagctggtttttctgctgtgtgaacctctcagtcttttcttttttttccccctgagacagggtttctctgtatagccttggctgtcctggaactcactctgtagaccaggctggccttgaacctctcagtcttaatgcagttcacttcccccttattctccccaacctcctctcctcaaaatggtccctcacgaatgtttgaggttagctctcacagtcacttccattgtcctaaagacgaggctctccttagctattccttgtatgacataattttcagacccttttgtgtattcagttagctgtaaaaacggtcatgaacttgtgttggactccacagacaattgagagccctaaattacctaattacttattcttggtagtcaattttattttgttctctttttttttttttttttttttcgtttcttttaaaatctgctcaggtcaggcatttccagctatctggttatcttgtactggggtcaatgtgtcttgctcatttctcttatctcagagagaaactgtggacatctggattctggttacttagctagagcatcacacactcttatgttgaagtaaaatttatcgaccctcagatgtctgaaataaaaggggtttaatgagtggctcagggacaaattctgaagcctacaaaagcaaaagggttcagtagatggaaatgggcacttgggaactaatagcccaaaacctctgtgtgtgtgtgtgtgtgtgtgtgtgtgtgtgtctgtctgtctgtctgtctgtctgtgcatggttggttatatggatgtttgtgagtataggcatatgtgtgtgaatgcaggtttatgtgtgagtgtgattatgtggatgtttgtgagtgagagcaggtatgtgtgtatggttatgtggatgctttgtgtgagtacaggtatatgtgtgtgtgtgtgtgaatacaggtttgtgtgagtgtggttatgtaggtgtgggtgtggatgtgtggggttatgtggatgcttgtgtgtgagtacaggtgtgtgtgtgtgtgtgtgtgtgtgtgtgtgtgtctgtctgtctgtctggttatgtggatgtttatgtgtgagtatagagtgtgcatatatggttatgtagatgtttgtgtgtgagcacagatgtgatatgtatacgtgagtacaggtttgtgtgtgagtgtggttatgtggatgtttgtgtctgtgagtacagggatctctctctctctctctctctctctctctctctctctctctctctctctctctctctctctggattccaaaggtttccttcctcaggcatggtccccctggcttatttgtcagtgagcctcaggaatttggctgactctgcctgcctccacagctctgggattaaaagcatgccacccagccagacttttaaaatgcaggaatgacttagaagtcagatcttgcagggcaaatgctttacctacagagccatccctctctgcagtcctcagagcgctttgtcctagggaagactagcgaaggaagagtcagttgagtacattgtgtttacctggccatatttagaggtgagactgcaaggtgctgaagggcttggtctgagtggctgggtgcagagtccctaagaagcattgctgcttcttgctcactagtctgggacatttatatattaacaggttgtggtgcctggggtacagccaccacagatgccaggtcagttttaacttgctttcaggaatgtggaactatcatgttagttctggctggtagctattaattaattcccttaactcttgcctcctctgatttagatttgagatattgtagaaaatgccttttaaaatcacatattacacagaaaacttactcagaatctactagaaacacattaagagctgctttccagaggaaccttcaaatacctcttctcagcttatgatgctgagtcacgccagggtaagggggcagctgcatggactgcctctgtttgaatagctcttgcttcgtttattagtatggggtccattattcaaaacccgtatgagctcagttgcttcgactctaacaggatattcaaaagtattttcagagagagtggtgaggattctttgcgttaacgatagacatggaaggtttaaccaagggcctggtctctggtcacctttcagaaaactgtggttttcacctgctttgggatcccatgtccagcctgcccactcttccccctcccattaccgctcgctgagttcctcttgtgttctatctgtggtggtcttttctgtgcagtcttgggttctggccccacagtgagtgactggacactatgaacagactcttatcagttctgtgcttaacacagctgatgactgctctttgtttaaatccatcatctatcacccagggctttattggcccctttgactcttggccacatcattatttcgccttccctcgcatcactctctataccagacacacctatttgtagctggcaaaatatggcctctatttccgttgctttctctttgcaagggaagctgtcaaacacagccacacttatgccctgagaccatgctttccacggatgggttaggagtcagtccttggcagtcctgggatttacctagcatatacttttcttattacttgtcaatttcagttgcttcctgatgacttgaggcccccgaaaggctgagataggtctggttaactatgtattgagcagcagaggatagttttataaatgtttgtacttgtcctttttctgttatcatctaactaaatctgttttttgttgtctacaatagcttataaaaatacaaatgattcccaattaagtaaaaaaaaaataattattttattagccctataatgttttcacttttaattgtaaaagtattatgggtggttgctctattttggggcagagtttgaatatccttgcctggtgggcattcaggttggtctttattgggccaaggcaacactggaagctgaccagtgacagaggcaaatgtctccatcttgaccaggtttgatgctataagtacagagctgctgaactggattttgaaatcaaagactgccattcagaacacagagatgaaagaatataagaagtcgcaggagacctcaggaatgaaaaagaaattgaaggtaaaatatacaatgaatatgccaggaagtaaaataattcatcaggctaattttactattggcacagagatgtgccagggtccagaagctattgcaaaatacatgtagccacagatggcttttagagcttcaccgtaaacatcagatcaccacatgtaggagaaattaaaaatgttttccccttttcctccttaatcgttgagttgtatatacagtcatcattattgccctctatgtagatttaaatttacatggtctggtacatagtaacttaggactttgtattgtttcagagatattctgcccttgtatctaacaaagcatttggcgtattaaaatttcctcaaaatatttcctttaaacaatacagctttttttaaaaagtcgatcttagaccaaaaatgttaattttaattatttccccttgataatgaactcataattacagaacatataatcttcccttctaaaagaatctaaagttgatattcactgtcatcattttggaattttctttttcagacgtactgattctccgagtgctagagagtggccaggaattgcgtagttttttcattacagtactttgtagataaactttgaaatacctaaagaaaagttaagagggcacaaaatatgaggttttaaaataacatcagcgttgcatcgagaagggatgctttcagtgttttatatttggtctttgtttccagggattagagaaagaacagaaggaaaatctgccccgactggacgaactgaatcaaaccggacaaaccctccgggagcaaatgggaaaaggtgaggccctgcagggcttttttttccctctcagattattttagaaggtcacacttaatatttgcagcttaacacacaaaacatttaatacacaaagatagaaaaaagatctggttttcaatttttttttgaggcagcagaatctttcaaaaactgaaatcttatattgaagctttttattaaaaacagataaaatcaaagtcgttctgctcccacttgggggtcagaaaactagaaaccttgaaaacctcagcagagcaattaaaatccaacagtgcacaagattgtaaaacctcacctttggggttacatactctgaatttttcttatacatgagggcactgagagaaatgtttatgctggcaatgtcttagatatgaagtcgccttaaggtaaacttattctagtttcattctgctgctgtgacaatcaccatgactcagagcagctcgggaagaaccagttcgtttcagcttacaggtcccagtccatcactgagggaagtcagggtgggaactcaagcatctgaaagcagaaaccatggaggatgctgcttgttggctgcctggtccttacagcctaggacctcctgcctaaggaatggtgttgcccacagtgggctggactcgtctacatttctttttcttttctttttttttttttttcttttttttttttttttgagacagagtatctctgtgtagccctggctgtcctggcactcactttgtagaccaggctggcctcgaactcaggaatttgtctgcctctgcctcccgagtgctgggattaaaggcttgtgccgccaccaccgccagcctgttctatatttcttaatgatcaagacaatggctactgtgtgatcctcagtctaggatgtcagatgatgctaggctgtgtcagatggacaattacagctatctaggacacttattaatgtttgatatttggtcacgttcggaggatcacattaatatactctagaaacatttttctacttaaatttgatgttacttgtattcaaaaaattttcaagcagcaaagacccttgctcctcactaaagccttgcatagacacagagaaacctaaaattagtattttctcttctgtggctgtttagtttggcatatggtttttttctttggtggtactggacctttcttccttccctcttaagaaaagatgtggcaggctgagatgtcaaaggctggggcatgggttgcagtcgggtgagattcgcatgctgctttaggcccgggttgaagggcagaaactgtagcgggcacacgccagtaggtgcacataggcaggagcaggtaggactggccaggctgactgcagaaactccctccttgagaactctagagggaggacaccacgaagcacacttcctgtgcacctgttccttcttctaaaaatacttaggttgcctgtcagatggttgggtcttagctccgcctgcatggaaatcatggatcggcaagggaagggctagtcttctgtaggcagctttagcatctgttcacagcagtgtatggcctcagcaggcaggagcgacatcaggcagtgctctctgatattagccttcccacagtgggactcttctataagcatcagagttattgcttaggcctaggaagtggggagccttcatcccaagagagtggctggctttgtttcttgtaagtggacatagctgtagggattcctcaaccttgggcaatggccaatattatagcttctgtacctctggtgcctaacactcttggctctaaaggcttgacagctttctgggtctattctgaggactgatgcttgtagtttcttcttaatctctctctctctctctctctctctctctctctctctctctctctctctctctctctctctctccattccctcctcccctctctctttccccttcccttcttccctccctccctcttcctccctctcctcctccctctaccctctcttgcctccaatttatttccaccttctctcctaccctgtctattatctcacatccactgcattgcagctgtgtctgtggctacatccccattgctgctgctcaggacctggctacctcagcctttgtgccactgtcagtagaggctctgccccttctgcagcttggcctgctaattgctctggtctgtcttgttgtcagatgtctatttcgaagtttagcctactagtactgctcagttctgtattccctctctctatcatctctttttctaaaccccgttcctccctttctgccaacacctcccctgaactcacgtctgtactagggatatattgcattcaagactttgcacacataagtggtctcccctgtctttcctgaagctgtcaggcatccagtccccatcccttggccactgctggtctggttcagggctgctggctttactctccagctgtcacttcttgctgtctctgttgctcctgtctttctggcatgtgctcagctcatccacctgacagtagacaataaaagaccatacaggaaaagccttttctggacctaatgttacatcctgggagggtgtaagagtatgttttccagctagttccccaagtgagccaaaccgtcctatcatgtagccagagaaagggtatttgtatcaattgcagcaaacctcaaaaataaataaaggttgtgcctataccaagtgttctatttgtaccaatcacattgttccatttgtaacaatcacattagtgttttgaggccaaggaggaaaggccaatgtgcgtggaaatgtgtgcagtgtcatctactgtttgctgaagctagcaaaatgtgtagttcaaactctcatggttggtgctgcaccttcaggagttgggcctgtgttgcagccttgactgtcatgtgcgtcccctaaggcacctgtggggccatcattccgcgtggctgaggccagctgaagggcagcctgcctggccattttattgatagtcccctggcttgcagcagtcaggagattctgggagtatcatttggggagttaggtcaccccttctgtcacatttttatttatgggaaaaccaacaacagaaggaatgcttatgataggaacttactaacactcatgtcagctttaatggtatttaagagctcttcacatatttattcaactcctgcccagggagaggtgggacccactcgcctgcctttgaaagtgttctgtgcctggctctgcccttgatcagagctataaacaaccaaggcacaatgtggcagattagttataccaaatctttaaaccagtagtttttttttacatctttaactttgtgtgtgtgtgaatcattttgcaattactgcttttggaatgaaattttctttatgatttatttctattgtatgtgcttaagtattgccagcatgtaagtaagtatttgaccacgccaaagcaccatcatatgcatgtccattgttcacacagttgctaagaaaatggtgctttttcttgtccatgactccgttagcagtgatacttgcacatggactgtggtgtgaatgccttgcttaggtttaatgtcctcttagcagcttgctggtggaagtgcccttgaacagctgatgtgggtggtacctttctaccatggtgtgcatgtttgtatctctgattcttaggagatgtggtgtgacacaaaaccttccaaatttgtattgctggtgagacaggggtggcttctcagtttccatgacattttcctttcatgttgggtttccatgactgtggatgttgatcatatatgttcacagagaagactctgcactcctactcatatcctgaaggtgttgagtctctcctttcagcatgtgtgtctgccaaatagagttggttgctgtagtacaatcaatttaatcttatccccaactagcttacaaatgaatgagactcagagtctggttattttatttagctttgacaattcttggggggggggcacctataatctgatcttctgactgctggcctggctacctccccagaggtgtaccccagatacctactcttactcctggatctgggctcacggcccccctagtctcgtctctcatggccccttctctgctctccctcctctttccagttctcccatgctcaaccaggtaacttaaaaacctgcctacctctgatctctccagtcagtggctgtagccccttatattcaaccagtagttttaagttaaggaacaaggtctacacaagaaaagctggtagttcacgggtgggcctaggctttctggtaaagaatctagcattacagtgcatagcaacagaccaaacctccacggattgccacttttctataccacctctcactcacttaacaaaagatttaatgatagtttatagcactacaaagggtatggaaagtgttattgttatagataatttttttaaatcaattctaaggacattgcatagctttctaaaatttgagaaaaaaaatttaagcttgtcagtggctggaaagatagctctgtgggtaacgctttttgccaccaaacctaatgacttagatccttccctgggagccacacagtagaaagagagacataattccagcgctttgtcatctgacctccatgtgcatgccttggcatgtggcagcccccccaatacaaaataagtaaataaatctgggagcttgtaagagtaacataatagaataacattttttgagctgtgtctccagagtagctaccattatcattactttggcattgtttgtatttactcatatataatatttatataatataataataatatgtttatatttactcatatgtgttcagagtgcttcgtaggcttcttgatgcttcctgaacctggcatctagtttaatgttcttacatgtacccatttgcttgcaggcaaagggactcctgtcatcttttgtcatcctagacttcagccagctctgagttctgctagtcttctgcttcattttcctatggcagaaggcgtatattctgatgtctgagctctgcacaaattcaggcatttgagttgatttgcctgcatcagattataagttagcagagtgttacagtgtcggggatggagacatggtctacagaagaggaactagtggatgctttatagatataccttatgagatagccatatcacctctgaactcttagcattcctaactccccttaggtcaaggagttaaagcatatccagttattagtacatcataatggtgtaaaatagtcatatctaagggtatgacctaagggtatgacctaagggtatgactgaaaggtatgacctcagggtatgacctaagggtatgacctcagggtatggcctaagggtatgacctaaggatatggcctaagggtatgactgaaaggtatgacctaagggtatgactgaaaggtatgacctcagggtatgacctaagggtatggcctaagggtatgatctaaggatatggcctaagggtatgactgaaaggtatggcctaagggtatgaccattttacgtaacattgcctaatctttcactgtgttagatgtctaggaccaattctaagccactttggtattactggatgaagtgctttgatgcacctggacctttttgtttccgtagaaggcctttccactgaagaagtaaacgatgttctggaaagggtttcgttggagtggaagatgatatctcagcagctagaagatctgggaaggaagatccagctgcaggaagatataaatgcttattttaagcagcttgatgccattgaggagaccatcaaggagaaggaagagtggctgaggggcacacccatttctgaatcgccccggcagcccttgccaggcttaaaggattcttgccaggtagggtgagaaatggctgcactataggactgtagagcctttctgggctgagtctcttatataaaaagagaagatatcattcagtgtgtctggtgagtgggctgtgtgtgtgtgtgtgtgtgtgtgtgtgtgtgtgtgtgtgtgtggggtgtgcatctctactcatggagacctttctgggttgaatctcatatatgaagaggaaatatcattcagtatatgtggtgaatgatgcatgtgtgtgtgtgagcacacatatctctactcatggatgccagaagaggtcagaggaggacattaggtgccctgccctaccacactctaccttattccttgagatacggtctttcactgaacctggagcctggtgtctagtaagtcccagctgccctcctgtcactgccctcccttaattccagggtcgcagcaggtggtgatacccacattttcacatgggttctgggtatccagactcaggtctacatgattgcttagcaagcgctctcacccactgagccgtatctgtagcccgagaggctgtatctcctaaaaggcaaaaggtctcgaaatctgaagagaaagcagagagcgggggagcatggatctggtatcatgagctttgtctttgcttctttcataactgtttatgggaacgctcgtattcatggagtgaagtgaccgtattttctcttcctcagagggaactgacagatctccttggccttcaccccagaattgagacgctgtgtgcaagctgttcagccctgaagtctcagccctgtgtcccaggttttgtccagcagggttttgacgaccttcgacatcattaccaggctgtgcggaaggctttagaggaataccaacaacaactagaaaatggtaaatattggctctcctctgctgtgtgtgtgtgtctgtctgtctgtctgtctgtctttctgtctctgtttctctgtctctgttcctctggttctcctcttagttttccttaaatctaaaattactcccaatatttccacctttagtgtgtcttgagtttcattctggcttcatgctttcttccctgcatccctgtggcttgaagtattataatacattcagacctggccaggtggtggtggcacaaacctttaattgcagcacttgggaggcaggggcaggggaagcagcagaggcagagggataggcaatctgagttcgaggccagcctggtctatagagtgagttccgggagagccagggctacacagagaaaccctgtctcaacaacatccctcccccaaacaaacaaacaaacaaacaaacaaccacccaacaaaccaagccagcttggcatgctgtaaaactgcatgagtaggatatagtgacttctgggagactttgctttcttttggtggtgatgggttgaaccccagtgccccatgcttgctaggcacatgatttgcactccagcccttaaggagaatttaatgggagaaaccactttgttctcatcaaacaaaaacatcatcgatttctgtttgctcccagtggttaaggtcttagtagccccactcgatccttgaaagggatcatgttgcttttccagaatttgaacaaaattgagcaaggtagaattggagacagtggaatgaagctggttcgggtagctggatttggaaagcttgtatgtcgctttctgtgtctcgtcagctgctgccctgggttgtcatgtgccatgtgctctctgtgctctgactgtgacctccaccatgttagctcccgtacagcatgtacaggcattaggaaggcatgcatgttagacaaaggcaccatgttacttttctcttgactgtgcatttggacttcatgcatttcactcatggaaatctgttaacttagtgtgacattaaaaaccagagaagatgtctttcccggctgacccccgcaaaccaagctttcccttatgacgaggatcaggagtgggcagttgaactcatgctgctaattggtttcacctcttggtgcttcacatttcagctcacttcctctttggtacaaatgctgattgtctgggatttgtacagaggcacagagggatactctgtgttagctggctgttgccagtcacccctgtttcttacggtcttagggttcccatgtagtttgtgtacactcatgggatttcaggaaggctggtggcagggtcttcgcttctgtttattctttgggtatcatttgggggaggggaggttgtgtgagacaaaaacgaatgttgtccttcaagcttcatagagacatttcagcatgatcaaatggagaaaaatgctagcgagttaatagttcaaacaccagcctcgagaggaatgaagccacggtctgtctgtctgaaatgccagagggatggctggtcttgttaagcaacagagagccttttcagttgtaatcaggggatctaatttattatctactggagtctccttattatatacagaagattaatggtgcagtcgataacagtagtgaagtcctagcgctgttttccctaagcaagcatgttcaattgtcagagctgaagagccagcctggacccgcgtatttggacacactgaataccctgaaaaaaatgctaagcgagtcagaaaaggcggcccaggcctctctgaatgccctgaacgatcccatagcggtggagcaggccctgcaggagaaaaaggtaagctgtccttgggagcttggccatttctgagagttcctgttatgtatttgaagtggtttttcagtgattaaaaaaaatgaccatttttgatgaagtcttttaagattgttaaaaatttgttacaaaaattgcagagtaaatgtaatttattttattttttgtttattatttattattagtattattgtagaggtgggtgtgtgctgagtcagaggtgggtgtgtgctgagtcctgaggacgactttggcaacttggttttctcttccactgtgaattccagggggagcgttcattcaatcttaagtcttgtgtggctgccatcttcatctgtggagtcaatctgcaggcctaagaatttataattttaaacttaattaccttaaataatttatttgaggtccagaaagatattaagtgttactgggaaacatttacttttttaaatcatttaaataaaattctaaacctgttcctaatctgctagatatatctcctaaaataatgtgaggtgtattaggtgacctgatttctttctttctttttcctctttctctttctttttttcctctctctctttttttcttttcttttcttttcttttcttttcttttcttttcttttcttttttttcttttttttttttttttgagacaagagttttactctgtaatacacactggctgagaattgagtgcagtcttcctgcctcagcctcccacattctgggagccacttaaattatattgactaaaccactctcctgcgtccagtggcctgaaggctcaatgccaatgtttctccactgtgaccctgtaacacagttcctcatgatgtggtgacctccaaccatcgtattattttcaatgctacctcataactccaattttgctactggaatgaatcataatgtaaatcttcgatatgcaaaatatatgatatgcaggccctgtgaaagggttgttagacccctccaaaggagtctcgcccctcagattgagaaacactgttctatactacggtacctgatagaaaagaccaactgccgaccttgggctcttgttctacactgtgtgtgctgttacagggtttaatgtacagaatccatgatgccacacctacttatgagaaaagaaagatttttatttttaagtaagataccctcttctccatatatatgtatatatatgttactacatctgtgctaatacatatgtacattgttgtggatggttttaatctcttgacactttcgtaggcccttgatgaaacccttgagaatcagaaacatacgttacataagctttcagaagaaacgaagactttggagaaaaatatgcttcctgatgtggggaaaatgtataaacaagaatttgatgatgtccaaggcagatggaataaagtaaagaccaaggtttccagagacttacacttgctcgaggaaatcacccccagactccgagattttgaggtaaatcgagaggccaatcgataggagtttaggcttgtttcagggcacacagcgataatcatgcaagactgggatatctgctttctgagttctttgctttcttccttgtcccacgtttgttatatgcttaagttgggattcataatttgcttatcagagatattttaatgtgctggcaagcacatgtatttcttttgccttatagagagaaggcttcttggtagaggtgtacaagaccttgttgaggatgtagcttagtagcggttaagatagactttcatctggggatctgcatggccctatgaaccagtgctcaaagtacagcggtgactagttagagtggagcaggttaacctagttggaggcagagaatggagtcggggacacaggggcaggctctcacatgtcctaggctggccttaaaccatgctatctagtcaaggatagccttgaacttctgacccttcagtcacctcaagtgctgagagtgcaggtgtgtgtgccactgtgcctgccttttttttttttttttttttttttgagacagggtttttctgtgcagccctggctgtcctggaactcactttgtagaccaggctggcctcgaactcaggaatctgcctgcctctgcctcccaagtactgggatcaaaggtgtgcaccaccaccgcctgtgcctgccttttaaacctgtggcagaggttaacttcagggtcttatcatgctaagtaggcactctgccacacagcttcgagtgttccaactacaagtgagaggcttttacaaccttctgctgcattcacagaacatacatattacaatggtatgaatgagagttatacttgtctgtgattgtaacattttttgatgatggtcacattgacctatcagtgattctcaaccagcagtgtttttgattttcccctcaccctaagatatgtgttagtctagagacatctttggttgtcactgacatggcaataggggtgaggtagagcagtgacaaacagaggcttagtagccagggatgtagctagctgttttatggcacccaggttggccctcatagaggcagaactgtttagtcccaaatgtcagagttcaaggttgacccatgctgtgtgaactgattttatattttcaaatttaaatttagttaggggaattcatgagtgactcctgaaaagtttattttcgggtgggttagatgtatgtgttttagctgctttcctgatgctgggataaactattctgactaaagaatctcggggtgggaggtgtttacacttcatgatcacggcctgttgctatggggagtcagggaaggaactgaagtaggagccgtggaggaacttgctgcttgctggcttgctctcagacctatgcttgcctatcttttttatacagtcctagatcatctgcctcgagaatggtgccatccacatgtctgggtcctctcacgtctaagtcaattagttaacaagcaagagtgttccccacagacaggcccataggtcaatttgatctgggcagtccctcagttgagactcattgactcttggctgagacaagttgacattttaaaattaaatgggatggtgtgccagtatttgaatatggcacctttagtggccagtttgatacacacacacacacacacacacacacacaaacacacacacatacacacacaccatacacacacatacacacacaaacacacacatatccatcaaacacgtggatctctattcaactatttggtattacagtagcagactttaacatcttgttattttctgtttttctttggtgggtcatcagcaaggttggtgatagtatttgtatttattttttaattgtgtaacttcatgcatgtaacacatgtaagtttttgtttttgtttttcgagacagggtttctctgtgtagctctggctgtcctggaactcactttgtagaccaggctagagtcgaactcagaaatccgactgcctctgcctcccaagtgctgggattaaaggcatgcaccaccaacacccggcgtaacacatgtatgacttcaatgctaaaggccacgcttgctctcttgtttcaaacgaattgcttgttaattcactactcagaattcatgtgggaaaacttcaaagtttcttcataaagttacaagataattgtagtaaacactcactcacaggataacttttttctttttccagtgtcctgatgcatgttttagtttttaagctctattctttaaagccgtgagcacagtgggtattagattcactgccaatttatggagtttctttgggataaggtagtggaattgtttgcttaatttaattaaatcaattagttgattacttgagactgggcgtcattatgtagatgaactccccttgaggatctcgctggtctctagcaaacagagatccacctacttctgcttccaaagtgctgggattaaaggtgcacaggcacctactgagcctggtggaaatcagaagctgctgattttaaaatgcgtttttaatcctatatgtgatgcatgaagactgctattgtgcagatactgaataatataggaatactcattgccaacagtattcttagtcccagttctatgtcccgtcctggcaggcttgtattcacagtgaatgtttgcagaatttccatgtacatacagtccgcacatactactaattccaatctggggtgttttgtttgtttgtttgtttgtttgtttgtttgtttgtttgttttttctgtactatagaatacactactgtagatcctgatgagggattgttaagataaaaggaaagtccatttccccaggttccaaaaggcagaatggacaggtggctatctgtggcgtctgttagcatacctaagcacaggcaggcctttgggctccctcagcatcagaagtaccagctacacatttcaaagtccatgctagcatcttggtgtctcccacttcctttcttactgtgactccctctagctaagaggcttcctttccaccagctacacattctgtttgtttgtttgtttatttatttaaattaattattttatctatttacatcccaaatgttccccctccccctcccagagttcttactcccattccccttccccttcttgtctaagaggttgcctcccacccctgcagacccccttcccaggggcatcaagtctctgcaggatcaggtgcaccttctcccactgaggccagacaaggcagtcctctgctacatacatgccgcaggcctggaccagcctgtgcttgctctttggttggtggctcagtctctaggagctccctgggattcaggttgacacattctctttataacccaaccatttcagctacacttattcttttgcccactccctatcttctgtgttaacctacccgccccacccccacccccttgtgcttctgtttctctcatggccatgttcagtctgctggccatgtttagtcaactactgtctctctcctctctctgctctggactcttccagatacttctggctgtgtgttctctctctctctctccctctccccctccctccctctccctctccccctccctccctccctccctccctccctccctctccccctccctccctcccttcctcttcccctccctctctctctccctcttatctcataaacaccattcccttatgcatactaagaagcagtcatgttgtcagtttatatgtgtggtgctgaaatctgggaggagcacagttggacctctttccaaaccacactgttgatttaactctggtaagatatggatcatttatttctgctggcttctgcctcccaccatattcaactctgaattccaggttctacctcctgggctgctgcttttctccagctgcttcactccccaggtgccctcggctccctcctaaagattattggaatcctccctctgacagagttcctgtttgtgacactttcccctccttttctaatctttccctcctcagcctcagagacattccattctgtcttgctgcaaatggtctcagtccaactcagttaatggccaaagatggcgcattagatttccaaattctcacagaccgtagcaagttctctcacttcacgaacaaatgctccccaaatctcttaactctaaactctctgtgctctatataaaccttcccttaaccatccatggagtggtcataccatcagtttatacggacatttcaatacctaatagagtgcaaagcttagaaagtgactcctcctgctcagaatgaagtctttcaagagtctatagcacttttagaagctgagttaatcgtggtggtgcttagcttccatcctccagccctgggatatttgcaagaagagtccccaggtttgtgtctgtggtcatagttgcctcttagtttcttggcatttgttgacatttccgttgtctttacagctaattccttttgtacaggctaaggttagactagcccgctattgtctcccacagtgctaggcacaaacatggacttaaagtctgttctgtgctttgcttcacaatccatcacctcccttcctggtagcaagacatttgaaaaacatgaaacaggcatttttttcttattgctttcggttatgaatcatgagtacaaaataaaatccaaagaggccccttcttctctgattctttctctcacacaggcagtaatatcttcggttattatggactgtgatatgttttatattatttcctttcccctactcaagatcctacagtgtgggaatacctggaacattaccagcatgtctgcaagtgcccactaaacctagttttgcctcttggctctgccctccactttataacagttccaactcccgattcccagcagttaccttggaaattcatcttcccactgaagcaagggatggtctggttatcgtcatcagagtaaaatgttcacactttatcacacagtccctgccctttcttcttctagcttgcctattgtccccactgtgagtggcatcaagttgggagagaatcatgggtcccaaaggactaccctggactgtattgccttcctgtggacatgacacacctacttgttggaatattatgtttccctggctgatttattttttaatgtgtacagtagtttttttttaaagctttattattttatttattgtatatgagtgctcaaatgccattacaaatggcaaccaccatgtggttgctgggagagcaactatgctcctaaccactgagctacctcttcagccccacccactacccccacccaggctgagtctctaagaacaaacttcatggccagtcaccagtcttgctcagcaccaaagtacagcctgaaccttcctcaccttttcatgctcccatccacaccctgtggagttttatcaacttagagctctgtgtttctcctcccctcccagggtatgagctctttgaagatagaactctgcggggtgcccagcaagtaagagggggtgaatggcagtgatcagaatgactcactcagtaggtgtgactctatcaggtagccttccccctctctagtgagcagtctcagacccacttatcctcaaagatcacacagccctctgcttgttctcttccttcagttgctcaaagtcaaggacactcaccaaaccaaggtgttctgccccaggatgctgaaaagacatgtggggacggggccattgaagacacaggatttgaaattattttggaagtatttcagggtcaagataaggaagacgaacatcccgtatttagctactttagtctttctagagaatacaagcctgatatagtaattaaaatactgtcccctccccccatcatttttactcattacaggaaacaatgggccattccacaccttggatttagtgacacaggtttagatgtgttgatgtggtggcaatgttattcttggccttcctctctgtgacagaacaccgtttttataacagtcttttgagtagggttatggtatccttgaaaccccaggtagtgtctgttacaggctccagaatgtcaccaaactgagcaaattaggaagctctttacattaaattcctatgccaactctattttcaaagctggtttgtccctgtcccaggcagaaattagcagcttgaggatccacatacattccagctgatgggggagcaggaaagcaaaaatgccagctatgtggctgtagtccagaatgaggggctgcagtgcaccctcgagtctcaggctctcctgtccagagcttccaagctttcaaatgcttctatctccagctcaggaggcgggcagggtaaggtgcaaagggattgtttcattgaccctacatttctcctctgtgacctgcccctgggtgttgcccgctcaagaagttttctggagggatggatggtcaaggtttttaaacattttccacattccaaaggagaatctttggtattttaaggtcctctaaataaccatgttattagcaatttcatcgtacttgaatatttatgagtaaaaatgagaatgagaaatgattactgtcttagatgaggaccgattaattttttttgcagacatttttattagaaatttactggcaatggtgtgtgtgtatgtgtcagagagacagagacgggtagacagggacagacacatacagacacagacacagaaagacagatagacagagaagatgtgtgtgcttatgagaatatgtgtggaggccagaggccagatgactgtatttgcactgttttttaaaacaaggtctctgggacctggggctcccaggttaggctacattgactggccagtgaaccccgggaatctcctagcttcccaggaattgtaccttttaccagcatgtcggttctgcatgtcagtctcaggtccccatgcatgccaggaaagcagtttactgactgagccacctcccgagcttctcctgggaactttaaaccagtttatttagcagaagagaagttccttaaagaactttgtgcgcgtacatgtgtgtgtattcttgtgtttgttcagcaagttggatagaggcaaagaaaccattgctgttgtagactgtagactcctaagcgctttaaagatttatttattttatgtatatgagtacgctgtagctattttcagatgcaccagaagaggacatcagatcccattacagatggttgtgagccatcatgtggttgctgggatttgaactcaggacctctagaagagcagtcagggctctaaatggctgagccagctctccagtcccccctaagctctttagtggtgtggtttttaaatggctagagagattctcttgtttttgtgaattctttcatgttctttgggacttagctgaggaactaatgtgagagccagagtttgtaagttttagtgactgtacataagagatccatgaagccccttgtccagggacagatggagaaatgctggagactgatttttctataagataacaagccacatgttctgacttcccttaacaaatttgttccacctgactgcaccagatgtgtttgatcactcagaggcaggcaggagggaccctggcaggaagtgcaccagcgtgtatgcttacctctgattggatctggtgagaaatatgcagccttgtaggtttgcttggaaagttgtagtggaatgtgactccatgtccgatgatccctggaatggacctgaccagagtccttcatcctggccagtatttctttaacgcttgcttcgaatttggttgaaaactgttctagtggtcttagtcttgtaccgtgcattaccactgactacagatgagctggctcgtggtatcgaccggcagtttctgctacaggaacatgagacgattttccttccagggaaaaatagatagtctggggagtgtgaaagaggagcgtggagctgggtctctgcaccctctgcaggctggtggtggctggtcttcagtagtgaccccttgcttcatagtgtggctacagggcggtgtgtctactaaatctgcccctgcaaggcattttcaaagtttggactggttcccgtttccttgactttttttctgctgagctctttaactatgcccatcagatatagcacgattgagctttcagctggccattttccagggactttaaaatagttataggactgaacaaatgttaatgctgacagcaataaaaaaggacaacaacaacaaaacaacaaccaactacctgatttttagcaaacacaacttcactgtggcattcctgggcatctctgacaagatctaagttctaggatttggaagcattggctctctaacgaggtcctcattgttaatagtgaggcagatgctttcgtgggtgctaagtgtatgttgcatgcattcgtgtggcgatctctgtcccaacactgtctgtgatttttcagaacaattaaacacagttgttattgttgttattctggttttacaggtgagcaactgaggtgccaaaacagaattagtttcttacagccatgctgttagctggtgagctcggcgtctccccatcatagggtacagggattatatgtcagattttctgtagtgagaagcagaatgcctgtttgttgctccgtctctgatatttctgtggcttgtgtgtgtgtgtgtctgctacattctcctttcttttttttttcctcagtgaaactgagagcaagaaggaacgggtgttcctgggctgtgtgccctcaccggtgtctggggttgtctgaggcgaggaagaggtgactgagcccctaaaacttcctctcattccccagtgatgggttaaagctgtctattttagtcagaggtgactgtgactattagccctcttggggtatgaggcacctctatgtgttactgaaaaatcttagctgtgaaactgttttcctctttcaaaattagctttgatggatttcctagttcctcagaaatactatgttatttaggagttcagaatggagattaacaatgcaatggggtaagcaggcaattttaaaaggcttgtttcatggaacaagattttatttttagtgatttatttttaaatcttatgtgcctatctgtgaacttgtacatctgtacttgtaacatgggcatgcggtacctatggggaccagaagagggcgctagatcttctggagttggaattcaagacagttatgcattgtcttgggggtgctgagaacagaaccctgcttctctgtaagagtagtgactgttcctgtctgctggggtatccctccagccccacttctatttttattagcatttattaattataaacaatgggcgccatgatttcacttacaaatcctaacactcaaaagcaagaaacccaattgaaaccaaccaaccaaccaagcggacccaaaccatgtacccaatagaaaattgtgtttctatgtccactttccaagtagaggaaagttaggaagagaagttggtaggaaagtggaaaggttaaaagttctaattattctgttggcttgttgctgatctattttttaaacttctgttgtcagcataataaaacaaaatttggtatttataatgatcaagttctatagctattctatccatgttaagcaatgtttggtaggggaagcttattttgaggtaaatactgagaacactggggttttagtcttcatgttgctcctgatatatttaagaacaaacaagtttaacccaaaagaatcattggacaaattcacgataagaaaaacctaaaatggttttaggtggtattttataggtataacctattttatagatgtaacttgccatagttgtatgtctttacgattcattccagcttcataagaatattaatagttggttttgtttggtatattataggaatataaaatattttttgttgtctccagagtacatggatcagaatggtttgtgcattacccggctatattgccctgtaaatgtcacaaaagaaggaatatttagccttcccaggactagggagacacatggtggtcactttcgaattaaccattcaggtttatttctatttctaggcgtgatcaagagtagaactgaaggggactcggagaaacattaggggaattagcaaggcagactaaccaatgaagggacaggaggctttggggaaaatagccaatgctttagtactgaagtttaagtgtggctgcagttgacttctctacagctattcctttgcgatctcctctctcaagcctactttctagaaaacgtttgccttctctttgtacttattaactttgagtggttagaagaactgaaataaaccagacagtggctagttctgttttcagagaaggaggtatcccatggaagattggagagtcctgtgtcatgttccttcatgatgctgtgtgcttactcctagttccagtaacttccgagaaaaaattgctctaagttagttgaaagcaaaagatttttgtttatgctttgactatgactagagtagcattttttttcctgtaatttgaatcttagtcctaaatattgcttgcatttagatacaatagtttattccagagtggcttgagactggtggatgaccaccgcagtgtcatttttggaaacatttccttgaggataaactaaagactttattttccaagttgggagacttcaaagaggaaatgaaacaaatgaaaacgatgttattgagttttgagaagttgtctctttctttggtcccagtagatcttgagatgtcctggggttgtatgtcactgagtaatatgcccctctgttattgtgttcaatttaggctgattcagaagtcattgagaagtgggtgagtggcatcaaagacttcctcatgaaagaacaggctgctcaaggagacgctgctgcgctgcagagccagcttgaccaatgtgctgtgagtgcctccgctctggcaatcctactggaataaataacattctcttctcgctctttgtcacttgccattattaaaattgtaagaatagggcttatgaagtctagataaagagtcttttattgtaaagcttttatttttacttcgtagctaataaaggacagacagattgctcatattatactgccgtctgtggttataggattcgtgatgagaacaagagcaaatttatttctttggaagctgttttcttctgttaagattgtgatcttaatgtaatgattatcacaagcatgctgctgccattgtagcacatgacgaacctttctgagcagcatatctagcaaatgaaatgtgctagcaacacaatttatacttgagactcaccaggtctctctagagcagtggttctcagccttccgaatgctgtggcctttaatacagtccctcagagtgtggcaaacaccaaccataaagttattttcattgctacttcatgactgtaattctgctactgttatgaatcataatgtaaatatctggtatgcaggctgtctgatatgtgaccctccccccacccccaaaggcctacaggttgagaaccgctactctaagttaattaaaagtcatacttcccactgagattcaagtaattctaatttaatttttagcgggcgactgtattaaatgctaggcaaaatgagtttcttgaagtgagtcatctcttaagtagctgagaatcctgaataccagtcactatgtccttgaaatatttgcaggatccaggtagataggtgtgatactgatgtccacttacatgggagtacacttaacatggacttatctcctgtattcagacgtttgctaatgaaatcgaaaccatcgagtcatctctgaagaacatgagggaagtagagactagccttcagaggtgtccagtcactggagtcaagacatgggtacaggcaagactagtggattaccaatcccaactggagaaattcagcaaagaggtgagcttggcaccttctttaggaaggggacacactgtcactggcttctcttgaccacaaaatcaaaaccaaaaaatagtgctctacaatttttacaggacagcataaaacacacttaaagcacacatgcacagacacatgcatatatatatatatatatatatatatatatatatatgtatatatatatatatatatatatatatatatatatatgtgtctgtgtgtatatatatacatgtatatacatatacatacatatatctgtgtgtgatgtacacacatacaaacaatattctttcatagttttaagatagatattaaatatatattaaagacatatataaagatacatatatcttatatataatatatttacttattttatttatttatatactacatatacatataatatataaagatatataaagatatattaggtatataaaatatgtatattaatattaagtatataagatatattaaatatcttaaattaaaatatattgtatgaattatatatatttattatattagtatattgtataaattatatatgtgtgtatatatacaaagacatatatatatatgtatatatatgtgtgtgtgtatatatatataaaaattaaggaagactactgcttgcttagtgagactcaggactgtcctattctttctgttttcaactgagttccacacattcatttatgacacttgccttgccttgaggacatttcagtgtggtatctactgattatagctattaatcctttaagcagcacatatttattaattaggcataattaataaatatagtgtagtattttcttaattagtgtctgttgctaggcttctttgtatgctctgggacacagaaatgaccagaggaaaagtttttgcattcctatgaggcaggtgagctgtcagggaggggcagccaagaattaagagaaggtagagttcttggcaatcgtttagtcagggagttgctcacattgggacattgcagaggtctgagagttggtgactcttggctggagagaccatgtttgtggtcaggatagcacgtgtgagctgtatcccttgggaacagagacaggccttgggtggaggacaatgtcagatggaaaactgatgctctgggtggctccagagattggcaaacggtgtgtgcgttcgtgcgtgtgttctgtgtggattgtggtgctctctgagtgataagaacccaggagcagaagcttcctagcagcaggtaactggatgagacctgttctggaaggatggaggtggaggtaactctgtgcatgcaaaggctgcttcttatttttcctctttttaaaattttagcttttaaaattcttagtgcccttggggcatgggaagcagaagatagtaagagaggtgaataaagctagaggcatgagtcaggttatctgagttaaaaatcaagctttaactttaactcaggagcgacttcggatgaccccaagaaaagtgcatcccctggcgaggtggggaaggaagtgacaatggacagtgggggagggaatgggaaggaaccctatggtggcatgattgaatgttttgttcttgttttagcccaacatcttcattttgaacatattttatgaggagaaaaatcatactaatcctacagagaaacacccatggacctattccaagatttatcagtagctagttttgtattatattttctatgtatctctgaaaatatgcttcatacaggaacttgaaattattgtcatatattataatataggcatttgtcaagatgccatgatccaactcaagaaaataatctttttttgtaatatcactgaatacactatccaagtttgtatttctgtatctgctttataatctgacagtgtaagcagctggggattttatctaaggaaataaaggacaagcttcctaagtgacattgaggaataagcaaccatgtagcatccattcgtctacttatcccctgtctcctgtatccatgcatttatccatctgtccttcatcctccatcatcttcatccatccattgtctaccattaccatctcctatctgtcacatccatccatccatccatccatccatccatccatccatccatccatctactcaagttcatctgttcacccacttgctcataacaatataaaatctacggtacagaaagtatttagatcagttctagacggtttatctcactcactagtaaaatttaaaaagttgtatagtgtgtgtgtatgtatacacacacacacacacacatatatatatacacacaaatgtacttaggaaacataggtctatctggggctggagagatgggttagcagtttagagcccttcagctcttgctgaagacccaggttccatttccagcacccacattggcaacatacaacagtctggaactccatttccaggtgaccttgatttgcccgcttctggcctttgtggttaggtgaggagctctgaaaatattcccagactcctctgaagtacttcacaaagttacacagtctgtacacagactgtgtacaggcaaaatatccctacacacaaaataaaaataagtaaacacaggccatgtcaaactaaaatgtacagaaatgtgtctcatgtatgctaccatgacagaatttaacactgtcctaaaataccaagtctatagttatgatcttgtggattttattttcaacttttctatggatccactaaaatgataatatttattgttgttcaggaaatgtaaaccaagagtctacatttatgtgactacattgcattttacccccccccacacacacacacactatgccatagttttatcaagagctgcttaaagtgttgagcaagggagaggagcactgtgtgctattgtggcttctcctagaagagtcacaccctagcttgcggggtgggcatggaaagaaaagttccttgtctatttttaggcctgtgctcctgtttggagggagggaacaggaaagccactaaccattccttaacccacattcctgtgagcccatcctgttcctggcctggcctccggtttctgtcagctctggcctccactcagacatgtaatttgagcaggctactggacgtgtcaggggaaggttggacgattcctgtgtgacacgatcatctctttcagccgaagtgcatttgtggttaggtgaggagctctgaaaatattcccagactcctctgaagtacttcataaagttactgagccagattcagacagatagctattttcaaatatatgttctacttcctcctcctcctcctcctcctcctcctcctcctcctccttcttcttcttctctccttctctccttctcctccccctcctttttcttttacaaaacactttacttatgtgccttggtgttttgtctgtctgtatgtctgtgtatgtagagtgttggattttcttgaacttgaactggagttacagttacagaggagttgtgagccatcatgtggggactgggaattgaacctgcatcctcgggaagagcagcaagtgctcttaaccactgagccatctctccaacgtctatcttctactttctgtttttttttttttaagatttatgtatgtgagtacactgtaactgtacagatggttgtgagccaccatgtggttgttgggatttgaactcaggtccttcggaagagcagtcagtgctcttaaccactgagccatctctccagtcctaccttctactttctaaccaacattttatagggtaatgccttgtggacatcttttgtaatagttcttttcatcctcagttttttccccttatttttaagaacatttttttgagaacaggtcttcttctgtagagcaggctagccctggatttacagagacacacctgcttctgccttccaagggctgatattacaagaatgtgtgactgtgcccaactccaggctcagtttagaatgtgaggccacaccatgggaattctgcttcctgttttattttttatataatagacagtgttacaattaaattacttgatgttcatacctttatcgctataggtgaagctccttaatgtggaattaaaaggtcagaaacctagttagtttctgctgcttacctttcacagtgttgggagtacagtgcaggctgccagggagaaaaaacaccagctgtgaaccctattttcagagttatattagatatcttctagttaggttcatgtctaaaatgttgtatagaagtcattatattttcatcctttcttacattacacagcaccagcacaggatgctttaaaagttttatttaaatgttaaaaaataagactggaaatctattgcagtgcctttaaatattaaagggtagaacttggcatttaacgtattaaaatttatttattgagtggaattggcgtttccttcctagattgctattcaaaaaagcaggctgtcagatagtcaagaaaaagccctgaacttgaaaaaggatttggctgagatgcaggagtggatggcacaggctgaagaggactacctggagagggacttcgagtacaaatctccagaagaactcgagagtgcggtggaggaaatgaaggtaaggccttcctcccgactgccctcttcacactagttagtctgttggtctttcacctatcacactgcacagaaccctatggacaagtctgctctcagtaggagtgagtgatgagcagctgtggtaatcttagttgggaaagaggctgatgccagtccactggttcaagtccaccccagagtagatcgattctgggaagtccctgtggatagtcatggaggtttctgtctcgaagaagggttgtgaggagaaactcatttttcttttattattgcaataaacacatataatataaattttttttttacccttttagcagtttcttggtgtatattttatggtgttaattctagtcatggtaccgtgtgacttctatcactgtttccaggaagtgtaagttttggtaaggagcaaaggagacttggaggttattctagttctaatgggtttcattctagtcattcgtgggggcccagggaaccccagaatgtctttggagcaggaggcaaaggctacattcaagtcagtattgggagtacatgggaaccccagaacatcccaggagcaggaggtaggagatatagagtcagtaatgagggcacataggaaccccacaatgtccttgagcagaaatcttggcgtatacagagaagataaggtgaagataagttggagttacaagctgtggttccagaaacatctattcctgtgtcagtagttgtccttgtataaggaaagaactgggcctcagacccacatttgcctccactatccttctagcatgagggcgtgattctgtctttaagagtcatccttcttgtcaggtggtggtggtggtggggatacagctttaaccccagtacttcagaggcaggggcagaggggcagaggggcagaggggcagaggggcagaggggcagaggggcagaggggcagaggggcagaggtaggtggatctctgtgtttgaggctagtcagtctacagagcaagtttcagagcagccagggctacacggagaaatcctgtccttaaaaaaaaaattaaaaaaaaaaagtacacttctctttgtaaaagatcaagtaacatggtatattgttaactagtagttatactaccaattaagttggttaactcaactagtagtataactaaggcaaacttttctgtgcaggtagtttttaaaaagattctatgtgacattcatgcatgctatcttgagtcagtagatatgaaaagagacttatttaatctgtgtcggggatcaatatatatataattttcttttttctaaaattttttttattaggtattttcctcatttacatttccaatgctatcccaaaagtcccccataccctcctccctcactcccctacccacccactcccacctcccggccctggcggtcccctgcactgaggtacataaagtttgcacgaccaatgggcctctctttccactgatggccggctaggccatcttctgctatatatgcagctagagacactagcttcgggggtactggtcatgtagctctttttgaaaagttttaaaactatttttagtactgaaaatatttaaaagtagattactatgtaaagaatggctaactcatttatcactcacacttttggagctgcagtttgctgctgattttaaaagtcattgtagttgacagtgaagaaaaatgagattacaatccctgattgggcaacactctatttatttttattctttaaaacagccattaggaatttaaaagccactacacttaattactttttccctcaccctgggagagctgaaatccattaagcaataaagcaagctaaaggggggagtgaaagacggctgcaggtaggttttcctgcatgtgagactgagcaccttgggcaccgagagaaagccaggaagcagctatttctggatcaggttgtccagaggagcttcttcatcttcattattggaaggatggatggacccatggtcaaggaggaaaatgtttttacaaggatttgtgggccattttaatagatgcctctgccacagtgtcctgccattttggggggtgtttatttatttcaatttaatgtgttcagacctccagtggtcatttaaaatgagttcatttagattcctaccctgagtccagaatttaaaaatatatcttgccagtagacactatttaggataacttgcctctaaactctggtggtattaaaaagaaactgttgtgggctcggggaattggaaactagaagagtaagtgagattttatttttagcattcttctttcaaaaaactcaggttacagaattttttaaatagtgttctactgaggcatatagaatcatttagttgttttgatattggattaatcattattattattttttaaagaaagatattagtcacagagagccatgtttcaaattgctcctttcttgggacagagggcaaaagaggaggtgctgcagaaggaggtgagggtgaaaattctgaaggacagcatcaagctggtggctgccaaggtgccctctggtggccaggagttgacgtcggaattcaacgaggtgctggagagctaccagcttctgtgcaatagaattcgagggaagtgccacacactggaggtaagagcttgtttgccccagggctaccatcctgagatcccagctctgctgtgtggatttccctgtcttatttaaaaaaaagaagaagaagaagaaagaaagcgccattactttgtcaaacattggattataaaagtaatttttatggaccaagtagataaaaaaatagagagatttttgtttgttttgtgttaaaaggagaccaagatctgcctgcatttctcaggaggttcaatggtgataattgatccccgcaggtttgtgtgctcactagtgttctcaggttaccataagaatccagacagctctcttttacctggctgactgttattttatttttattttgagtcgtgtctaatatttactggaggggaaaaagaatttcagtatgtagagatttcattgcatttttaggtggagaatctcactgcctatcagactgaagacctagattattctgtgggattattttaataaagtgctttctcatcttcatggttaaaaaaaaactggtcaaaagtcttaagaagcgttttgagttattcaaatttaaatgaaacacaccctacaataagcaattacattctggtgagttctgataatgccgagggaagatttaaactgagtttactcattgtacttcttgtaagatctgagcagatttttcggcctgcttcttgtaagattaatgggagaaggggactagaaatctctttcttcttttgctctgaaccaagagtcaacaaattatggtagaggcctcaggtataaattgtgtagtttgagctaggcaatggtgttctatgcctttaatcccagcaccctgaagggagaagcatctctgagcccaaggccagcctggcctacacctgaggtctggaacagccagggccacatagagaaaccctgccctgaaaaaaaaagttggttttttttggggggggggtaggtttggttaagagtggtatttctaaaggattgaacatggtgtaaacacctatacaccaaagatgaagctgtgacaaactatggatgtcacccctaaagtctgaaataccttctctgtgcctctcgagaaataccggctgagccctgttctggcgagcagagctgatgtggggaatggatgggactgtgccctaccttggtagagaagacagatgcaggggattttgtgcagagctctaatcttagcagtcagataagatcctctcttgttctggagcaaggggatagaaggctctaaatgcatgccttcctcggcttctctcctacttcggaactctgagtagggagaacacaggactacctggctcctgttttggtaaaatgggcccatcctcttatgtgtctatctttactcacttggaaagaagtccagatggctacagagacatctgctcccatcagtcatctaggaactggaattggatatgtcctaggagatttaagtttctataaaaaaatatcctgaatggtttttaccttttgctctttctgggggtgttgctgttgttgttgttgttggtggtgttgttgttgttgttgttgttgttgttgttggtgttggtgttggtgttgttggtgttgttgttgttgttgttggtgttggtagtggtggtggtggtggtgttgttggtgttggtgttgttgttgttgttggtggtggtggtgttggtgttgttgttgttgttgttgttgttggtggtggtggtgttggtagtggtggtggtgttggtggtggtggtggtggtgttggtggtgttggtagtggtggtggtggtggtggtggtgttgttgttggtgttggtgttggtgttggtgttggtgttggtgttggtgttggtggtgttggtggtggtggtggtggtggtactggggattggacttagggcctttgtcaggcaagtacaggttgtagccactgagctaaatctccggctctaacattttctttaaaacaaacaaacaaacaaacaaacaaacagaaaatgtatttctctgctgtttttttcccctattaattattcaggtttgtttttttttttaacatttagccaggtccttggaactcattttactgaaaaccgaggcagcttcttttccatttttccttctccttccatcttaattgctcctattttattgaagatttagttttgcctcatttatttgatattctagcttcgctggtttctggattcctgtatattactcactgaaatggagttcttattgatcgaagggatgacgtatggttatggcttctcttccgtgttaattttcccttcacatttgttaggaggtctggtcttgctgggtggagctgcttcactatctggacctggagaccacgtggttgaacaccttggaggagcgcgtgaggagcacggaggccctgcctgagagggcagaagctgttcatgaagctctggaggttggcacctgatgtctgagccacagttattttcactgtgaatgggaaagatgtctgtctgtctgtctgtctgtctgtctgtctgtctatccatccatccgtgcatacaataggatgtgtgttgaggtcagagcacaatttgtaaaagttattttcccccttgcaacatagatcccagggatcaaatccaggtcgttagggtttgtggcaagctccttttgacccactgagccatctcaccggcccctgggaactctttataatcagttttgtaaggcaggagctacatgagtgcatgttagacacagcgatagtcactagtagggtccagttcttttcaccattctctgaacaaaccctgttttgtttctttgcacttatgactatggcatgaaccatgcttcaggtggcttcttcatcattctcagatgtaaaaagttaaagcaggctgctatgtgcattcgtgaaggcaggggctcccacagtggggctggatgacaaggctgggcttcaggctcctggggccaagaaatatcccgaaggcttcctcgttctgtagtttcgagcccaggagtacacacgatactgtggtaattacttcagaaacgaattacagtgtaaccaaagaggtttcacttgtacaggagtagtagggaaatttggggatccgatgaacagcagaatgggaagtcagagagctattcccagggggtgggggtgaatggggctccattcctgaagatggatgccgtgcagggagagaattgtcacttctcaaacacagcagagtagaggatgcatagacagcatggaaaccactacatgcccattgaacaaacagcaagcatgcttttctcatagggcataaatatacattctagaaatccagacaatggagaaaaggaaaagaaggctccatgataaacactttaatacattctgtgttctcttctcttctctcttctctctccctcactccctttctttctttcaggtttatttatatatatatgagtacactgttgctttcttcagacacaccagaagaaagcatcagatcccactacaggtggttgtgagccgccatgtggttgctgggatttgaactcaggacctttggaagagcagtcagtgctcttacccgctgagccatctctccagccccctgtattttttctttattatcagcattccttttgtgcatgtatactgcagggcagtaaatgcagtcaaagggctcctagtcctaagagcttcggaaagagtttggagccttaggatttttgtttgtttgtttgtgttttgtttttgtttttttttaattgactctcttttgtcaaattgaactttatggctttcagatttcccatctgtagaatgggagtagtatttcatgcataaggttagttggacttgtgtctataaaactgtatacatagaaatacttagtgtatttctgtatcataaggtagaaaaatggatctctaattttaccaatgtagttaataacatgagataattttatttgtagagtacagttttgtatgtcacactgagagtttctcataaaattaataattattcaaattattttatgcatatgttcttgaagtttttttttaaagttttgtgattttgttaatctatagtggataattttgtgaattagttatttccttaatatttgtcattacttgtttcttaaatagatttctagaaagtggaattaatattaatgcttaaaatggcattttgcagatcttgatccatttagacccattgaatgtattttttcccctgcccaactgcagtctcttgagtctgttttgcgccatccggcggataatcgcacccagattcgggaacttgggcagactctgattgatggtggaatcctggatgacataatcagcgagaagctggaggcttttaacagccgctacgaagagctgagtcacttggtgagaaccagacatgtgcagtgtgattaggtagttactgccacaagctaactctgagagctctctctcttactcggagcttccgtgctggttacacttggtaatgtataaattggtccccattagataatgctttggtgtggtgggagttaaagtaggcaggcaatgttaatgggagcataagggctttgaagtaagtatagaagaatagatctaatatttgtaggtcagatgcagcttgatcaaacaaacaaacaaaagacaaacaaacatccaaattgccaggacaaggcatggtggtatatgcctttaatccaaaaacttaagaggcagaggcaagaatatctctgagcttgaggctagaatactctgcatagggagtcttaagccaggtgaagctacatagtaaggtattgtttcaacaacccaatcccaagccaagccaaaccaagccaagccaaaaatgaaaccaaaccaaactttgtcagatactggatgtagcccagtggtaaagcacttttgttgtacacacaaggctatgtgttaagttcccagttaccttctatctccaacacctctttgagatttatttctatttgtgaattatgcagttttctgtaagaatagtattacagctatgtctaagaataataacgtctatatgtatgtcctaataacgattagggccttccgaatttgacattaactgttatgaaagctacatcactcggctgatgctcagattatatctcaacatgcatatccatatcagtgataagagaagggaccttgttcttttgtaagaaggttgagttgatcattagataactataccagattaccaagtaacaactgctgagattagactaaaaatatcattgagcttaatccaaagatgtgtggcaattagtggtttgactcacatgtgcactgttagaacttgttctcaattttagaaaaaaaaattaggtatttattcacttgatagacattcttactatgtcttattttttttgttaggcattggagattcttaaaattgctttatatttctagtaaaataaaaaaattagaaattacaaattttactaagtttaagacattttgtatatgtgagtgtctgcatagatgtttatgtcccatatatgcgtctcatggtcatgttgtccagaagcgggtatctgaccccctatagctggagcacagatagtcgtgagccaccctcactatctactagggcaacaagtacccttagccactgagccagtcgcctgaaatacacattttttttctattttatatgtcctatgggggaatctttttgtacttgtattttgtcatagtataggttaatagaagtaagaatgagagattcaggggctggagagatggctcagcagataaaagcactggatgctctccttgattcaattcccagcacccacatggtggctctcaactgtctttagctcctgtcccaggggatccgacaccctcacatagacatacaggtagtcaaattaccaatgtatttaaaatgaaaataaataaataattcttttaaaaatgagaggttcagctgctgtgtccatgagatactagaagaacatttgcactcttattatgatcgttattaattatttataagaagagctacagtcttgaaccagtactttattataatctgcatggccagaaggcacattcagctatttatatttgtgctgagcagttacaaaggaaatgtctcctctgtgcaggcggagagcaaacagatttctttggagaagcaactccaggtcctccgcgaaactgaccacatgcttcaggtgctgaaggagagcctgggggagctggacaaacagcttaccacatacctgacggacaggatcgatgccttccaactgccacaggaagctcaggtattgctgcaaagccgagagcctttgcgtcttgagaaagggcagctgtagcctggtcctcactgccagagtcaggaggactctgtatggaacagcctttgggtgggggctgttcttgttccttgtgtgagaacttgacacattttctccctaccattttatgcatatgggtgtctggcttacatgtgcatctgtgcactgtgctcgtgcctactgcctgtggatgccagaagacagcagtgaggcccctggaactggagttagactgttgtaaaccaccctgtggggactgggaaaggaacctagatcctttggaagagcagctggtgctcttaacagctgagccatctctccagctcctttcacacagttgatatgttagaaaatagatttcttcctttctctctttctctctttctctctttctctctttctctctttctctctttttctctttctctttctctctttctctctttctctctttctctctttctctctctctctctctctctctctctctctctctctttccttccttccttccttccttccttccttccttccttcctttgtagctatacagttcaggcagtttattctgtatacatcagatgtgaacattaataatgacaagcaaagaccttagcatgtgcatagcacacggtggtgtactgtgcaacagtttgttattatcatgtatcccacaagcttattagtgtgtattagatataggatcatatactatacaactaccttgaacttctgtattatatttcttcctgtacttggttgttgtataaagacatactgctgtattccaactgttgttatataaaagctcacatgttgtgtaaaggcatactgtaactcgtgcttgtctgggacttactatgcagccaagggtggccttaaactcagccatcctccagctgcagactccagaatgctaaggattacaagcatgggccattacccagggcttctttgtgtactttaaaaacacaccttctcccgttttttatcttcttggtagaagatccaagccgaaatctcagcccatgagctcaccctggaggagctgaggaagaatgtgcgctcccagcccccgacgtcccctgagggcagggccaccagaggaggaagtcagatggacatgctacaggtaaggactggcttccctttgctttttatatatggtgggtatagaaaagaaaagcagaaaggcttaaggacttcggtaccttcgctctgtgctatgattcaaacatgggatgggagcggagtattaaaggctcatggcaacaggaacaggttgttagctgggtaaggaaactatgagctttaagagttggctgagaagaggggatgagttcaggccagcagttgactttgtgtagaccattctctgatctcagaggctgatgtctgggcactcagggcctcagtaggtagagggaaatgagcttccactcttaatgtggtagaaggcatctgaggtctatgttcatgaaaaagtgagtaaatgaatggactttctcatccagagacaccatctgtctccagatgtagtttggagactgaaattctgagtactgctcactcatgacatcgagcagtggttctgaacctgtgggatgtgacccttttgggggtcgcatatcagatctcctctgtatcagataatatattatgattcatagcagtcactgaattagttatgaagtagcagtgaaatagttttatggttgggggcggggtcaccacaacgtgggaactgtgttaaagggaacattagaaaggctaagaactactgctttatatgaccgtcctaattcctctggggtttcctgggttggcctgtttttttttttttttgaaaagtctttcggcattatgtattatagtaatatctagttagagcgaaagtgagtggcttactcttatttctgcaaacagaggaaacttcgagaggtctccaccaaattccagcttttccagaagcccgcaaatttcgagcagcggatgctggactgcaagcgtgtgttggagggagtgaaggccgagcttcatgtcctcgatgtgagggatgtggaccctgacgtcattcaggcccacttggacaagtgcatggtgagcctgaggcccagcaggcagctcacatggccagagctgctctgatggtttagtatagagcatcccttcttattctttagttcagggtatggagatgatggagactgtgtcagaacaaaaagaactgtggctctcccagaaaaaaaaatagacagtataagagtaataggggagtatgaaagcaacaggtatgatctgtgcagataaaggaagcagattgcacataaataacatggatttaaaaagaaagaaatgtataaactacaacatgaagtgggaaagacctctctgaaggatgcaactgataaatgaaactttccacaataaatttgaagtacctctaatatttggaatattatagagtaaaaaaaatattttgctaggaaaatgacattcaagtcaaagtttaaacttcagatgggcagaaatgaatgacaaataagaccttactattccattgtttgtagttagtttaatagaggtttataaattttatttgttttttattttttaaacaagtgctctatctgcatgtatgcctgcatgccagaagatcccattacagatggttatgagccaccatgtggttgctgggaattgaactcagagcctctggaagagcagacagtgctcttaaccactgagccatctcgccagccctaatagagagttttaaatgatgttgtggggaggacctgaacttagccttattgtgcccggtgctcttctatctcctgggaggagatattggtaggactgtcttttccatggtttgtttcttatgtgggtggaatagtgcacaggtaggagacgtttgaatcacatgaaagtgttgtaagcatctgtttgctcattgggacagagtagcagatgtcactgtatttgacatcacagatactggctttgtatccttgaagtgttttgagttggatgctcatgtatggataagctgcctagacagagtttgggggttcacggtgacaagtacgaaggcaatttggaatttgacctgttgaactccaacttcatactcatatccattttgacactttaaagtattaagtgtatttcagaatataaattatactcattatggtacatttgtcttctctgaggaatagaaacaaataaatgttagggattccacattctttcgggcacagattgccagaggcaactgtcttccagtcaccggtgttaggattaaagaattcattcagtgccgtgagttgaaccaaggaccttgtgcatagtaaacccatgctttctcagtaaggagtctgccatccctacagtgtggttccacacagagacattccagtttgcatcctgtaactttccaaagtttttgaaggaaacatggttacagtgagcccttatccaggatttctactgacatttaatacgcacgtcttgttttatatttaaacacacgcaaactctattagtttattatctgatttgaagaagcattacaatcctgacttcacttaattcaaccttcaaaccatattcaagacagacagtgtgccctttcatatccgggatgaggtattatctgtccagccacagaagctgtgctctgaaatgatgccagtcgggaattttctgttaacaatggaaattttttttcctcttttttaaagaaactatataaaacgttgagtgaagtcaaacttgaagttgagactgtcatcaaaacagggaggcacattgtccagaagcagcagacggacaacccgaaaagcatggacgaacagcttacatctctgaaagtcctctacaatgacctgggcgcacaggtggggggcgcttctctctctctcctctctctatttatctgtcaccccctctcccaacatttatcaaatttaatctttacttgtacatcagtagtataatcgttattagttatataaatatttttagattacttaatacaggatgatatttatattttccatggccattggcataagttattctaaggaaactcaacaaggtaatagtttctgtataaactttggttttggatatctaaattcagtaggtatgttatcatgtcaggatctagtaaatacttggtggtaggtagtctaccgagactaaaagcgtccattgtatacttcaatgagtgagtgttaagagttggtaggcaggccattttctgttgctaaatcccatagaaaaactgtcctctgactttgagggtttgccctgaaatttagagtccaaagaatacgtgaaattagctagggagaggatatgatgagggaaaatgaggctactgagcaagtgttacggattagcaaaacaaactttaaaataagaagataacaggtgtgataggtgtatggcagggatgagctctgggaaaccaggagggtagtatttcaaagatgagttcagtcatggctctgtgaatattgtgttcacttaaaaatgccctttgcatctgttgccttggggttgttattgaatttagcaagggatgtgtgagaagtcaggcatagcaccacactctaagaagcagctttgatcatatggtaaaagtagacagtggatatttagggaagttggtgtgtgtgtgtatgtgtgtgacatgagagtgtttaaaatgtttacccagaaggaatggtcctataactaagagggaagggagaatatccaggtaagttggggtgtgtgtgtgagtgagtgagagagagagagagagagagagagagagagaagagaggagatgagagtgtttaaaatgtttaccaagaaggaatggttctatagctaaaagggaagggatgagcagtcaggtaaagccttacatcttcctatggtcccttgcagatgcccttagcccacattgatgaggttgagaaaaagtgtgcatccttataagttgagcttggatgcttttcttcctgatacagaaatctttgtgagcactaagtttggtggtacttgtggagctgctcgggcatgtcagtcagagaagcattctgtaattcaagtgtttactatttatttttttaaagatttatttatttactttatgcatatgagtacaccattgctctcttcaggcacaccagaagagggcatcagatcctattacagatggttttgagccaccatgtggttgctgggaattgaacacaggacctctggaagagcagtcggtgctcttaaccactaagccatctctccagccccaagtgtatactatttaaagtctgtgttctggtgctattttttttttgtttgtttgttttgttttgttggttttttttgtttttgtttttgtttttcgagacagggtttctctgtatagtggtggctgtcctggaacttactctgtagaccaggctgggttctggtgctattaattgagtgttatggattcagttgaaccacactgtgtctttctcattgtgtccttgacctccttgtttactctgtctcacagtgtccttggtccccttgtttatctttgactcgctcaccatgtctttgaccccctttttaggtgacagaagggaagcaagacctggaaagagcctcacagctgtccaggaagatgaagaaggaggctgccgtcctctctgaatggctctctgccacagaggcagaactagtgcagaaatccacatcagaaggcgtgattggtgacctggacacagaaatctcctgggctaaagtgagttttagttgggttggacatgtcccatcagtggcatttgctttggacaatctggctggacactgcctctatttcgtattaattgtaacctctgctcttctccctccctttctttccctcttctgtgatctgggaagaacattttgaatacaccttgtttcagaggtttctctctgtaacctgggctgccatgcattcattgaatatcacacgctggccgtaaatctgcagagtttctcttcattagcttctccagtgctagggtcaccatcatgtgcaactatgctcagttaaaaccaggcattttaacagtacttttgtgtgtgtatgtgtgtgtgtccgtgtatgcacaagtgtgtcagtgtgagtataaatgtgtgcatgtgtgtttgtgagtgagtgtgtatgaatgagtgtgagtgttcacatgtgtatttgtgagtgtgtgggagattcggtgtgagtgtatgtgaatttgtgtgtgtgtgtgtgtgtgtgtgtgtgtgtgtgtgtgtaggcctgtggttgatgtcatatgtccttctcagttgctttctctgggtcaaactctcattctgaacatgaaacttactgttttggctagacttgccagcaaactcctgtctctgttttccccagtgctagaattctgctctcgtttctgactttttacagcagtgtgcaggatcagaactcagctcttcattattcagcaagcactttaccaactgagctgcctccacagccccgataaaacacttcatttcccttccaaaagcgctgaagtcctaggagtcatcaggccctttttttacattatgcttaggtagtatctgaagatgttatattaacagttagcctccttagctgggtgtggtggtgcacacctttaattccagaacttcgaaggcagaggcaagtagacctcagagtgttcaagagttccaggatagccagggcaatgtagagagaccctgtctcaaaaaagaaaggaaaagaaacaacagaaaaaaattaatcacctgtccatgacattttctcccagtattcattctatattcatattatttatatttatatctctctttctctctctcttttatctatctctagctacatagctatcactacctttatccctatatctatctatctatctatctatctatctatctatctatctatctacttattgcaaaataactgatgcagaaatcataatcacataatgtaaagcaaaactcacacagtttcctttagccttctagctatttggaataattcctacttaggaattaacatgtagcgtcttgtttctgagctggacacgggattggatggaggccttctcttttcctgagttccttttgtatgaaagacacaggcatgcttgagaaccttcgcaggatacactggctgcagaaacatggacgacccaaagtctctccagtgaactctgtagggtttcctgcgacctctgtgagaagggactcgggcttaatgacgtaactcccactcgcctgaacgctcagtggcagggacacttgggagaaagtcaagctgttgctctgggaagaatattccagtttctaagacagtacatggaaaggagctcatgctctgtgtgtgggggacaaggagcagagagagggatgtggaaggaaaaggaacttgaaggtcactggtgtattctgactggctgaaaaagaaaagaagccaaattgattttgttaactgtgatctttgtttagtatgctgaaagcaattcttctcttcccttggacagctccaggctcctccccctgctctcgcccctccctgtgccaccattcctcttcttttgagactgggtttcaccatgcagttctgagtggtcttgaactcttgatgcctcggcatcctgatggtgaggatttcaggccagtgccatcagggcctggacacactgtcttctttccttattatctctacgactttcactgtttcccagagatcacaaactctccttggctttctgagttgctaaagtcacagtttatgtgtaggacctaaaataaagtcaaacacaagctaactgtgagcttggcagtttgtctttccctctgcttttctagtgtatgttagacaagcctactcctatggttggttgtttttattgcccaattcttccactcacagctgtttaccaccctccattttcattattatgcatagttctatgaacaacattcctatggctgattttcagcatacatttataattgtttcctgaatgtgttttagtagctggaaaatctaaggccaaagaatacacccattttaaatctcatgtgtgcttcaagtctgtgccatagacagtgcattacaagcaccacatatgcatcaattcctccctggattttgaaaatacattcgaccgtggtgtacaaacacggtctctgactatccagttagaaccttttccatggcttatagaccatcggtagcccctatttgaaaaatatttttcctgtagttttgaccatttttaaataaccagattaaactgctaattttgatttcttcatcagacttattaatgctcgctgtgttgtgtagtatttaagaaattcctttctttgtcattgcggttcacttcctgtccttattattttttttaacacacacttaagtgtgattttaaagaacagaatactcagttccttgttattggtgccttccgtttcagaagggctgccgtgaccctgagcttctgtggaatttcttcatgatcttgtgtagtctcatcccttcaactttaatgtttaatccttagaggctaatttgctctatattaggagagaggctctgaacttctccccgaagaacaaacgtatgctcccaggtttgtcggtctgagttctgagttcttctctagtctaacacagtagttaatatatcattgttgttttctgttgtacaattctggtcttctaccctcccccagttcccaaactgctgagtgagtcattccgttagctattttaattctcagtagagggtccttctctttatgattctcttcgtggcttatgtacttttatagaaatagtccccatatttgtaaaataacttttgtgtggatttactttaaagctctagacttgttagatgagaacttatgtattttgccttttgtttctgtgggggctggagattaatcccaggtcctggcccatgccatgcgagtgccctgccagccttgctaaatcatttataaataaataaaacaaatattggttgttattgttgtgtatatacatgtctgtgtgcgtgcacatgtatgtgagagaatgtatgagtgaggctcacttgtgccagggcatagatgtgaaggtcacagaataacttttagaacttggtcttctctttccatatttatgtgctttccagggatggaacttggattttcagacttgaacagcaaatgcctttgtctgctgagccattatgctggcctctaggtgtagcccaggctggcctctaggtgcagcccaggctggcctctaggtgcagcccaggctggcctcaccctggtgattctcttgcttcagcctctttagcacatcctactagcacgtaccaccacgacaggcttcagtccttattaaaatgctatgtctcactttcctgacctttcagttcttttactttccctcataatatcttaattttttcctgtataaacattgtgtgtatatgcgtgggtatatatatatgtgtgtgtgtgtatatgaataatgcatctattttatattattttgttttattaccatataaatgtgcattttcctttttttactgattgcttttatatgtgtgcatatataatatataggtgagattgagttgtatatactaatatttgatgatcctttttttctggtctcataagttccatttttttgttaactatcatttttgaagacagactataaatagtggtaagcttgtgaaatatataattttgaattcccaactaattgttttacagatctgacatagttagggtggcatctaggaagcacccagcactttcctctcagtggggtgggaggaacgttgatgtggagcatagccacccacttttctttttctatcagtttatttatttatttatttatttatttacatcctgattgcagcacccccccccccccccactcaaccccttctcttattctcctacccttttcctctgagaaggaggaggcccctctgggtactaacctactgtggcacatcaagtcactgcaggactaggcacatcctctcccactgaggccagacaaggcagctcagttaggggaacaggatccataggaggcaacagagtcagggacagccccgcctcccgttgttatgagacccacgtgaagatcaagctgtacatctgctacatacatgcaggtacccaggtctaggccatgtatgctctttggtgattgcccaccttttcaatgatatgtcttaagatttaaaaccattaaagatttagaagatattttagtttcataaattaaatattatgtgcaatatttaaatgcagaatttaagtggtgtttttatttgtggatgtaagtgggaaatttattccatacattcaatattattttaaacactttttaccataaaacccaccagacttgtgtatgtattatttaaacttaattacttgtctgtagttattttttatggttcttccagccaattttagtcagttactacagaaccactgaaggagcgcagaaagtctgaactacacagagtacatttgtaatagactttttctctcatttaggggaagagtaggagcaggaaatacccgactgcctttcaaatgcgtctctaagtgtcatgaccaaggcagtgtttcagccttgactcccttgtgggtttgtgatttgtatccattcagaaatgtgattttcagcagtgttcacataagaacttgaattccttgaagtgatttctttaaatgttgatttaagaacccgtaccacagggaggtggctcagtggccaagagcacttgctgctcttgcagaagaccagtgtttcattttgaggacccaatatcagcgtgtaactttaggtctggaacatctggtggtcctcaagggcacacgcacacctctgtcctcaagggcatacacatacacacatgaacacttaaataaactcacacacgtacacttaaataaacagaaatatgaaaagtactttttgaaaaaggaacaacagttgaggagtaagggggccacgggtgtttccatatgtcatttcaggatagtttgcattttcagcatgatttgaatttctgtgaatgtgcactttcctggtgagccttcacgtgtgtgtgagtcccggggccattttccctcctggagtgttcccactgcaaggcatgaagctgatgttcaaagcttctattttcctggttctcctttgatttacttaagctgtatttcccatctgaatttctttcttttttttttctctccatttttaatatttagcattagtatcatcactcacgtctcaggacatgtgtaatatttcttttttttaattaaatattttcttcatttacatttcaaatgctgttcctaaagtcccttataccctcccccaccctgctccccaacccacccactcctgcttcctgaccctggcattcccctgtactggagaatatgatcttcacaagaccaagggcctctcctcccattgatggctgactaggccatcttttgatacatatgcagctagagacaagagctccggggtactggttagttcatattgttgttccacctatagggttgcagaccctttagctccttgggtaatttctctagctcctccattgagggtcctgtgttccattcaatagatgactgtgagcatccacttctatatttgccaggcactagcatagcctcacaagagacagctatatcagggtcctgtcagcaaaatcttgctgggatatgcagtagtgtcttggtttggtggctgtttatgtgatggatccccaggtggggtagtgtccttacgtctcagctcaaaactttgtctctgtaactgccttcatgggtattttgttccccgttctaaggaggaatgaagtatccacactttggtcttctcatctattaaaaacaataaatttatgaaattattaggcaaatggatggatctggaggatatcatcctgagtgagataacccaatcacaaaaaaactcacatgatatgcactcactgataagtggatattagcccagaaacttagaatacccaagatacaatttgaaaaacacatgaaactcaagaagaaggaaggcctatctgaatttcttatgtcttttcagattcacctacttaaccatttcagttttttttatggcttgagagttgcaatgtgtcagagagttgagttttataaacctttaaggtattgcaagttatctagaaaccattgactcgttattgctggaaaaaaaaaagctaaagaacaaaccacaatacataaggttaggtaaatgttagtgtgttctgaaagtcaagtgggtttttttttttttctttttcctttttcttctagagtattctcaaggatctggaaaagaggaaagttgacttaaatggcattacagagagcagtgccgcccttcagcacttggtcttgggcagtgagtctgttctggaagagaacctctgtgtgctcaatgctggatggagccgagtgcggacgtggaccgaagactggtgcaacaccttgctggtaagatgccagaacatgcctgccactggggatgtcttctctaagtagctgcattggaaagcatgcggccctcgttagggctctgtgtgtgtctgctttgcttcgcttgtgcgttaggtttattattttatttttctactgaaaagataccaaaaagaagaatttacagcacctctgataaaagtcaaatattcatgccaaacacaggggccatgttacttaatattttagtaaacatagttttgttttaatgataagagtatttgctagtataatcataatatataatttatacatacatatgcacatgtatgtagaaatgtatatttatatacacacagtcttcacagtgtcttagttatatactagcacagataaagggttatcccagacattgctgcctgtaaaattcttgactactacctcagtgaagttacttacaaactctattctttctttttctcatctacaaaatgggcgttattatcatttctaccttgtatgattttataataattaaatgacttaaaatgtgtagtggtattatataacaatatgttaaacaccctattattttcttttaattataactattccactttcatagtgtttcctggctacttctaccaatgattaacatatggcagcccctatctctgaagtgagagttacaatttataagttattactttattctagcacatcagataggactttaactcagttatttccccagtaatggattggcatagatataagaataagtgatctgtttgggatttttttttttttcaaatcagttaggatatacagggcagaggagctcatgtgcttaggtcttgattgatcagaggtttatattctagtccatgactcattactgttataactttatgcaaattctgtaatataatacatcaccacataccaatgtagagagaaaagtaaagctaaagctggccatggtgatacatacctgtaatcccagaatttaagagaccaaaacaagagtctctaatgataaaggtcaatttacatagcaaggctctgtctcaaaaacgccaaaaaaacaaaacccccaaaacccaataccccttctcccctcagaatagtcacacctggtagcacaggcttgtaagcctgctgcttggatgactgaggcaggaggatcacaacttgaaggtcttcttgggctatatagtaaattcaaggatagcctaaataatttaaaataaaaagtaagaagaggcctgaggtcatattcagttgcgcagtgtatgaggccctatgctcagtctgcagaactttaaagcagtcgcccctccctccaaaataaccccaaaccaaaacaaaccaagtgaaagtatgtagcaaacttcgttctttgttgacacgattgtgtgacatgcagcatgctctttgatggcctcttcaatctctactaagattgccatcttaatatttcatttaaagctcatcagcaccatcttattcctttgcagaaccatcaaaaccagctggagctatttgatggacacgtcgctcacatcagtacctggctctatcaagccgaagctctgctggatgagatcgaaaagaaaccagcgagtaaacaggaagaaattgtgaaggtagtcagcctcatgagtcccgcaggctaatttgctgttctcttgtgccgtgtgctgtcagcagtgtgtgtggtgttctcaagcagtttgctttttggtgggagaaaccaagatcaccatgggtttctatgaccaccacatcctctggtgctgagagtcttcctagcaatctcagatgtttatttcaaatacctttaattcatagtaagcatcttgtgtgcttggaataatattcttctctctctctccctccctccttccctccccccctccctccctccttttactatcagcgtttactgtctgaattggatgatgccagcctccaggttgagaatgttcgggaacaagccatcatcttggtgaatgctcgtggaagcgccagcagggaactcgtggaaccaaaattagccgagctgagcaggaactttgaaaaggtgtcccagcacataaagagcgcccgagtgagtgcttgcatttgtataggatgccatttctccccatggtttatgtataatggtacataattttgttcaagcctattaatttgtaaatgaattttaataactgtttggcaaagcaactgctgttacttatgtgtgattgttgatataagaaaatattgtttagtaaataactcacccaggacaggcttcagagccagttgacagtcgggatagaaagagaatagaaataagtcatttcccaactgacacatgattatcaattcctgatcctaaatgcatccttttaatgtatgtgtttatagaaaatacatgtgtgtgtatgtgtttatatgttgacagatttaaatgttataagttatagactcacagtttgtagttcacagggaaattttctgaattcgctaatttgaaaacgctttatcaattaaaagaagggtcataaataacagctgtcattacaaaatggtgtctgtactactctattattttttcagcccccctgtatctttcccatccccccctctgttattctttattttcagaggggggcaggagacaagctttactgtagagttctcaaggccgagcacagatggagcttgagtaaatgtgaggtggaaacgatgcaagcattttctcagcttagagggagagcggtggacctgagatgcccatgctgagggatcacaggatgctgagcgttttatataatctcatctgtgcacatctggtggcactttaaagaagtagtcaattgaacctcttggcagttatctattgaaataacaaagagaaaagatcgtttgttttatatgtgtgcaggaagtaagttttacctaactttgttttaacttaaaatatctggtatagtgagccacacttttttctatgccccagcatataattattcacgacttaaaacaatacagtcagaccttccttgagcatttgtcttctttaatcttggctttgcctccttattgtatgacttaattccattttatttgtttaaatagattcatgggagggtttttttttttttttgacattaaaaactaagcaaaggacggtgctaagagaaataataaagaaaattagcattgcccctcaaatgacctttgcaaaccactctgttgcttaacaatttttactcactgatgcatgattccaaaatataaaaaaaaaaaaaattatagcattctgtacatgctcccttgaaatggattttaacagtaatgttctatgggctgttataatttgctaggttaactttgtgaatattgggcccttgggaatgttgtctttgttaaaatcatcttactcgtatctgctggctcatctcttactattctgctggtatcggattttagaatccattgagttgttgcagagggtgtagagggccgttccaaacactttcagcaggggctagtggaaaatctgtgcaggttaagaagtgagactgctaccttcttcatagacgctggatgttttattcatttatttttattaaaatggccatttttacttttattttcccaaatgtgatgtttttctctatagatgtgaaaatgtggcatttggaaatacaaatctttttgaggttctgtcattaaaacacccaaggggtgttcttcttggtgggcatgtatgggaggcgttctctagggtctccttgcaccctggagtgaggactggccattgtttctttcatggcttgtggcagggatggttcacatcacggccctgtaggatgttcaccttggcagctgccctactgtgctcgaagcagccacagggaacggaatgcactttacattcctggctccagattgaaaaatgagcagttcgagtacacccaggttgccctaagtcattgctctgtgatgaatgaccttgaagtcatttcagataaatgctggtttctgctgtgaccctgcctctcgggatgattttagaaaatcaactctcagaagcctcttttccttccctagatgctgattggtcaggacccttcatcctaccaaggcttggaccctgctggaactgttcaagctgctgagtctttctctgacttggaaaacttagaacaagacatagaaaacatgttgaaagttgtggaaaagcacttggaccccaataacgatgagaaggtaggtggtctgcaaaccctaccctcgttttttttttttttttctctccttaacaatatggattcatttgcttgacccaccacatgtaactgaagtaatccagatgtgatttatgagagtcactgccgaagctgtcaggtaactcatgcaatgcttgaagttcacatacaacgctcatctaaccccaacattgggaggcagatgcaggaggaatcccagttcctgatcttctctagcgatagagcaagtatgaggatagcctgggctacaagaaacaaacaaacaaacaaacaaacaaacaaacaaacaaacaagcaaacactaatggtggtggtgatgatgatgatgatgaagagcaacaggagaaagaggaagggcaggaggagaagaaggagaggaaacagtggtagtagcagctccaccccctccttcctgactagctgtaatcattagctacgttttgataaattagctttgggatatttgattttccaatataaagtatttgaagaaaatcaagagcagttgtgtcattcaggccgatgtggcttgacccacactgccctgtctgtctcagcatagttcttaacactgaacaatggagagtacgaagtttgtctgtgtatttttgttttcagtaattttctttctttaaatatttagatggatgaggagcaagcccagattgaggaagttctacaaagaggggagcatttgttacatgaacctatggaggacagtaagaaagaaaagatccgcttgcagttgttacttttgcatactcgttacaacaaaattaaggtaggttgctgtggtctccgcagcaaagaaataacttacccagttgtaccatccaggctggggatgtaatatttaaagacacaagcaatattcaagcaaatcacctagggaaattatatatttccccctcactgtctttttaagtttaagtaattactgcttattttttggagttaggattggatcctattcctggtgtatattataggttatttgggaatttcccatcatgcactctgatcacacgcacttcccagtcctcccatgtctgctcccttaaatgtaaaaaaaaaaaacaaaccaaaaaccaaaacaaagacaaggggaggaagtggggggggggagagaggaagagaggaagagaggggagggaaggggaggaaaaagaccctcagaccattttgtgttaaacttacttgtgcatggtctagtcccaatgagaaagggaaactgagtccttccccacccttgccagaagccatcagttgtggagagctacatttcagcatccttatcacagctttcaaaacttctctttgatggctaccttcttaggctattaattttttaggggtagggtggaggtaggggttgtcccagaagcctcggtgttcctctttttcaactgtgcatctgcagacattgaaaatacggcaagagtaatatccttgtggtgttttaagtgatgctgttccccagagctctattttttggtagttcttcctgaaatgagttttatttgatcacttcggaatctgagtggagtcctgtgccttggcttgctgtctaccagctgtctctgactgcacgtgccttgttgtacgatccaatggaagttgccattggtgtcgtccactttccccatttcccttcttagtctatcctcttaaaaaaatagcccgtctgtgtagatggaggaaacttcattaccatcctcacctattttcctgttcattacaggaagcaggacttacaacgattaggctttggactgaggatagtggtctgggaagtgtgtgtctcacacgtatgaggacctgagctgtcttagttcagtctccagtctcagtttatgtaaaaatgttaagcatggtggcacagtgctgtgatcccagtgctggagtggcagacaggaggatcccagggctctgtagaccaagcagtctcacctaattggtgagctctagccatgagaccaatgaaagacccttcctcagtgggtgggtggtggtcctgaggttgccttttggcatgaaagtggcagactgctgatgaaagctgaggcagcttgtggagtttctgtagcaatgaaggttaaaagaagaaaacttatattgaatgttatttttattagcatttattaattgtgtgataatggtttcattgtgacattttgtgcatgtacatagtgtgttttgatcataatcacctgacttgtgtttcttacaactttggttgacattctgggattcttcaacccccccacccccaatttgttgttactttcatgggggggggttaacatacctgcattaatattttttttgaatcttttaatagacaatccctatccagcagagaaaaacaattccagtttcttctggaattacatcatcagccctccctgcagattatttggttgaaattaataaaattttactcactctggatgacattgaattatcacttaatatgccggagctaaacaccactgtctacaaagacttctctttccaggaagactctctgaaggtaaaaatccaagtgcggaatgtccgttgccattgttaatagaaaaagtacagaaacaaggccaatctccggctcttcctgttttgccttttccctccccctctctccctcctcccctccctccctctcttctttcctcctaccctctctccttccctccctctttctctctttcctcctccgttttaaccttttccctccttccctcccttcttttcttttttcctttcccctcatctttttaaagacagggcttccttagatagtccaggctaattggatgctcaccctccttttcttgcctgtggagagctgagattacaggcatgattgccgtgctcagatggaagttgctcttgtacttatttagataatccaaatctttgattactccaaattagcaacaacagtgtataaatagtgagattttactgtattccctggtaggatgcagcatttttttttttcaatttaaaaagcatctaggtctggactcttatgaatgcacatttatttgcaacagcagagatctaattttaatctgatgtaaactcgattgtcatttgtgtcaaatgatgtcaggtcatccatattgattcgagattggctagttgccccgttgtggaattgcgtattgattgcaagttaacattttgagttctttgaaagttttttcccatgtatttgattgtacttctatataaagatgtcgtattatttctgatagattcaataatttattttctcatttaagctacagtgattaggcatttaaaactataattctagaagtgtctcctttttttttttttcacctacatagtatgttagtaaagctacctttcctgtatcctgccttgaagccggtcaggacatctaggagggtgccttcccattcgccattgtgatggtattcctcacattttggtgactctgagatttttatatagaaaagtccataagaaaaccaacagcggcaactaacctggacccttgggggctcccagagaccgaaccatcaaacaaagagcaagcacaggctggacctaccccccacccccaaatgttacagatgtgcagcttggtttgacaattgtctgacctcagtgggagaagatgcacctagtcctgcagtgacttgatgtaccagggtggggggatacccaggtggggcatcccccttctcagaaaagaatgggagtgggattgaggaaagtagccatgcaagggtcaccaggaggaggggtgaatgcaattaggatgtaaagtgaagaaataaattgaaaaaaatagaatcccctcatttgcacacagaacagtaattagccccactattactttaaatgagtgtcatacatgtaactctttatctgtggttctggtgttttgtacaatgatgcgtttgcagagtatcaaaggtcaactggacagacttggagagcagattgcagttgttcacgagaagcagccggatgtcatcgtggaagcctctggccctgaggccattcagatcagggacatgctcgctcagctgaatgcaaaatgggaccgagtgaatagagtgtacagtgatcggagagggtaggtgtgaactaagtgaatagttatctctaagtcacacgagtaccaggccatgcagcgttgacagagtccaagtgtgcattaggatcatggaaaccatttttcatgtatttctaatatgacatgattaataaatagagatgagcttcattccttaaagagaaatgtgtccacaggcacacagccattaagcacataataccttaatgatatgggggcacctttagtttttagcttaaaaataattctcccttttaattagaaaggattttattaatgttcctttctcccacacggcatgattaatgtgaatgaggaacagaagcagcttcaggtaattggaattcatatataaccacaggcccgttcttcccggtttttctgctctataaccttctgcttcataggatgtttcggagtttttttttttttttttcctgttgtttttagacttcgaacagggacctgtgaataggagtaaagaaaaatgagtgtgatcccccccccccccccagtagctgtgaatgtagttaaatgcaaatacaacatgaaatagcccaacaacaacaacaacaaaaataacatgtaatggagaatttactatagagcaatacattgcaagtattcagatacgaaagcaaggaatcatatggttaaaatttttttaattcatgtgactgtttaatcagtgaagaagtatgccttaatgatctttgttgctatgtaaatttataatatggtctctttgtgtagttagtgaacattcttttgtacatttatatatatgtgtgtgtatatgtgtgtgtgtgtgtatttttgttgttgttgtttgtttgtttgttagaactggtatagtagttactttcttcattggtgacacaaatgttgatcaaagcaccttaaaaaggaagggttgttttggtttatggtttcaggacacacacttcgcataacaggcaagacatgatcacaggagaaggaggttggctggtcacatttcatcagcaatcaggaagtgtagagagaacagaaagtaggataaaataaaacctgaaagcctccaccaagctatgtgcttcttccagtgaggctctgtcttctaaagattctccaaacagcgccacctgctggtgactatgtgttctaacacacgagcctatgggtgacatttcacattcaaatcacagcacttggttattacatgaagacaattaaaaaagcaagatgttgaaactcgatttgtattataacatgaacttggctactgtaccctgccagggatatttataaactcacccttcctttagaagcctggctattattggcaggaatatttctccaatattacagtgatagcttcattgttgtctttctttactgtgctctcaatgggacttgaagtttctttgtgcccagtaatggctcatctttgaaaccaagggagtaatacttactgtttaaaattgtttttctaactggaagatattatttatgtatatttttgtttatttgtgagtatttacagccttttgtatgtcactcaaaatggcctgtaccctttgacgtagagccaacttagttttatgaaattatatcttatagttgtttcctttatgattgtatacagttaacaaaacttacatatccattccttacatttgctgtgtctgaggaaataataatgtatggtttggaaacaatcttagttgcttggttttgattttggtatgacctctgttcagggcccagctcaggagcctttgtaccacagcttcagtaccatgagtctgtgcatgcacctctactttccaaaaacccttaagcaactttttgtgcatctctagataaatatttaccagctctaatttgcctcattgttcttaaagaaatgaccaatgtctccccataagttttcattgtccttatagttagcaaaaaatgtcataatttaaagttatgttattgtgtattaatttagtggtgctaattatgctttgatgcaccattcattttaactaaatgctatatttttatttgtaatttgtaaaatttcccttcaatgttccagaacagttactcttttttggccttcgttttaacttgtttttactttgtttcaacttgaattgaagccttctatcactgaaaccacatactttcgaagagaatagaggtagttaatcatgtgtttctgtttcactatacttaaacggtaagggtataaatttggatggattaacatgcctacaattaatcaaaagtggctgtgtaagtcagagaaagcaaaaacctttttgacataacacattccatttaaactcttcggtttaaatcagatttgattgacttattactaggatgggtttgaaagagaggttacttctggattgctctgtgaagcttgaagctccactgagtctgtctctcgtgctccaggtcctttgccagggctgtggaggaatggaggcagttccaccatgaccttgatgaccttacacagtggctatctgaagctgaagacctgctggtagacacttgtgctccagatggtagcctggacctggagaaagccagggcacagcagctggtgagtgtgtcccatcctgggggcagagtgtgtgtgtgtgtgtgtgtgtgtgtgtgtgtgtgtgtgtgtgtgtgtgtgtgtttggggggtggggtgggaagggggaggcagggcatgcaggggcagggcgggaaggtcagatgcttcatagattgttgtaatttttaccactgtacattttttcctacatctagttcccagttttaaaattctaagaaacactggtcattatacaatttatttatttatttattattttattttatttttaatttattttttacattccatattccattccctgcccttcatccaccctccgactgctccacatcccacatctcctccccaccccacaccgtgtccacctggatgtccctaccctcccaccccacctgacctctaaactccttggggcctccagtctcttgaggggtaggtgcatcatctctgaatgaaggaatccctgcagtcctctactgtatgtgtgttgggggcctcatatcagctgatatatgcttctgtttggtggtccagtgtttgagagatcttgggtccacgttaattgagactgatggtcttcctacagggtcacccttttcctcagcttctctcagccttccctagttcaacaacaggggtcagctgcttctgtccattggttgggtgcaaatatctgcatctgactctttcagctgcttgttgggtcttttggagggcagtcatgatagatccctttttgtgagcattccagagactcagtaatagtgtcaggccttggggcctccccttgacctgaatcacaccttgggcctgtcactggaccttcttttcctcaggctcctctccatttccatccctgtaattctttcagacaggaacaattatgggtcagagatgtgactgtgggttggcaaccctctccctcatttgatgccctgtcttccttttggaggtggactctataagttccctctctctactgttggccgattcatctaaggtccctccctttgagtgctgggagtttctcacctctcaggtctctggtgcattattgggggggggggggagtgtcttcccaacctcctatttcctgaggttgcctgtttccattctttctgctggtcctcaatctttttccctcacccaataccagatcaggttcccctcttcccttcccctcccctaacctgtccactttcctggcccccatcatacaatttataatccagattttaaagaagtttttaaaaggataaggcactcttaggttgttaatgtgagagatagttatttttaaaaatattttaagatatatttctcctcaggagattttatattcatactaacacaaaaaattatatctaagactatatgaaagacagaaaagtatgtgtatattcaatgtcacctctgctttgtacccctaacacctaggcatcccggttatttctttttccttttttaaaaaatcattgattattgtcatgagaggatgctgttctttatggacaaagccagcctcttgtaggactcagcctcgagactatgtagcacccagcagtcagcctgccagcacaataggtcactaaagggagaaatggagcaagcagaagctcagatgtccattgtcaaatgtatttcttgttttagtacattttcaaaatgtattttctctagacagttcatggggcgtcgaaaacaatgcctccccctcacttgcagacatggtgctgcggttttttttgggtgtgtgtgtgaaagtttgagttacaggtaagtatttagacttgactttgaagtagaccttaatctgtgactttaaaatttttacagacagaggcagcatctcagtaaaatgcacattgaggattttttattataaatggctggacataaaaattttattgaccaaatatttgtgtgtatgtggtatccacatgtccctggaaatgcaattttaaattctttgaaaagacattatagccctaccccgaatttgtttctgtaggtgttagattgatgcttaaaaacttgggtacactgaaggtatctgaacagcttgattgagtggtagaaattcataatgtgtcatctgtcataggaactggaagagggcctcagcagccaccagcccagcctgatcaaggttaaccgaaagggggaggaccttgttcagagactccgcccctcggaggcaagcttcctgaaggagaagctggcaggtttcaaccagcgctggagcactcttgtagctgaggtggaggctttgcagcccaggtgatgactcagctctgaatgttttgagcagaggggcgaagatttcatgtaaactacatagaagctgatctaataccatgataaaaatattagtggcatttgaggcttcactgttcatgttacttaggacagtttttaggctgtcttgtaaatcttactgttctgttcagatttcctatgtataaaactttctttggggccagggtgatggctcagtcaataaagtgcttgccacgcaagcacagagagccttgcttagacctccagcacccgtgtgaaatggtccctgttgcaaagagaggtttctttgatgagggatcagaattatacttatctgggttggaagaagttaaatatttagattgtacttatgaattatgttgatttaggcaagtggcggttgtaagagcacatccaagttccatggcttcactaaccttggatagctggataggtttccagtatcaggcatagtttccattttttctgaatgggctttatgcccagttagagagctattagttgcataaaggtattgttgcactcttgtacccttagggttaatgcattgtgctggtcacccaccacagcacttatggtcactgtttcctttctacaaaagaaagctataatgtcagacagttgcttgagggttaaatgagactgtatttgaaaaatgtgtatgtcttaactttttatggcgaacatttaaaatatccatttcttataatcctttctcgaacatattctcccagcgtgttgttgctgtgtattgctaatagtcaattaatgtaatcagctttatcaatattctctcgcactgagcattcagatgttactatgaactcagactgaaaagatgaagtagaaaggaaaaaagcgtgatcaagggaaacatccacatgaagatgttgacacagaggcaggaaagatgagctatggaattgggtactgatgaagagggatgctgaagctgagtttcgaggcatttatagcaattttctgtacattctttctagggtgagcctttgtggcagctagctttctgcagcaataatgcataatcaagatgattagcttataaagagagaatgtttattttggttctcagttgtacgggtgccagtctgtgagtgtttagccccacagctttggcccttctctgggacattgtggttggggtgcctgctagagcagacagcttgcttcatggccaggaagcaggagagggaaaaggcgactgaggttcctgtgtcagcttctccttcaaggtcacaggccccatgtgctgaagactgccatcaggttttataaaattgccaccactgcccagtagcctcaggggcctctaggagatttcagacgaaactggaaaccttcttgagagaagatgtagaactgggctttgtgagtaccacacccagggctgtgtgagagagatgggcagatgaggagacaagataggaggactcgatatcacaagggaaggaattcatggatcatcctttcctacaacaattaatcagattattgttatagtaatgcattaatattaatagtaattttaccactactactattgtcaatcaattcatatatcatataataaacagtacatacttaataataaaatagcaaccaattaataattatatcaataataaaattattaacttatataataacataatgataagtggctatttatgtcttcttaaaaaagaaaaaataaacaaacctgctgctggcaagatattaacagctgcagaaatacccctcaattttcaagtgggtttctgtggagtgtggaagccattcttccccaacctacaggatgacctcgacccacactttactcaagcttttggaagtgaatgcagtaatgagtttcttcttagcttcttgtatattcactaaaacaatattggttttcagaaattcgtagtgaacttcactgtttctctaacctgtgtgtattggggtcactttggaagccccagaggttcagggtcattgacagttaccacactgcttcatttctctgtgtattcagtacctgcaggtaaatatttgcacatttacagtttatggtgtcattccttaataagcaattcttatcctagaattgtttctactcttaagaatagcaaagtgtacattatatttagctggtttacagatgaaaattacttggtaatattagtttcttttatagttctagttttagagcatgaaagtagtcatgattatgaaacactggcaatttaattttcaatatatctgaaagaaaagaactatacaagtattatggagtgtttctaaagttgttagattatttttaaattacattttattataatttctactaccgccatcattgcttcattttttttttaatttcaaagtgcatcttcttttttttcttcttttactttttaaaaaataagttacattttaagcaatttttattaggtttaaatagttaaatattatacctttccattatgactgttagtactatgtaacattaacatataatatcacatattagcatattgacgtaatacatattacatgcatattttgttgtatgtattatattgtattatgctttttatggttaaaatataggaggtggcatgagaccattaatttccattagggatggcacagtgtaatttattaaagtgtcacactcagttttcaatcagcgtctagttgcagtagcttaaaagtcatgatcccactaagatcttaacagctttcaaactctctctctctctctctgtctctctctctctgtctctctctcttaaatctgcaatcttatttgtcatctgggttctgatcacacttcattgtctggcagatggctggtatccctaggtgttcttcttatactgttaggaagttctaactgggggattctgatgtcatagtcatcctgtggcctacatttatcttttggaccttggctggatttttttcccttcatctcctttatgcaatatgacatcctatgcatatgttatccttattttaatgaactaatcaagcatatatgtttgtagaagatttcgattctcagtactcatatttttgctgttatatgggtagaatggacaaatactgctatcttgttgtatctgcgttggtggcgcacgcctttaatcctagcacttgggaggcagtggcaggcagatttctgagttcaaggccagcctggtcaacagagtgagttccaggactgccaaggctacacaatgatgtctttctgtctccatggagaactcagataattattcctttttccttattttacacaaggacatgttcactgttcgttaactgtattatacagcaatagctaacttaaacattttcatattaacttgccatttaatttttatgatgagaagataagacttctcagtgtgtctgaatttaattaaggggaaaaaatccctttagtcctatatgtaatttttagtatggtactctgtatgcatgattattaatgttaatttaaaaactacatatttaatatcattattagaaattatttctactggggctatggggagcaagttttctaaaacaaatatattgttttgcttactcagtaatttctgtcaatattttccctactgtgttcttttaggctaaaaggagaaagtcagcaggtgttggggtataagagacggctagatgaggtcacctgctggttaacgaaagtggagagtgctgtgcagaagagatcaacccctgacccggaagaaagcccacaggaattaacagtaaggagtttgtagctttccagagccttcgaatgcaggatctaatgaacttgggaaataagatcgttttgactgaaattgagagggaagtacaactttgttctttatgataagtatggtaaatttgaaagagttgggattttttttcccattattttatactattttggtcatgcagagatcaaacaaaagattagtaaccctgaccttgatgttttattaaaagatgtagactatcttaaagtgacttagaacacaatgcagccatgaagaatagtttctgcctttgtattgaaaaggtaactgtgtggtgacttacaagaaaatcctgggtgttgtgcagttagcgccttgcagcttgaagcaggcttagagttacagttcagcaatcagagtttcttgttgatttgtagccaacagggatttttaatggttgtgcatctgtgcacatgcatgcacatgtgtacacagacacacaatctataaaaatatataaagatatatagatatctaaatgccaaatctccataaatattcaggtccatgagcatctgtagtctctattaagaattgagacattaatagtacaacgttggacaggatccattttctgaaagcgtcacagacatggcaagatggctcatcagataaaacactcactgtggtcatctggtaacttggttcaatcacccaaccagtggtaaaaaaatttagatatgacggtgtgcctctggagtgccagcctttttgcagacaggtgctaggtagagacaggagaattacttagatacatgagggccagctagtctgggtactcggtacgagagaaatcccacttaagtaaggcgaaaggagggaactgactccccaaatttgtcctttgacctccacatgtgtgtgtgcgcgcgcacacacacacacacacacacacactcacatttaaaataataacataaaaattgtacttgaatgtgttaatatatatacatatacatacacacactcacatttaaaataataacataaaaattgtatttgaatgtaattacacatacacactcaaatttaaaataacataaaaattgtatttgaatgtgattacacacatacacacacattcacatgtaaaactatgttcaaaaaagtattcaacttatttgagaagtggttttgtcatagagatgtatggttaaagtatcttgagaaagaaacttttagtgatgatgggaaacgtgggaattgttcattaaattttttttttgaagtatgaggatattccttctttatgtaaagagtcaagaattttcttcaaatatcctgtttataaagtatttggaaaatttacaaagggtaggacagcatgttaagatgaagaaatttagtggtgatcatgatgtatcttaacaatgtaaacatagtgtgcgcctggtgaagtggtgctggtcctagagcgatggcccagcaggccagagcactaactgctctttcagaggccccatgtcaggcaggcagcttggaactgcctgtaactagagcttcaagtaatctgatgccctctcaagactgtgaactcaagtgtagagcccttccaccaatatatacacttggttaagaataataaaaaagagtatgtgtttgtgcatgtatattcagacacatacacaggaatgtacattcatgctctatcagtgagagtgtgttaacaatttcggtaagctgactttccatttaagatgcctgagtcctgaatgtataaggatattttcccaagagaatatattgtgtatagtaactctccctcagaacaaccttctaaccatggctgttttttgtttcaggatttagcccaagagacggaagttcaagctgaaaacattaagtggctgaacagagcagaactggaaatgctttcagacaaaaatctgagtttgcgtgaaagagagaaactttcggaaagtttaaggaatgtaaacacaacatggaccaaggtgtgcatgtgggaatcctgtaacgtgttcctcttgtctattgacttttagaattatacttgctttggagtgtgtgtatttgtgtgtgtgtgtgtttgtgcgcgcacacatgcacatgcaaaggggggggggcaaacagacagagacatagagaaagtaccacacataagggaacaacttttgggaattgatctcttctctcatgtgggttccagggattgagctaaggctgtaaggcttagtgcaagcaatcttaccagatgagccatcttgttgacccctatttactgagtccttggttaaattgttctcttgctattgctctaagtgtacagatacaggtctgacatatgtgtgttttttcagcactttacaattatacacacacacacacacacacacacacacacatacacacacacacacacacacacacacacaatatatctatatatattcatccactatcacatgtattctcaaagaatatcttttatttcacatggacttctttgttctaggggatgtgtatattttcaaacataccacatatgattgtctattggaatttagcagtaaaatgccagtaattatagtctgaaaatgaagaccttaaaatagcctcttgatgttgaacaagactttcccacatctgtttatttttggtgattttttttattcctttagtatgtttttattgttaggatcctgtggaatttaataacatctgacaaaaattaaactaagatgggagttattttccttatatgattactttgtttcacagaggaaatggttaaaggtagatgaaatcataggattcttctcattttgtcttagtacccactgggtcgatgtatggtgtctatttgaacatggaatggatgtgtcccacccgggactgccagtcacttgactctcttttcaattctatcaaactggaagtcctggcgaatgtgttggcatgcatcagtagctctgacatttgacatttactaggctaaggtaggaggagagtttcttcaaagccaacctgggctacatagtgagatcttatctcaagaaggaaagagtaagaggaaagaggaggaagacgagctatgagaatgaagtggtattatgctgtatctaacaacctatgtgtgctttctagacccagcctctgtgactatgagttactgtccaagtgatcactcgttatctgtatctctggcctagacctttctctgtattcggcacttgaatgttcaatgtctctgctttgggagctaatagatgtctcaacagttacaaaattgaactcctgatttctaccttatctttgggccttagtgtatatcacattcctcaattaatggcatgtatgtctctattgttgcctaaatcagaaatcctgaatcattaaaatggcacataaattatatatgtgaattataactcaataaagagacatttcttccttttcttacacacccagacacccacatccagacacacacacacacccagacagacagattcacccgccaccccccaattctttgatgtccctgtcattggctttttccatggacttgatggatagtttgatagtaggcagctatatgtgataaggcagatgagggcaaatttttgatgtgtagaatattggttgtgcacgaatgtttctgcacagttatttcagttttctttatgttagaaaaataatggcataaattggacttcaccgctcctttgtattgcttatcccaagccaccgtcatctctgggaaagccctccttcctggtctcttctgccaccctttctcattgtcagagcacagcagccaaagctttgttaagatgtaagtgagatccagtaactctctgaacaatgtccactaacgactttccgtcttactgagagtaaaagccaattgtcctccgtgtgatttataaggcctctcaccctgcctagctgctctctctgagtttatctgatgctctctcttctgctctccactctggacatattggctcccatgtcacttgccaaatccatttgcacgtattcatccagagcatacatttttatggaacacagagggttttgcttggtattatagattaaagggtattgtggccagttggggaacaccatgataggcagcattgaagcttctattactgctggaattaaattaacataggttttagtattgcccactttgggtaattatgacatctaaggcaaaaaaaaaatgcttcttgtgtggggaatcatgttaggaactgctactctggaatattttattccttcaattcttttatatacttagcagatttcactacacccctggttcatgcaaggccccattttaaggactataggaaattttttatcacccagttggtttgacatggataagacaaagagatcaataattaaaaattggaagcaaggaacattcaggggacacttatatactttcgagtgatcaaggaaggcctgtgggagaagatcttatctagcctaagttataaaagcttcactgcttaggtgagggatgaagtaacaggctttgacggggaagtacagcaagtggaaggctctagaggacacaccgtgagggaagtgcatctgtggtctacaatagacttatacataaaacagtcacccgagagatgcccagtcactccagagaccagatcctggtttattgagcaaatgtgccactctacagaattcgggctctatcttgagaagaattcactactttgagggaaatggacagctattatttatttataaacagatttctgttagaaagaccccatagctatactgtagggaaggtgggctcagtgtatggaacaatcaggtagagtttcaagagaagcttaccaaaggcagtttcctggaagacagaaatcgtgaactgaggtttggatgtgtctaaagatctattagacagaaagctgagtggaagatatattactgggggagttctttagcctctgaagcatccatataggaaatgaagagtaagaaaggtcaaaggtttaacctgcacagcaatggcacttgatggacagtgaaggaaacttaagagaggcaggaagaaggtcagactcactgggtctttacaggatttgagttgtgaggggaatgggcagctccagtggtgcaagtgtcacacatgaggactggttggcatccttgcgcttactgtcaggggaggtaacctgccacgaccacacatgcttagtgtgtataatttgatcctgatcataggattttgatcccttccaaacccctgatcgtggagttttgaaggctgcatttcccaggaaaccatgtcctagtaacatcacagtggatagtgaaggtggagatgcaagctagggtgggaactgaaagaaaattgattgagctgtcgtatggaagagtggctgtgtttcgaagatacaatcatcgtttgtttctcttgtgtgtttggcttgatgctacaggtatgcagagaagtgcctagcctcctgaagacacgcacccaagacccctgctctgccccacagatgaggatggctggtaagaaagcatttgctctttaggagtcatttttatcaacacagacaaacttatagtgggaacatcctattagaagaacttactgaaaaacatcacgtgattgctgttcataatctgaatccagactggatgcttagcatggggaaagatttgttgttctccgagtcaaagatatatctggatggccatgggtcctggtgaaggaaggaaagaggggctaggtggaaaatactgagttaatttaatggagagatgcactttttcaagttatcttgtgtaacctgccatgacaacacatgtttagtgtgtacaatttgatcctgatcatagaattttgatcccttccaaacccctgactgtggggtttcgaaggctgcatttcccgggaaaccatgtcctagcaaatattattcccttagttatggggaacattgtatattttctcatgattcctgtttatttccttctgtttctgtcccaagtagaccatatagccactgggactatggccttgctcactctcctacccaccacattctgcttgctgtctgtagtccttagctgtactaaccccagccacccacgtctctttgccagctgaggctggaggttgggactttctcactgtttttcagtgcccccctcatctctcctcctctcctcaactctgcctcccacctgccgcctcctacctgggctcaccttgtccatttccacctcttcttctcttctttatatcttcttcttttcctttaaaaacaatgtgtatttccttcctgatattgcagcattgcttatgacccagtgtgtgttctgcattacttattttcctcagtaccttgtcttggaaatccctgtggcctgattggttttcttgattatatttagaacaattgaattgagatttgtatatatgtatctctcttcctctctctcatctatgtatgtatgtatgtatgtatgtatgtatgtgtgtgtatctgtcgtatgtatgcatgtatctatgtatgcatgcatgcatgtatgtatatatctgtatctgtcgtatgtatgcatatgagtctgtatgcatgtatgtatgtatgtatcatctatatgtatctgtcttgtatgtgtctatgtatgcatgtatgtatatatgtgtctatgtatgcatgcatgtatgtatctatcatctatatctatgtatctatttatgtatatatgtatgtgtctttgtatctgttgtatgtatgtatgtgtctatgtgtgcatgtatgtatgtatctatcatctatatgtatctgtcaatgtatctgtgcatgtacatatgtatgtatgtatgtatgtatgtgcctatgcatgcatgtatgtatctatcatctatatctatgtatctgtgtatgtacatatgtatttatgtatgtatatatgtatgtgtctgtctttttgtctatcttgcttcaattctatgaccataaagaaacagcttgctttattaagtacagctgcagaggtttaccttttttagaacattgacaaaggagtagaaaaagtttatgtacatccttagattataaaagaccaacagcaaaaccactttacagtaggtttgcagtttgttttccttaaggcaaccctccataaaacaggtgtgagacctgaagccaatttcagtatgactttccttctacagtgttcttgttttttttttttaagtctaaacacaaaatgtaaaaatctaaatgaataattttaaattctaagtaaaaaattttaaatgtagaaaatgatgaaattatgtgtttatctgtgtttgtacatgagtgtaggtgcctggagaggccagatccactggagctggggtggaatggccattgtgaaatatcccacataaatgttgggaactgaatttaggtccctaacaagaataatatgtgcttttaacttctgagccatctctccagcccttacacaactttttagtttaatatttttcttcttttaaaatcatattaaaagtaaaatgatctatttttaaaataaataattcaaggacatttagttcattgacagtgttgtacaagcttcacctctatgtagctccaaaatatttctattctcaagttagagttcttgtgcttgagtagcttctctctgctcctccctccgacccccagattctcagcgtctggtatccaacagtgtgcatgccagccatgtcagcagattggtccatcttgactatctcgtataaatggtgtcacacaatgtttctttcatttagcctagggaacttcacaaaatttttgtttatctgtatgtttaaaaatggcacaggctgggcatggtggcgcacgcctttaatcccagcactcgggaggcagaggcaggcggatttctgagttcgaggcccgcctggtgtacaaaatgagttccaggacagccagggctatacagagaaaccctatctcgaaacccccctccccaaattggcaataaccaatctattatgcttttaaaatatatatttttataatattaaaatctactatgtttcaagagaaagtgaaaatgaaggaagtgacattgttttgcctttttacaacctaagtatctggctttgaagatgatatctaccttctcatttatgcttctgggtttcatctgtaaagatggtgcaggtgatgtgtcattatatacctgggggagatttaaagcaaataagtatggtggtggtggtgctattaccagcatccagatatcttggaagaggcacagggaggccagtgcttgtcagctgtcactttgccaacctgagacctgcacactttgctgacctgtgattgcaaaacattttgctttaattagtgctttctctttcatgtttcatgttgaactgctgtccctgttatctgtgtagtaggttatctgtcgcctcgtccagagctctaaagaataaaagcattttgctcactaattaaattcacgtgcctagcaatcacctcctttcttagtctttcagagatgtttgaacggatcggtctctggtgctttccttagacgtttagagctttaatggtgcattaacaagtttgcctgtctttgtgttgtgctctcgactcataaagatattcttctacgtcttaatctgatagtcatagtttttccccttcatgccttcatctccaggtgtctattttcctttatgcacatgaggtcagattccgtggcatcatcttgccatactagctgccagacagcagtgcttacggggtagtgaagtctttagcatccttccacaatgccacttctgtgtcaggtctttctgtccctgtgccttatggttctcctctcctggtcatctatttattattttgggatacagttatcattggtcaaaagtgtaactcaataattgtagggcatatctccttacacaaatatttttataaatttttttgggggggaagaggagggtccctttctttcttattgaacaactagaaattagtatctgtgattttgccaagctgcctgcatacctgttggggtttttattagaattgtactgaatttatgctaggtgccaggtagatttagtattcgtcttaactacatcttatattgaaaccaactgttaacttctcttagaaacaaaagaaaaacaaaaacaaaactaagaacaaagacagaaacaaaaccaagaacaaagacagaaacaaaaccaaagggttggagaggtggcttagtgtctgatatcattggctgcttttccagaagacccagaattcatccccaacatacacatgaccgctcacatctatctttctggggattgggtggcctcttctggcccctgtgggcatcaggcatgcgcatgttgtgaatatctatatctgtatctgtatctatctaatctccagacaaaacactcatacgtgtaacagaaataaaaccaagcacaaaacaaagagaaagaaaatatttatcagttctttggagaagacaagaattgattttaatacctttgggaggacatgtaagatccttctgctcactgtgaaggacaagggtggattcctctgacagaaaggagtaaataaaattaaataaatcaaataaataaataaataaaaatgaaacaataattcaaaaaataaaccaaataataagtaagaacaataataaaataataaacaataataaataaaataaatataataaataaagcaaaaccctaggaggacagcccctctcagaaagagtaatgaaattgacttcctcaagtttgttaagatataagtaattacaaagtagaaggacttagggaggaggagaaagaggaagggaggacataacacattgcaaaaatgaaacaggagaaaacaaacaggccagacagtagcatagctttcatctcaaaggcatccaaattgataaagaagtagattccaaagaaacaaaaaccagactaatacagatactaactataccactcggtgcagaagcatgaaaacacctttattagtaattaatccattacagtaatggaggcaggtgtgtactgagatggagtcctgttgatgtagatacagggtgtttagctagttgttggagaagtgaattccctttggcaaggagattaaatacatgaatttaaaaatgttgtctgacccagtgatttctctttgggaaatctctactaaattggaaactggaaatgtggaaaatactatactcaaaaagagtttccctttaagctctttggtaaagaatggatttcaggagatttgtacatgtacagctcaatgtgtagctgaaggaaagggtgctgtaaaagtcagtgactatttgtgtaaattcttatacagatcttcacattatagttagctaagaatgagatatgcagtccaggtgtggtagtgtgggctttcaatctctgaactcaggaggcagagaaggttggatcgctatgagtttgaggccagcccagtctacatagaaagttccaggtcagctagggctacactttgagactctgtgtctcagagagtgtgtgaaacagacagaggcaaagaaacaggagataaaaataaaaggtgaatatgctgtaaagttaaatgaaaagaacagaaaaattagaaataaatttgctttatatttacagtagcctgactcaatgaaataatgcttttaattttatcagtgtgtgtgtgtttgtgtttgtgtgtgtgtgtgtgtgtgtgtctgtgtgtgtgtgtgtttgtgtttgtgtgtgtgtgtatttgctttgtttactgctttattttttgtgttaatgttgattgcatgtgcattattgattgcatggaattttgagagggctgtgttatattggatctatggctattaaatacacgtggttatttcaatctatgccatttcaacataaaaataccttcctagaaaaatggaaatttacttagtacacaaatgcacatgccctcactacatatcttaaccattgcctcctgttgattattttcaacttgctacatctcttgtttcagctcatcccaacgtccaaaaggtggtgctagtatcatctgcatcagatgctcctctgcgtggcggcctggaaatctcggttcctgctgatttggataaaaccatcacagaactggctgactggctggtattgatcgaccaaatgctgaagtccaacattgtcactgtgggggacgtgaaagagatcaataagacagtttcccggatgaaagtaggtgcagaatgtgaagttttgccagggcactacgctctccttgggtctctgtggtttatcctaaatttagagaaaacaagcttaccgatattccttatctgctgggtagcccttcagggttaactccaaagagtcaagcttttcttcagttagcgcaggttgatcaaatagaactgaaggctcagtgtaaaactctagtattgatactgtgaagctggacaccacataactgtaagctacctttccatttaatgcgcaatgcaatatagaataatttctaagcctatgtttcatcttagatttcataatgagtacatttcatttctgatcttagaaatgaatgtgttctgatgatatgttttttttttctcttatagaatagagaccaccaagtagcaacctggaaaattctttttccatacttagtatatgctaggctatagcttatctgttatatagagtaaggctgaaaagaatgttttagatagatatgcataacaaaataatagctattgctagcatctaagtgcttaatgtgtgttgaacattttcttactttcacatgtattgtcttgtctatatcataacaatctggtatggtaggtgccaattcattcccatatcaccaagaactttgaacttctaaaccagtggttctcatcctgtacgtctgacccttttggggttgcctaataccactggaaaacaatacattccaattcaaattatgatagctaaattacagctttgaagtagcaacaaaaataatttcatggctggggtgtgtgtgtatgtgtgtgtgtgtgtgtatgtgtgtgtgaccacaacccgaggaactgtattaaagggtcgcagtgttaggaaggttgagaactgttgttttaagaggtcgggaagatgggcatatcaagcagatggttttctctgacaaaatagtttctaataaatgtcccaggggagtgtcagccacatgttagaggagacaggccaaggaggggctgtttcagtagccctgggatcaggaggtgggtttatgagatatttaccgttctatcataggggacaggaggcaggggcttggggttgatcaaatacttagagccggcatttgtgcaagaagtgtttttgtttttgttttccccttatggaaaagttaacttagttctttgagaagaggcatgcgaagctgttcacagcctcgtggacgtaagagtctgcaatcagtagacaagcgtgctcggccgtttctttctggttcctgattcgtggctggggactgttgataataatgctttgctttagtagaagatgaggatggctcggaggcaggagatgcttaagtcagggaaaggagcccttcctgaggggctgagacgatgctgtttccagtagaggaagtagaggaagtagagggaggaggaggaggagaagcggagctccagtgaccctctgagtgatttagctttgagtctgttgtgcagagggaagaaagtcagcagcataaacggaagctctgggatctagagctggagtaggagtcgttcatttggaaatacttactcctgtaggagtgattgaggtctagagaagtagtttacccgcagggagccggctggaccaatcttttggcacactgtttgtaccaactgtgaattgtgttttctaattctttttggtatttattggttctagaattagaatagacttttcctggaattcttagccctcactgtatttatcagctaagacacatagtccatgaaaaaagggtggtttatgaaggtgattcatttgcagttattgtaattattgcttttctaacatgccgttttcatctttctacaccagtggttctcaaacttcatcatgctggacccctttaatacagttccatccataacatcgtttttcataactgtaattttgctactgttataaattgccatgtaaatatgttgggagatggaggcttaccaaaggattgcagcctacaggttgggaaccattactgtagggcatccacatgtgcattcatatctgatgtccaacaggtacacaaggagtcagtagcgaagattgctgatgttttgagagcatttatagtgagagttccttgatttaatttccttagatttgatggaactgagctgggggagccaatggagagggcagatgccatttctggttatggaagacctgagatttgaacctaaggcctctgactccaaatcacatattcttcctctgttacatcgatgatgtttcattgcctcttagaggaagaagacacacccaatacacagctaggggcttatctcaggatgcattaatccctttgaacttgtctccttgcagatcacaaaggctgatttagaacaacgccatcctcagcttgattgtgtatttaccttggcccaaaatttgaaaaacaaagcttccagttcagatgtgaggacagcaatcacagaaaaatgtaagttaaaaaaaaaatgtcctgcctggcgtggtggcgcagacctttaatcccagcactcaggaggtagaggcaggtagatttctgagttcgaggccagcctggtctataaagtgagttccaggacagtcagggctacacagagaaatcctgtcttgaaccccttccccccctccaaaaaaaaaaaatgtcctttatagtatcagctacttcccttaacactcgcaaaaatgtcttcagagattatcctactagaaataaatgttatttttagaagaaaatacttttttctctctttttatcttcaagtttttgaaagtcttttcatacctattcctcccttctgaactcttatacatttaataattttttcttttattttaagaattttttctattttttttttttttttcttttgagacagggtttctctgtgtaacagagccatggctgttcttgaacttgctttgtggatcaggttggcctggaagtcacaaatgcccacctgcctctgtctcctgagtgcggggattaatggcatacaccaccatgcctggccaacattgggatattggtttaaggcatctaatggaataagctagctaaactcatagtcacataaatccattctgccattgtgccttactcacggaaactggctgtcaccatctcttaaacttccgtgagaattcacttcgtacttgctttctgatcggctttcatgtggggatgcctcagttaaaaagaaaattaaacagccaataaaaagaatgggtggaacactaacaaaccagagtctctgtttggagttagtgttggagctgaggatctgtgtcgcatgcggaactggattcttaacgatggtgtctggtggctatcatagtctttctcctcagcccctgtcccctgcagacctggcctgctccggatccctgttcaaagtccctgatatttccagccattaacttttatccatattctccccgcccaacctcaattttgttcttctcctggggtgagattactcagcagctaaagtgtccctccctctgtgagtccttcccacccacacatgctcccctgtggactgcattttctatctttagttcttgccacagcctccttccccatcagtttcctctggatcccatagctgctttaatcttctttcccattcccaggctatgcagactcaccttcctggtctctggtcctcccacttggcagaccatgagggactcagttaaatacacgtgagaatgtaaactaggcgaataaagttgaatttttcttaagggagagcattcggctataggcttaatagatgggtttggctttcaaaataagtggaacaaagtggttcctgatggagacagttagcctggggactttgagtgacagatggcgttgatttattttcacttaaacagccactatcctttagtcttcctgattttgataattgatcaaatatggatcttttatgatggagcactccgatatgagggagcactctggagtcatctttcctccctctcttggtaggacatcttctctgttcacagcaccagaccatttctagccacatttcatttttctttctgatcatcttatcaggactttatttttttttcctgagcaggtggactgctggctgagatcactatatcaagcccagacagtgttgctgactgagcctaggatcttgggcacgctaggaaaccactcttgcctgagctgcaaccctagcacacacttgtgctctctctctctctctctctctctctctctctctctctctgtctctctctctgtctgtctttgtctacctgtctgtctttctgtctctctctctccctccctcctttcctccctctccctctccctctccctctccctctccctctccctctccctctccctctccctctccctctccctctccctctctctctgacaacagggtttctatctcctgaatatcttcccttatcacttatttctgtctctggtctttgtcttctcctcctcttcttcctcccctcgtcctccccactccccaactaattaatcttcatcattattgtatgcaaagagcccttaccagctcctgtggcactaatagtaacaggtttatcatttataatgaataggataatcagtttattttttatgataggccaatgatatttgctgtcactcgatacttcagcttgtatttgtgcaaaccaatgaactgtagcagtagttaaattggccataagtatttagctgagaattagactatcatgatagtttggtcttttcttcccttgagttaaaactttcagtaattttcttacattattaaaacaatatacagcagaggatctcaatggatactttttataaattataactcactgaacaatttaatggaatttatgacatgtaagtctctcagacttctaaaaaactccaagtcgatagcctcatgatttacaatgaccatatgtaatcttaggaattttaccagaatgttacattgtaactaaacccaatcttttcagttttcaaaaactgtacgtgtgtgagtgtttcgcctgcttctaagtctgtatggcattgaaatatgtgaaccacatgcatgcaggtgcccatggagaacagatcagggcattcgatctcctagaactggagtaacggatcgctgtgaacctccgtgatagtgtcggggccccaacttgggctttctgcaggagcagcaactccagattcctggctggagtttgtcttgtagttaagttcttcttgggctcgttcttctgtacctttgaggttgttcagcctccagatgtcactgagccttgtgtttgccattcatgggctgatatggagaactattatttcctggtatttcagcccacagctgtgaactttccttgtgataatgaaccaaagtgtaaatttcgaaaggtctctctctctctctccttttagatctatgatttaaaaataaggataaaagacaggagaggagagagtgttggagagggaaaagagagaagggaaggacaaaagacagagacagagacagagaaagcaggactgagaaaaggagaaatggtacaggagtggggggggggggagccagcatgaaattttatgactgtgaacttataggtacagagaacttgcaatttcttcattctcagtatttctgttgaacttgaacatgtaaaatattgccagtcagaaaggcctcacgctagactagagcaaatgtaaaaagtgttctttgcctgagggattgtcattgttaggcagaaggagacggtgtctttttgttaacgtcctatcctagactgccattaggtgtcattgtcaaaccaggttctgtgaaatacaggaactagggaattgttttctatctatctatctatctatctatctatctatggaattgttttctatctatctatctatccatccatccagtagatatttttgttattacatgactagtgtatttaacataagccgtattcaagtttttgctgttcaggaacaattttagaaatatgtgtggtgaggtagcccagtcctggatgtcagccaagctacttgggataccacatcaggggagctgcaagttccaggctagtctggggaacagaggaaggactaacttacataaataaagcaatttagaagagcaatgtatgtagttcaggggtaaagtggttacttgatatgtgaaatgtcctggatttgagcccagcactgaaggaagaaaaattggtgagctgagcactgtagaataatctcagcactcaggaagctgagccaatagaattggctacatatacctataatggtgtgatgtgtaatgtatttttttacacagtgtacatatttgcgagccatctctccaacccctgtacatattatatagcattacttactataataatacattatactatgtacataatgttgtggcaggtgagcatagagttcctttaagatatgtttatcgtcttccactctttctgtttctagatctatttatagcatatttggaaccaggtcttttccttctgtggtggtcactttaacaggtttctttttactcccactccccagtggaaaagctgaagacccagtgggagagtactcagcatggtgtggagctgcggcggcagcagctggaggacatggttgtggacagcctgcagtgggacgaccacagggaagagactgaagagctcatgagaaaatacgaggctcgcttctacatgctgcagcaggcccgccgggacccacttagcaaacaagtttctgataatcaagtaaggcaaattggctagttttttgatgcagtcatttgatagatttacttgttttatattgataactataattaggggctctcacgttttcccaagttcttagacatacatgttgagatttatgggaatttaatcacagggttcttgttattttgggaagatgtctaaagacacaatgagcaggaacgtgcacttgtgtgagtagagccatagttagcgtctacaaggcaatcctcatttgttgaccctttttctgtctagggagattcttttcttttttttttttttttttggtgtttttgagacagggtttctctgtgtagtcctggctgtcctggaactcactttgtcgaccaggttggcctcgaactcagaaatccgcctgcctctgcctcccgagtgctgggattaaaggcgtgcgccaccacgcccggctgagattattttaatgtataaaatttttctagacttccatttgagtacttctgtagtgtgcaagctaagtcgtacctcagtgtcattctctattctatgtttatcagtagcaacagctttcatgaccaatttcataatagtggtgagaatattgaacactcagtgtttaaagtgtgttatttaaaaattacttctgtagtcacagaaattttcttgtgctggacatgtggttacatactttgtatttgcccttgtgattgcctgagatgaaaatgtacttttaggaagaatgtagtaatctagaacaatgtgggaagaaaactgagaacctgcaaataatgccttaaatctctgcacacgagggcttctcgtggctatcatctcatgggtatcatttaaaatccacctggccacgtctgttagttcctgaattgtcccatgtgtttatgacgcttgtcgatggccccgaagtaagagtgaagcttttgtacacatgactagaaaaacctgatcagcaatgttcaccagtgcttccatcttcatacccagaatgcacttggccttcccatctgtagcatccatgtctacagattttaaaatgaacacatggattttctgttagcttgccattatcccgtgaccacacagtaggacaactaattatgagtattgatgtcattttaagccagttcttcccagccttcctcgtgctgtgatcctttagcccagctccttatgttatggtgacccccaacaatttaattattgttcttgctacttcataactgaaactttgctactgttatgaacagtaatgtaaatacccgatatacaggatatttgatatgtgaccctggtgagaagatagtttgacttctgaggggtcgcgacccacaggttgagaaccactgttttaagcactgcaagtaacccacaggagacttaaagtgcactggagggcgtgcacgtcttattgtgcaaacactatgccattttctctaggggatgtgtgtgaatttggtatctgtggaatggaaaggtttgggagcagtctttcacaagtactagacacagattctctgctgctctaatgaacagtgtgtatgttctttctgaagccttaaggtggatttttctttcacaattgctacaaaaacattacagatacaagtgacacaagtgtccttcttgattgacacacacacacacacacacacacacacacacacacacaccccgcttaacctccctgggttgagaacctgtgaaggggattgtgcctgtgatacactgagcatctgtgtagatagaatgctgaacaaatcttcattggctgcctgatccattccagctgttatctttgcaaacactcagactgattcggagttaaagggcagagggtttccaccagggtaatcttccgacgtgtctctaaatgtatacacaagaactcagtttatgttgatatgattcatgttctgtgagaattagctacacagcaaaaagaatgacaagggcattccaggaatacgagggtttgaggaggccagaaatctcaatgggtaatattttactctcacctactaggcacctgattcctcaggcatgttctcttttaaacaagtatttttattatattttaaagcatgtgtatatgtgtgtcatgcaagagtgcaggtggctatagaggtcagaagagggtgtccacctcccgaaactgcctgggacttcagactaccatggtggaaaagctctctttttgctatttctagaattactctggtttgattgttctgatttaaacttgagagtttgtcctcttgcttccttcttatgatttctgtgtctaaaatgtgctaaatcttttcaggactatgagagttgggtagtcctagttactgagtagccatgggtaggtagttttagttattgagtggccatgggtaggtagtagtagttattgagtgaccatgggtgggtagtactagttattgagtaaccaggggtggtagtaatagttactgagtgaccagttctaactgtgtttcaatttacaccttagctattgcttcaagagctggggtctggcgatggtgtcatcatggcgtttgataatgtcctgcagaaacttctggaagaatacagtggcgatgacacaaggaatgtggaagaaaccacggagtacttgaaaacatcatgggtcaatctcaaacaaaggtaagcctgggtggggacatgtgcatctccttcccgagcatccaatttccttcgctttcccatggaaacaagctaaataggcaaatattagaagtgtatcttattatttttctctacttttaaattctgatgaaaaaattcatgtcagtatattttgtgcagagtgtgtatttttatatcttcttgaagttttaacactgtatttttaaaaataaaccttgctagtattattttaagttttcttatttttttccctatgcctctttgtattatttagaatacattttgtagttctctgagagcacagatagttgtaactacatcaggctaatattagtactaattgttactgtgatagcgtatgatatttgggtgggatactctcaaatgaggaccagacactgtggatctaccacctgacctcagaaatcatctatgtgccgagttttggctaattcattatcttttctttccatcattgtcttatcattatgtatggaaaaacctggaacaacatatgtgtttcagagagggtttcactcacttaatcttgcagggatcgagaaagcatgggcagcagttagcatttttccagattccatgtatgtccatcatcagttaaaatatttatatagcttactgttagtgcccatatgtaagtgaaattatggcttcttttttatgctaagtgcaatttcttgaaaattattttaataccaaaacatatttattttgtaatggataaaattgctaccagaacattttatgttaaaataactccaaaaatttaatggtaacttaacacagaggaatttttgcgtatagatgtgttttaaattgtgtgtgtgcctgtgtgtgtgtgggtgtgtgtgcatgtgaacatgtgtacgtgtatacatctgcacatgaacatgcgtgtgctcatgcatgagtgtatccatgggtgctattgcactcatatagagaccaaagaatctcttgtcgaagggagttggttctttttgtctacagggtgcgaggcttgtgagaatgcacctttatgcagcacaccactaggttggacctctggagagccttgtgagttagattctttaacaaggttctggaactccttgaaggatgagaatgtttacgtgttagatgcttactcaggttctccatagaccctaacaaatacacagctttgccaaaagttaaaggtaaatagctgcaatcttggcagtttcagcagaatagcgttcttgtatcatgccatgttgtttgtgtagatctcataactaagatagggagggaaatgcattaaaaaccacagagatatatcttaaaactgcttcatccatttccagaaattacatgtgtaagaaacatggctttggttttttttttttgtaagcaattccaaaaagttgagcactcgctggaatgaacagtctgctttttcttagcaacattgaggcttttctttgtaaatactctaagacagtccatggctgcagttaagttagacggacgaggcaattaaagacaaattatatcccaaggagatctctcatttatcagcgttgaggtagccacagagccccagttttgtcgtagtgaaaacacgtgcttcactttattctgtttctgagttgttttagtaatgagaattcctattaatattcagacatgatttaggtcatattgttctttatgcggttaggaaaatacaacaaaaccttggctcacagaatccttcctgagtgacagccacagcttctatattgaaactgtgtgtctttcaaatctttaactatcctaaatagacatctcttgggaatatataaaccattccttcctttcttaagcaaggtgtgagattatattaaccttcttttgtgtttttgacattgttcttataaagacagactttagaccaatacttctccactttttaaattatcttccacaggaagcttttaaaactccttccactgaaattttaattaattagtaaatgaattattctgggggcacagcagagtcttactaatgtagctgaacttgcaaagtagctcagagtgggattaaacttgggatcttcctgtataatctttgaagctttattaataatggagtattctgtgagtctgtttccattctatgcacttaagctttttagttagacagaaaaaggagtgagtttttctaccaccactctgggggtagatctactaagcaactcctttgagaccacttgggctagcctaacactgtcaagcttagtgacatagaaagcaaacgacaatttcttaagaccaaaagccggtaacactatccatgctctgaattctgaaacatggaagacaaacttaatcagctgctgtctcctgtgagtgtctgctgtggttttccagtgtggatctgagtgacttctcactgtttctaactgtggtaggcacttgacacagctctcctgtagttcgcccacagccttaagagacaggacgcatcttcctcagcattgcattggttgtaaatggaagctcagaggcagcagagagttccccagagtcacacagctcatcaagcatagctggaatttggatttttgcctttttgcctacacagccaggctcttacttcctttaccaagagtttaatttttcttctttgttatcagaatgtcagctattgctggtgaatgctcgctgtgtgctcttgcttctcagatctgcggttctatttactggtgcttctctgtactgtgtatggagaacagatcagattaaagatacgggagcttccgtgaataatagaatagagcaagctctagcacatggccactgtgccaactctgatggcccccgccaggcctttatcatcacttcctcttacttcacatcatctctgaatatactctgaatatacatcattgtcagcagaattgtgcacaggtgaaggggtatcacacttgcatacacagtaatgttgttagtggctgtgattcataaagtttaatatgagctttcaggggagatgtttggtatgaattgaaattgaccattcatagttaaaggtcctcattcccttatctacagtgtataagccccaagcagccctgataacagacagctgccctttaatgtgagtgccttaattatagtctttatgcagtgggaatgacttcctcctagcagcacgagtattagtctgcttgattgcttccctaaaccttctggaagatgatctgtaatatagagaaatgtatagaaattcttagatctttgctttccttttttaatgccagttagataattacttactgcaaattttgatagtcaagatatgtgtgcacaagttgaatattctttatctgaaatgcttgggacaagaagtggtttggacttgcagatatttacaggcacatgatgaaagatatagaagatgatgctcaaatctaaacatgaaatttattctgttttcaacatactgtgtaagttgggaaattgtagcatgtgtgaagccttgtaccatgccagcactgtaattaattaactaataaaaagtcatgtatattttaaacatataaccagaaggcaatttatataacatgtttagtaaatgaaacagaaatttccaccgcagcatcatgtcagtactgaaatcaattttagatttcagagcatttcaggtgtcagggttagtaatactcaatttatagcaagttttggagcgtggatgcctgatttggatgtgaatggttgtttagtcctttatttttgctctatatagataaaataacactatatatatatatgtatatatatacacatacacatatacatatacatacatatataaataatgtatgcctgtctatgagtatggatgtatatatgtatgtgtatgtatagaaatagaatgatctgttctgaaggattataaaggaaatcagatcccatgactatatgctatggtttctcacaagtcactaattaactatggactttctcttgtcctatcaccacacatgcctattataaggaaggcacttccaggatggtagaggtagagcaagtccagtgtgaaccttgagcaagttatttcatctcgctgggtctcagcttttcctttaaagcggagggcatggctgatgggtaggcctactgtgagatcaaaagtcatatataaacgttcttggttcctggtctgtgctccacaaaagtgcacccaaattaacatcatcgctgtcatgtcttccacgggactgatatgcagacttgtttgtcattctgaatggtttctactgatcctgatggtaaagtgttggattatctgctttaatgaatgcattagagttgcactcagtctttattagtagatgaaacttcttttaaaaaaatccaattatcttacttagtgaaatcaccacacttgcttaatccatgttgtattcaagtgtcttgtgctaaagcacagatctagccatcctggcaagaaaagaatataaaacttaaaggactatggtttgattgagtgccatgcaaacgattcaaactgatgagtgaaataactttattttctttttatataagactgtctttattcattggtactcatggactgggtatatttacatggactgacagaagttttgtgtccactgatgactgagcctgaggactgggcgtatagctccattgtagatggcttgtcttgaggttcaattctcaaatcctgcataaacagggtatagtaacaattgcctgtaatctcagcactcaagagatgtgggcagtgggatcaggagttcaaggacatcctccgtggcaccaggagtttggggcagcctgggacctaggagactctgaaataaatggactgaatttggtagttcctggaccgtagtagttttcacagtgaattttgtcgcgtgtctccaagcttccgttttgttttcctttctctgtcgtgtttgcttattgtctctgtagattaagcaaaaagcgtatattcttcagcatgggccccttttcaataccttttcaatacaaaaaggtattggctcaaaaccttttaagagtggccaatgaaagacatcatatcaggattaccgcttttgcctaccctttggccaggctcaaccactgagctcataaaattagcgactgtcatgctcagtcaatggactttgatgggaagtgcagttagctttttccttcttgctgatttactattatgagagccagaggtttgcatcagtcagctggactttcctcttggaaggcaatttctttcctcaatagtcacctttggttttcagtctgtttcttttgtttacgctgttcacattgagagaagtataaaagttatactcttctacattgttctgttctgctatttaatagtccatgtattgtttttctgcccttaataaagcacagccatcatgacatactatttgtatggtgtatggagagaagattcctgtgttcagtttgtgccaggcccctacatgcagacatttttctcagttttgcatcaaataatatagagggttagtgggcacagtctttgtcttttctttcatttgttttgtttttattccatcagtgaattaatcatttaattaatgaactattcactagtctccatctgtccaggccccaagagagtacagaagaaccaaccataaacatacgtgttccttccaccagaaagctcacattctattaagagaaatagtagaatgcaaacatggtatggaagaagttgggataaagattaacataattgtaggcggttgtttggaacttgtaaatgaagttggcagtgtaatgtaagaacgggactttaaaatggtagaaagcaaaacccagtggtcagatgtgaactttatgaagcacaggcgtctcggcatgagcgcgatgggaggctagtgcgtgataagtctgggagcgacactgcgttggttccaacttaatctctgtacatcatgctttgagagttgttcactgggctaaaaagaacagttgggaagagcagaaaggacacaattgcttttgaaatgaagacattgttggctattgtgatgcagccatggatactgtagtcttcggatctgccttggatgttggcatgctttggtggtttagctgtatggtgtgatagggtggaaatattaaaagatagaatcttatgaaagacactgaactgagagacactgtagctttgtggggaaaaacaatctagaggcgagaaagtgcagacgatttatagaaataatttcagagaactttgctgtgaggaggggacagccagattagacaggaatgggggtggggtgggggtggaaattgaaaacatagtacttttgggcttaagaattccagtttcagtgaagcccagatgaggccttggcctgaggagactaaggtccaagtctggctgattgtatagcaggagctctgggacttggttgaagatgcctttggaacgtggaccggtgcatgtcgggaagggtatggaatgataaaatattgattgataaagtgaagagcaaatgtgagtagtgatctagtttaaataaataattaaaaaagatctagcgagaacgcagcctcttatggaaatgtctgggtggtctgttgttgtttttttaactggcaatggcagccccacagggaagtaggtgctctgctgtgttctacacaaccttgcatcatgagctggggccagagctctcctctttaacttttaagtgctctggcatcagtgccttagcacacagaccccttaagacctgtggggtgaatttttaagtggcttgggaaaggcgcaatctctatgtagcaaggactgctacagttccccaggcctctctgtgcacactgaaaggctttccccacagtatgtgttggtatctatttcagatgaacaaaatcttaggaaattacttccctgtaagtttcctaccttctacttagactgattctgccattttccatgctgaaagagataaatacatttaaatcttctgcagagatcaccgttaaagacgtcaaaattagcaacacacaactgtggctttcctaagaactcgttttgcatcttgtaaaaaaatttggggacaatgttctctttgaccaattataagcatacacatacttcatagaacagtatattacattctgtagcctaaaataccaaatattgcctaacatctttaaaattgcgttttcaaaagcctgctttgtaggtggctatattttatgttacaaaatggctatcggtttgttttatagactatcacagtgagttttattacagacatcatgtgaaagctaagacttcatattttagaaaatcctggttccctttaatataaacgatcacaaatctgtcacccgtggatggccttacatttcctatgtgaagctatttctattttctttgtgtcctatagttggttatttcttttgtttgaggcataaaaatattttagctaaagtaccctgtgtagacttcaaatgttatatcttacatgttttcagcctattcttgctttttttgattttataggtttaaagatttagatttttaaaaagtccctgcttttgtcttctgaactcagatttcctaaagttaaaacttttattcccattataataggatcctttccatacatacggtcatctttgtccttttgcttcttctactccatcctggtcttatttgagacccagcaaatcaagcattgggtgaagacctgagctggacctacagaaccatgtttgtaataaatgaaaagctccaaacatgatagtgtgctctggtagtcccagggctgtggggacagagataggtagatccttggggctcagtcaccagccaatgtagcctatgtggcctgccagactgtgttagtaaaagcagaaggtatctcaggagttacatcagtttgcccttggctgttacacacaaatgcgcatgtgcacacacatatgcaccctgagactctagatgaatgtgggttcagtactaggcatggccacaggagccctaggatcagtgcctctcaacctctttgctccagtaacatttcatgtacaagtagagacacttagtgaagtgggatttcaagctaggatgggaacaacagtggaagaactcttccagctgtgcctatgatatcagcaatggcttacacagtttgaaaaggacccctagagagtctgaaatggctcttccactgatctgctccaagctcttcattctaaggcgagaactgatatatcaaagacttttacatggttcactcgaagccatgttcctgggaaattgcagaagaggcaaaaataggttcttttcttctgaaggtagcatacagggctattaaaaataatttattaacctgcttgattgaatatttgtatatgtgtgtgtgtatatatatatatacatattatctatctatctatctatctatctatctatctatctatctatctatctatctatctatccacacacacacgtgtgtgtgtgtgtgtgtgtgtgtgtgtgtgtgtgaataaaattcagtataccacactagatttggatctaattttagaaacaaaaaatcagctgagctgcactctgttagaaacttcatataaattatattaacgtcagaaatcagaacacaaagtgacatatatgtgtgggctatgataactctttgtgtgtgtgtgtgtgtgtgtgtgtgtgtagttctagaaattaggtttgtgcatgtggtaggcaagcattctactactgagtcatatacagacatacatatgtcctccactataattcattatgacatatgtatcatttagacttctataaacagagtctaaacttcaatattcctttttataattagaaggtgtattgtgtatgtatggtatatgcctttgtgtgtatccttgcacgttcatgtgcaggccagaggagagtaccagaagtctccctgtattgctctctgtcttgtttcctcgagacagggactttcactgatcctttgattcttttactttatcggaagttagtatttacctctgtggtttttttttttttaatgcataagtttcttcgttcctattgctaattcctctcacatcttttcagtagcctggcagtgtaatttttcacaaagtctgccacgttagggaagctgtcacttctgctatctttatcttgaaggcatctctcctggtgccatgcattctgtgtgtaccttcactcaccatactgagtatgtctattcttcttctctcaatgtgtcatctcttcttggatcttatggttttgttctcccttttggagacatttcatttgagtatatcttttgtaagttttgtcgagttaatacagagaccacagagcagtcaaagtgacaacacactcttctctctttgatcccctttgtcaccaccaaatagcctcctgatggttcctgttgtcaggagtcttgtttctttggttctggaattttaccccttcatggtgtatatagtttgatgtagtctatctccaggttctttagggaaaaatggcatttaggaacaaatctcaaaggccagatatccatctggtgaacatcatagttctgcagtatggactctgaggaatgtggaaatatggaaaacaattgctgcctgtaggttgtagaataagtggacagattaaaaagtctatatattataaagtgtagagtggaagcagatcagaatctaaggacctttctagaatacacatgattattttttatatagagcagctcactgtccttttataaacccagagtgaggaaacttgagaaagaatagtctcaaagagatgggttctaaactttaaaagataagtttgatcttgttaagtagagatagtaggaaggacactataatgtaggtataaagtttttacacagtcatactatcaataacattctagaaaatctgaaacattacttggacatgaagagaatatgagagaaaagtagaggttaaagttggggagagaaattggcaaaaagttttagaggacggaacattccgagtagggcagtgtctctgttagggttctattgttgggaagagacaccatgaccatgccaactcttttaaaggaaagcagttaattggagctagtttccagataatggagtttagttcattatcctggcaggaagcatggtggcttgcagacagacatggtgctggaaatggagctaagagttctacatcttttttttttttctttattaggtattttcttaatttacattttccaatgctatctcaaaagttgcccataacctcccccgtcacttccctaccctcccactcccacttcttggccctggcattcccctgtactgaggcatataaagtttgcaagaccaaggggcctctcttcccaatgatggccaactaggtcatcttctgctacacatgcagctagagacatgagctctgggggtactggttagttcatattgttgttcctcctatagggttgcatatccctttagctccttggatactttctctagctcctccattggggtccctgtaatccatccaatagctgactgtgagcatccacttctgtgtttgctaggccctggcttagcctcacaagagacagctatatcagggtcctttcagcaaaatcttgctagtgtatgcaatggtgttgatctgtgggcaacaagagaaagaccatgtcaccctgaccatacttgagcttagaagaccgcaaagcctacttccatattggcacacttcctccaacagggccacaccttttaatagtgccactcgctgtgggccaagcattcccacacattagtctttggaagccattcctattcaaactactacaggcagttcgggtttattttctagacaaatgggactagaggaattttatagagtagctgctgctatgattatgtcatctcggaaggtcacattaattgattcactgttgtcctttgtatctggcttctttcacttagaagcatgaatttgagagcccgatcatatcattgagtgtagtttgtctcagtttctgagtcctatcccattgcttgcatggagtgcgctttactctccacctcctgtttgggttgtttatggtcctggaggataagtcatctgctttccctgtcttgagtttagttgctttagagatttcccccaaatggaatctcacagtatgtgtcctttggaacttggactccttctcttagcctatttttgtggtgtgggcatgttaagttagagtgtttatcaggatggttttattcattctgtggttgagtaattgttcatgtattagcatataatggtccattggttagtgcttccttcagataatgtacagtggtgtttcagtattctgaatcatgaagctctaaacatttgtgtatgacactttgaatgggcgggcagttccagtgttcttgggtctagatagataggactaaaaatatgtgagtgcctttttttcaaattaagatttatttatttggtatctgtgagtgtatatgtgtgtgcatgccccttcctgcctttatagaagccagaataggaattgtatcattgtgccctttggagctggaattacaagagtctttggaccactgagcttgttactttctgagacccaaacttcatcctggtgatggtacatcacacactctgggtcacaggtccatccatctatctagcctagtatccatttaataaaaatagtttgtctattttctcactgtgaaacttggaggtatatacagctataaatgttggatttacaggtatataccttgcctaattcagataactctcggtgctctagttttgatgtagaacttatgaaacattcataaaagcttgtttgttcagtgtctttcagatactattaaatattaagttgatattactaaatattaattattaagtcaagtattattaaatcacattatatttacttagattattagcaaaagccaaaagttattatttcctttgtggtgttgggggttgggcccagggccttgtaaatactaggcaagtgcttcaacactgagctctccatgttagcctgtgtattgtttgtttttaagtcttaaatatttattttgaatttgctcttttaaattcagtgagtgaagtatgactatgtattaatatcacctttgattgacatcccttttatggcagttcatagatttttggcataaatctataagagatcatgttaatgcacaaatctgatatgtaaaatacaggcatgatttattttatgttgtgggtgtggctttgttaatatttctctgtctctgtactggtatctcacaagtcactagacatcctctttaaggattattttagacacacagatgaaaaaaatcacacatttccgtttgatggcttaaaggatggaggttcctctgaggctgtgtgttaattttgtcttgggtgcgtatgatgtatgacatcaccctgaaagtcacagagctgtgtcttctatgttgtttcttttagcatcgctgatagacagagtgccttggaggctgagctacagacagtgcagacttctcgtagagacctggagaactttgtcaagtggcttcaggaagcagaaaccacagcaaatgtgctggccgatgcctctcagcgggagaatgctcttcaggacagtgtcctggcccggcagctccgacagcagatgctggtaagtgtgtgggaagccacaggcagcagtctctcctgagcccctgggccaccagggaactgattactgtttcaaagtgaggaggctgtctgcactttgagttatggaatccgtgctgtcccatgaataactagtttttttttggatatgatctacagaatacttaatatacttaacattaggctgaagaccaccttgttttatagaaataattgtgtatttagagctagagactcagggctgcttggttttctgccattttaagcccttgtgccattagtgctattgaatattaaattataaggtcatttcaccttcatatgaatgggaaattataatttgtattattatatttattataatatatatttattatttataacaataacttgtatttatactacacttaatataaatacttgctgtagaaatttcaaatctttgtgattcagttatagccagatctatgaggctcaaagacattatttatgtatttactttataatcatgactacatatgcagtctgaggttcaaatctcattcttgagaaatgtggtaatattaaagcttttctttaaataactttgtgtgaaattatatgaagcatgccagaatctctctttccattccaagtcatagcccttctgtgctcctgcgtctttttctcttatcgtgggtaaatgcagtgatcatttcttgtcaattttagataagccttctcaattacaacttttaaaaagttgcttcatcaggggcatctcctgtgtgccacagcgacacatcacattttgtctgtatgctgtgacttatttacaaacatgtgaattcatcactttgactactgtcttctgccattgtggtgaacatgcgttttgttatcattgagtgtatgtattttacctaccttagttgctcacatagttctttaagcatagggatgctattcttgttgtttacatgatgtttcaggatcaagtcccaagtaaatgcacttgattctaacttctgcagttgaaatttagtactgttaaccaatttttaatccattcttaagaatgcttttctcttgaaatatctaaaagaccatattataaaatatcagcaaattggattaaaggtctagaggcttttttggaactattactcttaaattttctaagttaaaaataattattattaatgtgttaaaaggagtgttgttgctgtaccttctacaagagaacacacacacacacacgtgcatgtgcacaaacacatgcatacacacttgtacacacatgtgcacacactggcacacatgcatgcaaacatgcccacacacttatacatgtgtatgcacatgtgcacactcacagaaaatttaaaaaacttttaaaacaagtttgtttaatttggaataggcttatttataatccatccttatgtgtgaagactcttacagtctcatagtgaaattaaggagagttagggcctgggaagagtggcttagtaggcaatgtttttgccacagaagcataaagacctgagtttgaattctttgtactgtcaaaggtttagtgtgggggttgcctgatgattttgctgtgggtcttctatctcaagctgtgggtaggagggtggagacaggcaatttcagggtctcaatggccaggcagtcttccctaaactgtgtgtgagctccaggttgactgagaaatcaggtctaaaacaatggagaggagagtgattgaggaagacatctgaggtcagccttcacagtccaagggcacccacatatacacacgtgcacatatggaccccagccaacacaaagaaatggtagaaaagaaagaaaaacaaataccagagaaaatgtctgttggcttgctcatttcttatgcattgcacactgttcttgtgacttggtgatgagtgtgtccaggcaagtatcaaagttaaaggtgctctttcccgtcactctctcgaccctcagaatgactgttaatgtgaattgctaaaatatttcgagaaagtcctcatttcaggaggctgcagtgggcattcagtgtgtgtaaacgctaaaccatattagttttgtgatttaaacaactataaatttgatctacacatgcttgcagatatttaatttatagtggtgttaatttcaatgctgtttagactgtgccccccagtaagcagtaacttgtgggaaggaaggaaggttccacatgaaccctgctaatatctggcctgagcagcacacaggcccattggagagtctagtggtgttttctcacacattttctcttaggatatattcttaccagagctccagctcctctccatttttaatgaatattcaagctatgggaaaaataaatttaaatagaaatggtgggaatcttttaaataaaaataactaagctggggattacttgtcttatggcaaacattgacagcccaaggaggctgttggctaatggatggagagaaaatgtgtacggtaattgcttctcaaaaataatctgatgttgctaacatagtctgtttgggctcatacgaaggcaggcctttgctaacagctgagtcagatatctgtttatctgaagacaaacgtggaatgtgtccaggatgcctcacagtatggtgatctctgtggcttccaccttctgctcttctagattggatactcttagtttatagccctcccattgtttgactaaaacaaaaaaattaatccaatgactttgtttctggcactgtatagatagatggttgttagatatgtagtggcactggctgagcatttctgagataaaggaatttaaattttcccatgggtttgtagtttatttctcgtttgtgtgcatgatttcaaatggaaacgtgttcagaaatggaaaggtatgtgaggaaatcagaaaagacctgaaatcatgaaataaatttactggtgttgagctgctgctggtggtggtgagccagccatctgagatttctgtgtaaggtgtggtgtttacttcattgtactcttgttgcatgatcaggagatggatggatctattctgatagccattatctatctatttatctatctatttatccatctgtcatctatctatctattcatccatctgtcatctatctatctatgcatccatctattatctatctatccatctatcacctatctatctatacatccatctatcatctatctatctatccatccatcatccatcaatgcatccatctattcattcatcaatgcatccattcatctatcatctatctatctatctatctatccgtccatctgtatctatttgtcctgagatgacatgttcactgtttgtatttgattagcattttgtgccaaccagatataaagccccacagaggtatttcatggagatacagtttataccgtgttcagtttaaagatgattctgaatatattttaataaagaagggcttggaagcacaatggtggttgaagcctttctggaccatttcttttatggacatttggtcatttggactcttgtatttatgttttggtttttcttctaggcagaggactttcagtaagagaaaatttgattttgatgacttgctggagagagatgctccttgagagctgaactgtacatggcagggtggtggtggtggtggtggtggtgtgtacctggcagtataatgtatatttaatctgctgctggtgggagatgtcataaaggggattaggccagagagtgaggtattatagcctccaagttacaggaatctagctgacgactctgtgaggaatggatttgtcctcagtgacagagacagtaagggtacctgctaggttcatttgtgctagatgtgatagtagctagaagtacagccctgcaggagttgaaggccttgggaggaggtgaacatgagatgtgtgtggtaatccaatgtagttggtatcataggagaagaaggtaacaggagagacttgtttggacttgaagggatggcacgttcttctattttgattaaagcagaataaagtgttaagagtagcctcccgtagaaggtgccaaatttggctcttttattttaagaagaaactgttgttgatttaaaaactcaatttattaattgacgcatttgtcttaattttcattgccacagtctagggcattcattattttaattacatttagttgtaagctctatttattgcagtatcaactactgagaagtgttagttcttttccggataagcttcggagtccctatggcctttgcggagtggatgtgagaatgtgctggatttgatccgaaagtctttgtctttcacagtcttccgcttgtcctgccctgtgcttgctgctagctacgtgttctacttctattgtaggagacagaagatcgttcagttctaccactgcacccaacttgtggggtgaacccccgtttcacttgctggctctggaacaggaattatacaagttaagcatccccaacttaaaaaaaaaaaaagcaaaaaccaaaaaaccaaaaagctgaaaccaagatactctaaactctgtaagttgttaaatgctaacatgatgtcctacatgttctataccgtgacagtttcttccatgcatagaatcactaataatgctataaaaaccatcctcagggttgtgcttaaggtctgtgtgaaacacaattgacttatctgtaggcttgggtcccacccctggaatacctcagtgtatttatgcaactattttattccatgatggggaaaaaaacaaaaactaaaaaaccaaaaaaccaaaaaaaaccaaaaccaaaacaaaaccaaaaaaaaaccccaaaaaacaaaaaacaaacaacaaacaaaaacaaccaaatcctgaagcttcaagcactcctgggctcaagcctttcatgtgaacgatgctcaacttgtaagttcatattttttatatctagtcatctatctgttatttacatactgccctgtctatgtacattctataattcagttttttgtacactcaaagatgtacagccatagctgcggtcgacatagaacaaacacgcaccccccagaagtccacttccctttaggatcagttcccgttctcaacccttcagaccctgaccttgttttatcactaactaatctgtattcctatctaactaagaacaagcactttccattatgttaatggaatgtctctggctttggcagcctcaccaggaggaggcagtataggttctcaataaggagctgatggcaaattatacatacacaggctgaagtttgatgaaccagctctatttgacccaatctaagaccttaaatcacacgagtgtgaaggactgaggagacagaggaagcaaaaagaagttcctgaaaatgtcattttcctgaccatagcatcacagagaggtgaatgagcagtgttccctgggcaattaggataggccggaccttgataatgagaaacatatgggcttagtttcaggctgtgcccttttgcccagccacttaatcatcctgggatactctggtcctctaagatattgtgcccaaattggttatcatagtgcaaaacgtctctcagacatgtatgtatacatgcacataatacacacacacacacacacacacacacacacacacacacacacacacacacccttcatatgatgtacaattgttctcttggatttcctatatgtgaaattaaaacagcttcaggacaaacagaaagattacgaagatgctgtctaagagggagatggagggtgatgctctacagtcatttgcaggcttcttgttattaacttggctgtttacttaaggggtcctatttgatttctggcctgatttgctcctgtgcagggacctggaagcctatcttttggctctgcctttggagccgaggtaaaccttcatccctccgtaaatatgttcagttttgttttggatgatgcaatgcccagactggcttaaggtgatttattagcacagagtgggcttcagtctgtccttccagacaaatcccttagtgctcctcagtgtttctactcattccacaagcacagcgggagccgcgttccactgggagtgctcgcatctctctgtaaagcctcatgttccctgccacccggtctcctcatgtaaactcagctaccaggcatgcaccgtggccgtgatggggttcactctctgtccccaggggaagtcgcctttgtatctttagctttagtgcttcacttaatatcctctcgtctccggagcgctctccttccctgcagccagcagtgcttggccacgctgcaacttgcttcatttctggccacgccaggctgagcaggtcctggctgtgagcatctgctgggggctgtctgggtggcgttcttcagtgtttttgtcaaatcaagaagttgatggactcccagcctccttttctctagaaccttaaacccccctttatctttcaaatgcatgtctggaaacgagcatgctcagagaactggcaaatcattgtccagtgaccgggaggaaatgatcgctgctcttcatttataatgcaaattctgaggactcttcagaagtgtggtaaacttaaaatgatggcggtggtgagaacgtctctgcagaaagttgtggttttgttacatcgtttacaaaggatggcagtttcctctccgcggtaccagaagctctgcaaggtaactgattggaaatagggagtgggtgtctgaagaatccactgttgcctggctaggaaatactcatctttcaggctcctctgaaggaaaggaaaaactccctttccaggcaactgattgcaaaagctgttaaaagaaatcgctccattaaaatttatttaagcctatgagacaagtactattttagtacatattttattttaccatctataacctagtcttctgagatgggttgtttggagaaaatatgacaaactattttcattaagacctgttacctctggggtactttacaatatcttaatatttaatgacacattaatacaatgttaagctccagcaaaatcaagcagagagctcagaatgctctttcaacagattgcttaccgtgctcttctttttatagctgatattttccaattaagaaaagtaatgcccattttaaaaacaagcttagccccattgtaaacatttcttatattcttgtgtgtccacatgtcctagttaaagttgaagaacacaattttctgtggccaggtgggttaagtagtgttttaggatataacttgtttgacagttatacattttgaatgcaatgtcagttattctaaacacaagccgtcccacgtcctcctgtgttgttttgggttagtatttgttattgcccatggtcttatcttatttagtgttcgtactgtctccttatttttataaaaacaagatgatatgatgcaaaaggaagattatagcagcagcaaatcaaattttatgttattacaattttctccctgtacaattcttagtatgcttctaaagaaggaatcttactgttctttaaaagatcaactgatcagtaattgggaaaactgcctcttatctcattatttttctgaagatgttaaatttgatgtgttgaagcacctaggctctgcctataaagcaatgggtctaggctgggaagctggattctgttaatttgatttttttttttaatcacagtgttgtgctttacagtttgtctaatttaatatatgtctgtccagaaacttactttttaaaatataatcttaggaaatcgattgatatagtgagacgtgctttaaagagatgctatattttcatttgtgttaagttaattaaagcttgatccaacttattaatccagtcggaaaagtacagaactaactgttggatatgttgagatttcatctgcttaaagaatccgtgtgtttttgtaagatgtttacattttcacaaaaagccaattttgataatggagaagaaaaatgcattcactaaataagtattagtattttactttttaagtattggtatagatacatgaatcattaatatatgttacttttttaaagctaaggatataaatgtatgaagcattaaaaaaaagctgggttattatttttctcatctattcccataagcactttcacaaaagcagaggggttttgagctgtaaggccattgggtgcgttgacttccacacataaagcaaagttaaggtgctggagaaagctactaagtagtcttatgataagaccctgaataagcacacatcatgttactggagtcatggggaagttcacttccaacaggagtattctttgggaagatttattgagatttgtaatttctcaaagatgccttagaatttaaatcttcggcacgggcattactttttgggaacctgaggttgtcttatttgcaattgaaatttaccctttatatattctctaccctatgtgaaattagctactgctcagacagggagggggggggcacacacttccagtactttccagtaggtgtcagtgtcaggcagtgatatatgaggtttggggactccagacagggaagtggcgtgatgctgttgttgactatgaataaatgaactggtagcaggtatcttttatttatcttattgtatgtgggaaatggatcctaatgcatatcattgtggataaaattataggtacagacttaaatgtcagttgtccttctctgttaatggcatggtatctatatctactgagcctacttgttaccagtgctgtcactgtgctgcaagtttgaccagctgtactgtttatctgcttagcgagacactgaattctctttatttaaattgcaaatgttgttacagctatttccccctatatcccttacattctctaaatttagtcttttagaaaggaaatgttaaatacttcagtgttttgccataaaaaatacagaaagtctatatttcaagtacatttaaagacgagagagagagagagagaaagagagagagagagagagagagagagagagagagagaagagaagagtctattttgcgttcatcttggcattttgaaaactggtgtctgaatatttgtaccctcttcatctttcacatctttcttttgtctgttgtatgggtatcagtcatttataagtaagtgaaaaacgactggaaaattgtgcacagtattcttattttgagttttatttatttgtatgtatttccccctgcctatttctcatagggaaagggacagggatgggcagaacttggggaaactgtggctctgagtaacccccctccaactgtacatggtgttgtattttttgcttttaaaggtgtttctttctggttatacaatccctaaaatttgggcaggaaacagaaacacattggctgctgacttgagaagcagcagcattgaaattgccctgatgacctcgagccaccccacgctagatgctaatttctcctgatttggcttagatcacttagcttctttaaaatattaatgactctagaggataatttttcctctattagagcacagtggacacaaagctggatgtaagtgacttttaagattgctactgactttaacttgtttgcattttgtgattatcttggcctgttttcagtctttgaattgaaacctgattgaggttatgttgagttagagaggaattttataatcccacccccacccccaccccctcagggacatttttaatggcatatttaataattgacgtggtaaaaagtagattcttacaaggtagattagtgggtgagtcatagaacattgaaaaataattagtattataaattgagtccttcatgacttcagcatttttattgatttagctaattattttgatttagttttatgatttttttgtgctgccagcatatgtatgtaaaacagtttcgctgaaataattttgtgcccaaacattttgtcatgtgtcctatgagttaaaatattttaagcatcctggtgtatattattaattcaaggttgtgcacaggtgccatgaagaaggaaacagctgttcaagaatcatagagtgttgatttgttcgtgtggtcaatattgtcttcttactgcccagactgattcgccccttcattctgtgcatttttctcccaccattggcttattagtaggggacaatgacggcttggaaagccagggatgacaagtgatgtttaaacaaaatcagtttctcctccctgacgtctgtatatatgtttgtgtgtgagaaccacatagaccctgtgtgggtacttttataaagggtaactctataactgaacatatcccaatcactcagtgtttgacatgacttttaagttcacatgctgcctggcatctgtatgttaatatgaggttcatataaggtcaagcatatgtgctggacagtggtggcacatgcctttaatcctagcacttggaaggcagagacaggctgatttctgagttcgaggccagcttggtctacagagtgagttccaggacagccaggactacatgaagaaaccctgtctcgaaaaaacaaaaaaataaaccaaaacaaaacaaaaaaggttgaacatatgtgttttgggggaaaaaaatagaacacgtgagtggtgcattttaaaataagccttacaggttttactttcaggtggggtgtgttgctctccttggataactaaaccctgaagtgtttcagagcatgaaacaagcttgacttggccacagtctgaatgttaagacagaggtattttaagaccatctgtcaggctcccttggtttctctcagtaaccaaaccgtacacatatttcttgagccacagtaaatggacgtcctagcctgaggtccccttgatcatgagtcagttcttgctttcatgagaagccagtgggttgggtagttcagaaggtgtatggaggtggagatgccgtggagcaaaatggcggatgcggagggattcacatttattctcccctttccttggtgctgtttgtggtgtctcatcagagatgtgtgaactcccagaacgagtactttcttaatgctctgtcttctgcagttcctgctgaggtccagattactgactcaaaacaggagaccttcctccctgcctgtgactgtcacaggagttttgttttgtggcttcccaaaggggcagcagcttagctgatctgtgacctccctttttaccataattcctcatatcaacgcgaatgtcaaaattatcttttattacttaagtagtaacatatcgttaatcagaaaacccatgttaccaatgacttcacttatgatttaatgcagtgctttttacatgattaaaaaatagccgggcgtggtggtggcggacgcctttaatcccagcacttgggaggcagaggcaggcggatttctgagttcgaggccagcctggtctacagagtgagttccaggacagccaggaaaatacagagaaatcctgtctcgaaaaacacccccacccccaaatgccggtcacaaagttaagtggttctttaagaacaaaaaacgttagttggaactctgcgtgactgacgcggatacagtagggagtaaacagaaagttctttctgagaagagagctggcatagcactctagattcagaaaatgctattttgtcatcgtgactaaaagcttgatgacttgtgtttcctctggggtgcagtttattaagtatcaaatggaaatttccagcctgtatgtatggatctgaaagctataggcacgaaccgctttctcttggttctcggcagagccctgctggcctttcaaagggaagttagttgtttatatttagctctggaaattaagcaattagcagggataggagaatatagacaatgtcacaccattgtcgttttctcacttgctcgaagtttgttcatctcaggcaaggtaaatgagtccaagtaattgaagttggaaaggatgtggagtgtgggagaggattgcttttcatttttctttttctagtttgttcaggtctgtgaagttctgaaagactgatttgtaacaaagctcagtcacagaagcggacagtgctttttaatgcttaataaataattggccgctgtgacagcatggcctgataaagccggaacggaatccctctagaatggaaagtgaagtagttgggtcaggcctggtggtacaggttctgtactctcagctaactgggaagctgaggctggaagattgttccaggcctgggtggtttgtagagtgaactgaaggtcaggttgtataacttagtgactctctgtcttgtattgaaatgttaaagtatcaaagctttgtgtattgtgccaggtgaacatttgcctaacatatgtaaggccctaagggcaattccctgcagttgctggaaggtgttggttttcagggtgggtgcctccttctccctgctcttcctccttctcttctccctcttcttcctccttctcttcctcctcctcctaatacatatttgtgcatgtttattatagaattggtagacagtttctgtgtatagacaccatgaccttgacaactcttattaaaaaaacaaaacaagacaaaacatttaattgcgctggcttacagtatagaggttcagtcccttaccatcatggtgggaagcatggcagagtgcaggcagacatggagctgagggttctatatctggatcctcaaacagcagttggagactgtgtcacaccagccacatttgaccttatgctacctcaaagcctgccctcacagtgacacactttctccaacaaggccacacctcctccaaggaggccacagctcctaatactgtcacttcctatgggccaagcacttatatacatttgtgtatgggctccatacctgttcaacaccacattcacaaaagtgaccatctcttttgagacaggatcttttattggcctgacctcaccaagctgtccagactggggtggattctccctgtttagacttccctagctctgggattacaaagacagtgcacacacaccaccatacccaacaaacatttttctgtggtttctgagaatcaagctcaagtcaagcactttatccagtgagccaccttctcaggccatatttatggtgtctgtattttttcctactgtaaaaggactaggaaaacaaaaactgttgacatagaaaaccacagcacaataaaaattaacaggaaagcaacaaccctagactccatgggaaagcgtctaatgaaacacggacagagacgcctaatgaataggattgtaaacgttctatgtgtttttaagatagtgttaatatatatttttatatgttttatctatcatctatccatttatatatcttctatttatctatctatctaatttatatatcatctatctacatatctttcatctatctatctatctatctatctatctatctatctatctatctatcttcctacctatcatctgtctgggaaagaaaattgtcaccagttctatgtaacatctggagaaacaagctcttttaactccacagtgaaggcacagagtaggcgatgcttggccagtacatgatttaactggcactgttgacaggttttctgattccagattcagtgtctctctgcatttcatttcaggtggtcacagtggttatcctgagctacaaagaaccatgcggttgaggggtaaagaaagagaaagtagcttaagtcattgctatactttcttttagttatcattcgttgtattttcactgtactaggaaggaaatcccctgtgtagatgtttcatcacccgtagtcttgggcatgcctaggtacttgttctcatcttgaagttgaaaaaacaatgagcaactgggctgtggtggcgcacgcctttaatcccagtactcgggaggcagaggcaggtggatttctgagtttgaggccagcctggtctacaaagtgagttccaggacagccagggctacacagagaaaccctgtctcgaaaaaccaaaaaaaaaaaaaaaagaaaaaaaaaaaaagaaaaacaatgagctacattatttttgaaactattttggctatatgaacgtttttgtttccagtttctataggctttttttttcccccctaatggattcatttctcagctttgtacaaaggatggattggctcattttaatgcaaattgatatagttggttctgggttttgattcataatttagcttggtttgagtctcaataccacaagtattgaattatgtattccccaagcctaattctccatacccaaatgtagttttttatcatcatatttaagacacataatagcgcctttagaagataagtgggaaggagccagctgtggagcaccttgttttagtgaagcatcttctctgttttgaaagtcatgtattcagtggttctcatgcaccacatatatgttcagcgtgcagggatgtgccagctttgtcagtcccagaagttcatttaagttgttctaaagacatttaaaatattttcttcttatgttttttatttgtttgttttaaaactttaaagctttgtttttattatttttgaagtgtgtatctctctctctctctctctctctctctctctctctctctctgtctctgtgtgtgtgtgtgtgtccgtgtgtgtgtgtgtgtgtgtccgtgtctgtgtctgtagtgatgtgtacatgagtatagccagagaggcttggatcctctggagctggagttacaggcagttgtgagttgcttaacataggtgctggcatccagctgtactactcggaaaggcaattaggtgaccctaatcctctgagctagctatctttccagccctgtttgttttttgaggctgtctctgcatatgtagcccatgatgacctcaaactaagcatccacctgcctcagcttccagggtactaggattacagtctcataccaccacagccatttattttaataattaataatagtagtaatggtatgaacttttgaagaattgttgtgagtcaaagtgttcatactagtctagaataagactatgtgtattcacataattttggcctggtcatttactacgttgacatcaccttgacaaaccattgacaggatctatagctcagctgtctttccagaaaatgagagtccagttaatctctctgaatttcactaacatcttgaatctttacacaggctgtatgggtattcattgatcaagggagatgacctagggagtgtgcccataacttcacgtgcctgtgtgtggtattgttactttcctggtattctctaacattaaagggaccaccaaatcctaataaggaagtccacagcataatggcccggggagtgcctctcaaagattcaaaccttgtagactctggcttcctgagatgaagtctgggccatcctcagcagggctaccttacaccactgttctctatagagaataaggaaagagtgctaagagtgctacagaggggtgtgtgtgtgtgtgtgtgtgtgtgtgtgtgtgtgtgtgtgtgtgtgtgtgtcttggtttctgtttgcagctctgcttgggaaagtccaggcaatcctttcccttgaccttgaggtaagattcccataggatatgcattccccagttctgttcactcctctggatttccaggctcctccttattgcctataatctttgaagcctacaatacaactatcatgcactgatttagacattattaagagactctgttctttttaaacaaagccaggaaagacatcacttgtcctgggaccactgtaggagaatacaacacatttacttagagatagagaaaagcaaaaacttcttaaatacatttttcagtatcttgaagaatgatcactgttttgttttgtttctgttttttgagacagggtttctctgcgtaacagctctggctgtcctggaactcattctttagaccacggtgccccaaactcacagaggcctgcttctgcttcctgagtgctaggtttaaaggcatgtaccaccacacatagcagaatgaatacattttgatatcataagttttgaccaaacacctgagtttttttgtttgtttgttttgttttttgttttgttttgtttttcggtgtatgcctaccattaattagctaagtaggcataatttttttttccaaatagttaattagttaactaattttgaggcaggatctcatctcatatgtcatccagcctcggcatgcctggagctcatggtgacctgagtgagactcactgcatagcccaggcttgtctgggactcactgtatagcccaggctgacccaggactaactgcttagcctggacttgcctcagacatggagtaatcctgccagctttgcctaccaagagctgagtttacaggcatgtgccaccatgtctggcttactatgtgtaggcctttaacaaatgctcttgctaattgttcaatgtattttataaaataataaatcttacttttaaaagggtaaactttacagaacttagaggaagagaagaaggggggaatttgattagattgagaacatttcctgtatgtcttttggttcagaatctacaaggatcacagtgcctatgcccctgacctatacaagctgaggggacaggcttctctaagacttgcttttatatgcaagctaagtaggcataatttctttgctagtgagttttctccttgcatgtataacttccctttacatcttcatatgttatgaatgctttcccctgggtcaaaaagtatttcttacattgtgatttttttccctcaatggtgtaaataaaattcaattgaatggcttcaatttgccataatttatccaagctttcaaatgtggtgagatgcatgcttgttgccagtgttctcctgataaattactgtgtggcgaacatactcctgcattcctgactgcatcctgatgactttcagaataccttcatagaatacaacaactgcactaaaacgcagaacctccaaaagctcttacacgcaaggtcaaattccaccttgtgaggtgccacttgcttgcacgctctctcccagctgagaggatgaatttctagcatgatcacaggcagtagcaggtgtcggttaaatgattttaggaagttattagatcaaacccccccatttggcaaagtagagaaccacatattctgtccctgaatggactgctgagaacccgaacactacagggcctacatgggcatgacagagggtgtgtggtaaaaccgaacctaggacattctaactgaaatgaccgaagtgtttagggaaaaggcagtacccaacatggatctggagggataggtagaattgtagagaagctgaggcttctgggaatagataagagaacaagcagatagctagagcattgaagcatgctggttgcatctaggggaccgaggcatttatttgccagagttcattcattaaaatattgtaatgacattgaacaagtcttttggtttccaggtgtgtggccctgactcctccaaattactgaagtttaatccatgagatgctccagcatgaaaaacatctctggaaaggaattataaagtttggaggagtgggtgtgtgagcgtgaacattcatctgtctgtgtgtgtatgtgtgtgttcatgtggatttatatatctaggggcatgtacataggtgtacttgtagttgtggcagattgatatcaaatgtcttctatttcttactgtaatcttctatctatgaggaaaaaatatttttttcacaacttcatgcatgcacatgatgtattctgctcaccccgcttttcccgtctgtccctataagctcctattcctagctatttcccccgatttactagtttggcttttgttttataccctgttgagttaaagaagggtcatcagtgtgactctgagtttggaactaagcatgagagcctactgggctcaccagagcatggacctggacactgtctccctccaagagtctgctgcttgctaatagatcagcagaattgactgtgtcctgcctgttcctcctccctccatagctaacagaggccctgacttctgtggacacagtcaaccttgtttttgggataggatctctcactgaacttttacactcaccaatttggcaagaaaggttatctagagagcctcagggatcccctctctctgctttcccactaagattatagacctgtatcaccatgcctggccatttacacaagttctggggagcctcatcaagtgctcagacttgcctagctaacagtttattaactgagccatctcttcagtcctgaaaaggaattctgaaaactaaattgcttaatgtctgtatatttaaggcaagaacatagttacttatgatgtcttctttccaagggacaactttcctctgaatgcaggactgcaattggagtgacaaaaagctggaaggcaattgatgaggaaatgtcatggtatttcaagcagaaatctaaaaagaaaaggagtcacgggaaatgtgtctattattaacttagattctagacttatagaaccttagggtttatagaatggttgaaattatttaaagttttgtatctgaagaggcaattccttagcatacacatagaacttctcaagtgagtgtgaatatggactttgaaggtagccaaggttgaacagccaagtggtcctttgcagctcagctttcagggatttctctgatatgtatatttatatgtgtgtatatatgtttatgtgcatgtgtatgtatgtgtacatacatatggatatgatcaatatgtgtacatgtatgtatgtatccatatgtatgtatgtatatatatatacatatacatatatatacacacatttgcatgttatgatgatatatatgcatatttttctcacttttcgtagtactacatttatctgtttgtctgttttaccttttcaattatgaactttttaaaatttggggccatgtcttattatcagtatcttttgatccttagaatactgaacaatatataaataatccgatgttcagaatgttactataataaagcagaaatgcaatatgtaatggctccggtttcttttttataacagctttattgatgtgcaggagagatggcttggcagttaagagcacttttctattctctcagtggaccagggttcagttccaagcacctgcatgaggcctcagaactgtctgtaactgcagtaccagggaagaagctgacagcctttgctggccttgccgagcacaacacatgtgtatggtacacatacacaatgcaggcaaacattcatatatataaaatgtaaaaatagatcttagaaacaaagagctttattgaaataaaattgatatctagaacaatttattctattcagtaaaataaaaataaaaatttatatatttagggttctgcaaccaccactacgagtttgtttgtgaacattttatgaccttctaaaacagatagatacccttccttatgttccgtgtctgtcaacctgagacagccactgcctttccttagcttttcttccattaatctatatggaacacacacacactcacacgtattttaaatgtttatgtatgcctgcaactgtgaaatgcacacgtgctggcttctcacagaagcaaaaagaggctgtcaggttttacttagggttatagatgattgcaggccaatggatttgggtgctgaggaccaaactcctgttttgactctcttaaccactgagtcatctctccagctcccccttttttttagtatgtgattcagtttgtcaacattgcaaaatagaaagtcatggaaaaccccttataattttctgtggtaaacttactactttagcttagagaattctatattttgattttgtttgtggggcagtcttagcttggcttgtaattcactttgtagaccaggctggtctcgatcttacggaaatctgcctgcttctgcttcccaatgagaattcagtacagtttaattagaaataacaaataagacacctaagttcaatctttataaaccctatagagctatatataactgactttccataataattatataagttcattaagcataagaataaagggggaaatgctgaatttgaaatcagaaggcctatgtgacgcaacctcatttgccacttcattttataaaaggcacatatgacctatgaattcttgagatttctcatttaaacattccataacttcaggaaggtctcattggcctggtatcttaatgcttttgaacttgccctgaagagctaaagtattattgaaactgccttttctatgattcccttttctacaagcagcaacactgataatatttatctccttgtttaatcacagttcatttggaatataacacacaacccaaagagtctgtgtccgtcctcgctcacttagcctactgagaactccaggtccttttgtagttcacggccatttcagctttcttcttcccgaagcttatttccaacttccttattaggatacattttctgccagtaaaaaccatagtggtttttccaaacacatccatcactaattagaacttcacacattgtatcatgtcttaagagtctaagaccagtggctaatggcctctggggcaacatgctttgaaatcatcaacacaaaattaggggcagctgtgattgctcttttctcttccttctctggtttccttccttccttccttccttccttccttccttccttccttccttccttccttccttccttccttccttccttccttccttccttccttccctccctccctccctccctccctccctccctccctccctccctccctccctccctccctccctccctctctctctctctctctctctctttctttctttctttctttctttctttctttctttctttcttttttgagataggttcacactgtaagcatggtggtccaggaactactatgctggatctggctgcccttgaattcacagagctgagtattggttttgaaggtatgtactaccataccgggccactttggtttcttaagtccatacatcaataacctcagatgctcacgagcactagggaaggctgcaagaagattttccttgagttttaatgataattaaacattctatacttctcatattttttctgtaacttctctattgagaataaggtcttgatagttgatgaagaacttgaattaatgaccacagggatagtcttggtttgccttagttcttgaagccaagtcctcattacttctttgcatgcccttccagtgtagaaaaatctcatgtggtgtggagtggaggtaaagtaggagtaaacatggcctctttttttttttcccagtaattgcttctaatggaagcctaatgacctattatgcttatttcgaagagcggaacagcttaataggaagccggtgaaggatttgagaaattatataatagaaaccaaaatttcaggaactcacacatgtggttgagaatcaatacttcattagagaatttaatgattcagtggtttgctggtgccaaatgtcacccttactttaaaagccgtaggaacttgtagatgaatattctcaggagtgaggaccaaaggagacggctgtgcttttgttcttgtaggtgtttatttatttaaattctacatgtagacaataaaaggtgaggagagtagaattttcttacagcattgaaatattattaaaatttaataactagaagtgaacttgacatttttaaatttagcttcctctttggtttctttgttctgcttttatgtttgagacaggaacttgttagagctcaggttggcttcacaatctcctggctcagcctccccagtgcttagagtatacacttggccttagcttttgcattttgtgtaaaatccatggaccaggtgcgtcaaaaggttaagtgatctgtcctaactttcatcaatagtgtcagcagctaacttctctcatggcgatatactctggttgtgggttttatgatacgttacatctaaagtgggctttgtaggtctctgagatgaatggttaacctcaaatgatatacctgatggttgtaaacatagcttttggataaaatgttcatgctaacagtttaactgttgccaactccagatgttattgtggttattttactaggctttcaactgttttgtatacttgagtgtttttatgatgaaatgctggaaaagtagcagccattcaatcataagatgggtcagtttcctgtaaggtgcttatgggccgctatctctcatagccaagttaagacagtgatacgttgaaaatgcttgaaaaattctccatttacctggtgataagtatttgcagaacaaatccatagctctcatgctttgaactcaaactcaaatgaaatatattttacatcactatctgttctttttacaaaacctgcatatacctcctatcaacatttataactttgcaaaaacatgagatacgatatgccataggtcacaaattcctgtagagattaaaaagaaaataatcttatttctttagcatccagctgaattcctatttaggcacagtttccagccctttctggaaatgttgacatttctttgggacttgcataaggggtatgcatcctctcacacatattgatgcacatgctgattttatggttctctattcataaagattcaatttgcagtcctcatctttatttaaggcacatcagttttgtcaaagaatcatttatttggattaaatgactgtatagctcatttgtgttacattgttttattttgcttttatcaattctctgatatcatttacgctatctatttcataagttgacttaatcacatctagagtggttctttcagaacatatgttagtatatttttgggggtatatgtgtgtacatgtgtgatgtatgtaagtagatatgcatgtgtgtatttgggcgtgcttacctttgccagtacatgtagatgttagtatttgatactggaatctcttcaatcaagcagaaataataataactattattattacttggtttttgacaagaaatgttattggacctggagctcaccaattcagcgaacacttgggatattttttttctctgtcatttagccctagattcaacagacctgtgactctgaaatcacatcttcaagtctttcagcaagaatttacctagtgagtaaatttaaatgagcatcttctcaggcttcgcctcattcctgtttgagatagatagggtctcaggtctgtaactcaggtgagatagatagggtctcaggtctgtaactcaagctgggtcggaactcaggttggttttgctctcccagcaatcctcctgcctcagggtccagagttcttgttactcttaaaattttcaagtaattaaaaaaaatcttattatttctagcgtgttctacttcactgtataaactgacattctgtaatattgcaaacattaagttatagagtatggtatagcataggatattttgatttccacacatgaattggatgtcatgatgtgacctagaaatagctgagttgttggaagattttacattctatttatttatttctcacatctagtttgtgtgttgattaattgctcttgattaacttccaactccttaaagtaaatcaaaattaacaaatatttattgcagcttgctgaaaatcttgtttacgccacatagcgtagttgaagtctcacttttaataaaggtcagaaatcaaacactaacatttaaccaccgcgtgtatttcctgatacagccgttacacggggaagtgagtgggtgcttcagtttggaatcagagagaggaggacactcatttaaataattctgcatgatttttttgttttttgtttttttaatcttgctggagattgagtccaggctgttgagcgcacttgacaagtgtgttaccacagggccacccctggtgcgacatgctgttttccttttcatgatatcagatcctttgagaaataactaaagaattgtaaaacagctaaatgaatgaagggaaccctaggcaaggaagggtaaaggggatttctggacataccttgaacagaggagtgaaatgggtgagaccttaactgttacaagtaagttattatttttgttgttgttgttcatacttgcacttaagctggtttctctaaagtatgaaatattgttttatggctttgtgggggtagggcttaatggctaactcagcaaagtgcttgctttgcaaggacaagtgactcagttctatatccaggatccatgaaaaagggctgtgcctgttggtatgtacttgtgagctcactgatgggtaggcaaggactgcagcatccttgtgggtcactgaactgcccacgaccagttatgacactatctcagaggagggggaggaggaggaggaggaggaggagatttcttgagggctgccttccttgcacaggcccatatcatatacagttccatgtacatgaacatgccgccatccccctttcaaagaaggttgctgacagtgttattgagaattgtcttctgtcttccccactacatatgcctccatatccgtgaacacacacacacacacacacacacacacacacacacacacacacatacaccatattaaaatgcttttagtgacctggattttagtagcaatgaagcattttgacaatttttggctatgcatattcatcatatagatttcattagctctaaaagtggaatttatagtgtaactcctggatatatgaaagagaaagcacctgttttataaatatctaggagggaagaagaaaagaaagctgaccagctcagtttgctcatcagagagcaacactagtaacatcgtatttcctttctttttactcagttatgcacattgaacacactgagatagtatttcacacaatgtcttctgctttcttaagtaaggattgtgttggcagcggtgatttgtttctaacggattttataagcattttagcgtttctttatttgaaaagttgtcattgtagcaatggctccagtcccacagtgctctgtattttagaaaatgctttttcaatctgagtttggtcttataatgtggaaatgactcccacaagttattcttagacatatacgtgtgtgcgtgcttcccataaaaaaaaaaaataagtgtatgtttaaaaaaatgtaagacaagctactagatctctagaaaaatccaattatttatttttatctgtgtatctatgagtgactcattattccatagtaaatacattcttgataccatgaaaactttctttttctgttatgattcctcctatgagtgcagtatgtggaatatttggtggttgtttttcagctttgaatattacagtttgtggcatgtctaatggcttttaaaagacaaagcaaagtcattaatgtccacaagtgttttatctgagtacagagtcctgtaatgctttcagaagagggtcgtcatcacagccagcctttgggtcccccgtggctccctattgttattgtgcaaagctgtactgctctgaaaaatcctggttctctgtgaataaagcattctctttggccctggcttgatagagtctcttagtgtctgagcctggtggtttgtttcagctcacagcccccaccaacaccatcattattgtctgatagttgtatgtagaacaccatggtatgccatttgtgacaaaaattaattttacatatagtgaaattttattgtgcatctgctaaaggtttgccttgcccgtgaggatgccagccctggcgtctggcagtagcacatgatagtaaggagcgtctcctgaggtgattcagggtagaacgttgctatcacttgaccagttaggtcacagagttcaatagatcttccttttcaatgtgaccataagacctcaactctaagcctatttctgttcttctttcattatgactcagtaacttttccttatcagctttggcaagagagcacctgtcaattacttggagaaactggctttagaaatgaatcgatattctatttgtatgtcacctctgctttgaaaggcgccatacaatcctgcattcttgcaaccagtcagcgttagttcctcagcttcgggtatggatccacttgatgttctgcaggtttctttcaaacaaccaaactaagcaagaagtctctccttaggctgctgagctcctgtaactgcagactgagtttcctgatatttaggttatttaggagttgagaggaaatcatcttgaggattccaaacagcatttgagtctcatttggaatcttcctgtcctctttgcaaatgctctttctttgtgagttaagaagaataatatttaagttgtgaacaaggtgaatggtcgtgaagttcatgttgtggcatctctttatggacattctcatgagatagattttgtgtttcttattttgttcttttaatttgtgggcattttcttatttgctcatgggaataaattctcattgtacactattgacttaaaacgtaataatcacacatcatatatgagctcaatgttttattcaaggatagcccaaaagcactgttagacaccggaaaataacataacttgtctttgttagttttgtgtggtgacatcgtcctacacaaaacacaactttagattgtggcatatacatgtgcagagggagctgttaattcaaaccaatgagagctggtaaaaggggaaagggtgctgggtggtgtgtctaggatctacagtaatcaccatgctcagcaacaacatctgttgctggcaatattggcaggatcataggagaaagcaatcattaaaattagctggtgcttgctttaagcaccacacagcgcactgacattttcaatattttctctagttttatgttttctcattccacaagtatccacctggttttgcctgaacggcttctattatgtctttttaaagaactatcctctacctttctttctgaatcgattagaggctatagcttgtgtctccagtgggccagagtggcctttacccctcatattgcaactgggtaccacagccacctggtttgcatttggtctcactgagttttaagaattgtagtgtgaaggagactcattaatttgtcttattttagttgaaggggatccatggactagatagagtatattggggaaaattctgggggggaggggaacaacttaatgtcgtggccttcttggggacaaggggacaatgctgtcttttctgagcctctcaacctctccttcctttccctcacctgttcaaggagaggaatggcattgtgtttttagaagttagaatttgtatttctcctttcttggtcagacagatgacagggacacacaaaggcatgcacgcacacatgcacttgtgtctacattttctctgtctcttgtttttattttattttatttttagggacagatatgatttttgagactaaatattttgtaccaaaaatgtctttcgagctgcctctgtggatgactttctgtacactcccttctttcacaaggcaggacaaggctgcattatttgccaagaagtgaaatgagtatagagttggaaagctgacaactcctaaccttttagggtgttaatgcatcaatgcactgttcaatggttgatggagtcttatcattcattcatctatacccagattcatttccaaagcccagggacaggacacaacaatagacaaatttgatcaaaaggtctagctttctccaaatccccatttcagctgggaaggaagcccagcagtccttggctgagggctggctggggatggagcctggttgctgagtgctgagaagagaccttcactgtggactcatcttccagctgtctgctttgcttaaataataacaaataacccaactgctctctggagagatctctgttctacctgtgagcccaggaaacatcagcttctcatggattatgaatgctgatatggttttgtgaaggagtttcagcaaagtatcccaagatcttcgtataaaatttataagatgagagttcatttcgtagccaaaatggtgtggggctggcttctctctggtatctctagccttttgtcaagcagacaagccaagtcagagaactctttttatttctggaagacactagatttaaatgaaaaaacaaaacaagacaacagaaacccagcttgtaaatacagtttaatgacattttaggaaggtttaatatactaacggggataataaattgtatctttcacagcccactctgtgtggattttttcatgtaaatttcattaagttttaattcacattaaactgagaataataataatacccttggaccatgggtgggctttggggtctcagacggagttaagaagaagaaaactgagaaaggaacttaaaattatggttaagctttgccccataccatatgatacaaagtaaatgcatgcttaaaattatattcttttgcccaatagaatgtctgttccactagtttatttcttctgactactgagactaaaatactggtcagactgtcagtaattttctcctctttccctctacctggttgcagcacaaacaaagaaggcagagattttgattcctgcatgttagattttcagtgtagtcttagcgctgcaagtctgctcagccacctgattctcctcttgttattatttttaacctgttaaaacctcggtatttttatatatgtgtaaatataattagcatatagacttgcacaaaatactaaggtcccagcttgatttctgtctctatgataaaaacattctgaccacaagcaggtcaggggaggaaagggtttacttcatcttacacttccaggtcaaaggccatccttggcggaagtcaatcaggaactcaagcagaacgttgaaaccgaaactgtggaggatttttctgcttgcctgcttactccggctcatcctactttcttacacagcacagggcactaggccattgtgcttcaactaataaatcaggacacccctcacagacatgctccagtctaacccagggaagacaactactcaactgaaactgtttttttttttggggggggggtcggggtggggagtaggaagtgtttttttaggttgttctctgctgtgtccagttgatagctaaaataacccaggacaaatagatttttattgtatcgctgtcatacctgtccgagggcactttggttctatcacattacctatcattagttttttgatggctatgggggaatagcctgaaagaatatgtaaagtgttagtaattaaaggctcttctgcctgttttctgaaaatgccatgaaaagtgtttaattatactcttagtgatcgacaaatattttcttaaaacagaagtgataaagtgtgtatggcagaggaggtctggttgattctcagacgagcagatgcagaagaaatatcaacaaaacacagccaccagcatagactaaagatgcaaaacaagggcaatcatagattccttgagagtttacagtgaacgtttgtgtgtgtctggtgtatgtgcatgcatgtgtgtatgtgtgttcatatgtgtgtagatacatgggggtgtagttgcatatccatgtgtgtatgtgtatggagtctagaggacaaccccagttattattcctctggagacctctaccttattgtttgagacagtggctctcgttggcctggaactcactgattaagctaggcaaaaaggccagcaagccctgaacctgcctctgtcttcctgcccaacctagcaatgacaatcatgccaccacacctggatttatactgtgtttctgttgctcaatctcagatccatgtgttcacaaggcaagtgctatatggattgagccatcctctgtcccttggataatttttttaatgtaagcattaagtctcagctagctagatcattattttggtctcagtgagtcttccaaagtaaaaagtgatgaaatgattataggtgttttagatgtataattatgtgtcatttgctcattcttgagaaaaacaagtgaatgaaccagtgggtgagttcacgaaaggagcctagtggagtctgactgttgtcagggccttttggcctgtgctttccattttcaccagtatactactcaagatgatctctctcagcaggaagtgacagcacaccctgtgggattgcttagtggttttaaatatggggacaagtatgagtttggaaataaatttttcctaagttattcttcttctgagaagttatttatgttataatggcttagaagtaagtctttatatcaaacaaggaaaagatctggcaatttaatatctgaattcttaagaacccccaaattccaaaagcacaaattagaacactttgtttcttcttatcaaaggtctcacctggggtagtataagtaacagagccacttgtccagcttttgtttcctcatatccacttattagggtaccagataatgtaacagaaaagttgagatgcataataaaaattgaaggattatgaaatgtcattacaagtcagccactattggtagtttctgaaagatggtttttagtcatccaaaaattcttctgttgaaggcatattgagaaactaccagatatttggctcctgaggagtcagtaaacatatgcattttataagcatgtacatttgtcactagtgcagcttcttagaaacgacttcctgtattgctttgccatgatgagtgttaccaataattatggatgcagtttttagatgtatggatgtgcccttgtagttctgagcctttgtaagcatgttttcatcaatctctatagaatgttttcccaggagtcttgtactccttattcttcttttggaagcccttgctgactgcttctctttctctgtgctcttatggtacccattgctgccctgacagttcatcctgatcaatttctgaatgcctagctcaaacccattgccctgtgattcatgcttgcctgggtcacttactttctgccctttctttttctgaacatgtaagccattgttattttcattccttcctcatgctgggataatacctgcccagcttttatgtggctttggggatccaaattcaggtcatctcctttgtgcggtaagtactttatctcctgagccacctcctcaacctctcaactgtatcttaaacagccattcacatctctcttctctgatgatcgctcaaaaccatgtccttgtaactggaccaaagtaatagtccccaaagttctctttgcttctgcttgtgattgctctcctgcatcagtcttctcagggcaccagaggtcttagagaagcatgcactgggtcctcttagtgcactatctagttgaatcacaccgaaagcctcacaatcatactataccctattgcctttgtccactatgtgtaattctgggtgatcaagtttctgtctgttgatgtgtttttgttgctgctattttgattttaagtcacccctgtccctttgattcactacatgtgagccatactggcctcttttctctttgtagtccactcttaacatacctaccacagtaggcatgcagtcctttatcacagtaggcatgcaattactgaacatacctggaggcagttcccactcatctccctgtaacaattcttgcttagttaagcagttggccaggatggtatgtcatattttatcctggtttaattctgtttctatatactagatagagtatctgttggtaaacttgaccaatgaagaagtatcaactcaactattattttaataactcctgttgttaactgtatgctacctatatgttgacctatgaagtatcaattctgagcaattatttaatagttcttattgctaactataatttatatgtgtgcttaagaactacttaatattgtggggcttggggctgtcatatggagacaatttatcagatagcttcaaatgataaaaaaaagtcatgctgatgagagaaacaaatattagcaactcttaacatttaattcataatttataacagcaaatatggaaatttccactcttggaaatttatatttgtttctttatcaactgtggagctctggttgattttgaagtttgcattttctcttacatatttttcttttgattgatttcttaagatcaataggtggaggtaaaattcacataaaattgaccaaagtaaatgtttttacttttaaccttaatttttatgtcaattagtctagttatttgatattgcctgaggggggaaaatagaatatatgttcaatttttttttccccttaggaagttctttcatctttgcccaccaactcatggggcacgcactctgaattctctccttgttctgctcttaagaactgtgagcctacattggccctgcttggctgtattctaggcacaggtaggttttggcactgccagttcacagggtgccaaaagttcacagttcactggtaaagaaatctgttaggcaccacaaggaattttggttgctttcattcataggtcctttgcttttgaatctacctgcaaaaaggaatttattatcgaactaagccccatgaattctatccagtccctgcattattgattttcagaccagctcattccattatactgttgtactgttggctaagttcagtgtcaatacatgatcggttgggagatcggaggctcattttcattgtgtttagccaacgtgtcctgtgtgtttcactgggccctgacttgcatctttccacacgtggcaagttaatgatttgaatccacttttgcttgaatcgatccattattgtgttactctgtgggcagcaagcaaggcactccctaggagagagacctgttgtgtaacacaagtaacatcaggaaatgacattttacgttatctccttgtctccctgttcagtcaccagtcagttaatatcagttaactattgggaagctcctctatctcagtttacacgagatgtgtcctgtgttaaagccagtgttactgcatgtatgaaacaagacccctcagtctggtacacgggagtacatttggcaactacttcctcttcattttcgccaataccctacacttataaatagtattctttgtggattttgcttattcaggccatgggcattaggttatatttgctttaattatcttcctgcttctgtagacattatgtgtgtggactgtacgatcgatcaacttggtatttgcaagaggatgagcctgctttttgtatacctttagctgatctcaggagagttgtatagactgatctttagggcccagtttatcctttctttgttttccttctcctcacaaatgtctcccaggcctgctttgcatggttagtaaatggaagcacagccatcttgcatttcataagtggcttcaagcttctattcagcagagaagtacagttgcacaggggcacaatctcattcattaccccccactcaggcccattccatgcttgctttggagtttagggaggcatttctgaggtctgtactccagccttttctccagataatcaaaactctgttcccgggtgcagcaggcctctgggaaatggcttgctttaactggagttcattgtgtctttaaaagcttgcaaattgtatgttggtgctttaaagagagaacacatatgagtgttaattcacatgtattgtaattcaaaagataattttttttttttttgcagagtaaattaaaagatacagaggccattcagagatgccatctgttactatttgagatataattagggtgataatttttaatgccattgtcatatgatgggaaagagaggctttggggtaccaattaaagattttctccttctgaatgccatgttaattccaaatttaaaaatgtagtgggctcaaagctttccttcaattttaaaggcaaactcattctttcttactgatgctggtgggagcatcctcatgagtatacgatcataggtgtttcttcagctacaagcctattatgccacaagctagctttcaacttctaatttgagttgatagttctgtgtattaattagttatgaataaaacatgggaggttaatagctgtaccccggccagaagactttgtagttttaaaaaggtgctctaaatccatttgtgtcaaaaatccttcagcaatcatgaaatttcagaccagtcatggtagtccacacctttaattcagcactaaggaagcagatgcagaaggatcatgagttcaaggccaggctaagttgcatctgcagctctcatttcaaaaagtaaaaataaggctggtgagatggtttagtgggtaaaagtgcttgccatgtaagtctggtgatcagaatttgatctgtggcacccatgatgtaaggacaaactcgactcttgaaaattgtccttgggcctatgtgccatggcagacacatgccacgcaacacactgctactaatactaattttaagtaataaatgaattgtataaagtaaacaccatttcaatttcatctgttagtatcttgttgctttgttttatgaatattttagttttatgttcactatatattggatggtatgctaactgtggtggtttgaatatgcttggcccctggaaatggcactcttaggaggtgtggccttacagtgggcgtggccttgttggaggaagtgtgtcactgtgggggtgggctttcaggtctctatgctcaagccccacccagtttagaatgctggtctcttcctgtttgccttctgatcatgtctgcctacaagatgctattcttcttgccaggatgataatggattgaacctctgaaattgtaagtcagctcaattaaatgttttgtgtcataagagataccttagtcatggcatcgcttttcagcagtggaaatcctaactaaggcagtaacttggctcgttgttttttctctgtcataatcgtttaatacatggaagttaacatacattgtgctcatattctgaatcagctaaagccaaacattggtgctgtactaccaaaatataatcgctaaagaatagatttgaccaaatacatttcatttatactcaaacctctaacatgatccatttaggcataatatttaataagttttgttgttctatcgtaatttaggctttttgaagcagtgcttttataaaaatgataatgaaatcggccatgtacaattcttgctgtgattaaactgttcagtctattaaaacacactgattgattttgttgacagttagcaaatagcccattatattaaatacaattgcctagtgatcacagcaactatatggtcttaaaggtctccctcaaggtcttagtggtggtgcattacaaatttgctgtcagtgagattaaataaatcttatttattaataaaggaaaatagtttcttaaggcaatagaattgcttggcatctatgttctatttaaatggtgccattattatttgagaatgtcacttgtcaacatgatcagtttacaaatgttaacacctaatgaagcagactattggtgagtcagaacatagtttcacagccccgtgcaccagaatgtgggagaggtctggtttgcctttgaatctgttgagtgcctgtgtggagaaacgcgttaaagtgtcaatgatgagtaaatccctcagtgctttccttcatctgtgggaagttgctctagaatttcactgtttttggaccaaatgtatcaatgctataaagtatcacagctttgcacatcctagcacatatgtacagacatgattgaagaagaaatcttaaatattgcctctaaacatccctctagccctgactgtgattgtgtgcgcgtcgtgttgatattataattgaatgagaaataaggaaacatttttaaaccacacgggtgagtgtctcaatatgagatcaccgagaaagagaattctgtctttaaacttggagtatgtcactacaggaattcgttgtggatatgccttgatccagaactttctaacagagctccagtgagcctaatgggcccacctgtcacttttctgccttctgttcatctctgtctctgtcacccctccctccctccctccctccctccctccctccctccctccttctcctttgtctctctccatggcccacccctactcccctcccttcctcacccttctccgagaataagcgttaatatgtcattctcttttttacatcgctatactttagacaccttctgctcatactgagtggcttctttgggctaggttgtgaatttaaggagctccttcattgtgataaccatagtggctaaggggaaaataccagtacggagtaccagtttaaatcatttttaagtacccacttgttctactgagccttccttctggggtttattgtttgatatgttttatttcaaaatgggttccttcaactctgatgctgatgaggtgcattaatctgggtgtgtatgtggttgcccttttagcgcctgaccctgttttaataaaagcaccatctgcttaattggtgggcttgtgtgttttccctgttttctttttctttttttcttttttacatttttacaaagcctggttcaaaagggcaacactaagtgtaccctttaaaatgtattatttgggaagaatttacatttccaccctcagtctggtgaatagatgtggtaactgagtggtaatatctaaaacagcactgtttttcttgatcctttgttctgttggtagatcattgtttctgtagttcatgaaactaagccttccctgaggtttgatgggccgggaccaagacagctctgggcatttacctatcttagattttctacttttcttaattcatttcttaattaagccctcttgttacatttccaggagaatgaagggagaataggggatttctgtagaaggcagtatagaggtcaacagaagtgaatggaaggaaggaaggaaaggaaaagattggaaggactcaaaggaagtgcaaggagggacttggtggttgtttctgttcttcccgtccatactggacatagcttggagcttgagaccaagtttctaagtgagcgtggcttggtgctgtaggacggagttggtgatccagcacctgggagatattctgaagccaagctattacattagccaaattggttaacttctctgttttcccctatgaagtgagatggtaactttatcattaccttttatggttgtgtgatgataaaccaaacaattgtgttacaaatgcttaccagggattgaagagattgtttagtggtactcttcttaaagaaaagctcagtcacgttcccagtactttcctggttcggtcactcccaactgcagtaactccagctccaggggatctgattcccccttctggccactgtgcgtactgcactgattaacacatacacacaatcaggtacacatggatacacataattaaaagtgtaatttaaaaatgcttagagaagtatatttaactgtaatgtacatattttattataatttttaagagtaggatatcaatataagtgaggtaaaaattcatggattgtaaatcattttagtgagaaactttttttgttgttaatgtgaatagaccattcatatatgaaattgttcatggctcttcaaagaagtcctgcacttttctgtgcatctgtcttcatgcctggactgcttttcttctggaatcttctattcatttgctagagcttttctctgttatcttctttgtgaattccctaataacaactataaagagatttagctcacttccaaaattgagcttttgtagtacttagtggtttttaatctagcacttgatccattataatgcactcatattcttacctttgtacgttccctcactggagcctgacggtgagtttttccatcattttagacatgcacataaaaaaatgaaatgcctgtctgtggctgacctttggtgaggaaagatgtgaccatttcatagtgttctcagctcatactctcagaaggagagatcatggcgtctttccctggaaatgggtgtctttagcatgtgtagcaagtattgttgtttccctgcaaatattcaaaggaactttcatttaatttgtcgaagggatgttggtgtcatgtttcctttctgtggtctctctcttccttgactttgttcttttttctattcttatcccttccttccttctgcctctttctgctaggctgcagttttcagggttggggaatatatttatttgaagctgtgctcacttttactcattcccacagagatttctcttctcttagtgtaaataaattttcatcctgttcattagttacagcattcttatgaaagtttagtcaacaaccagttgaataatttctgtttttatttatacatgcttataaaatggcctcctatacttgtcactgaaccagtggtttatgctagcaacagatgtttcctacaatacataatatgatgacataaagtttaagaataataactaaatgtaaatttgtggcattgcctgataagaaatatcctccggtgtagtgtttttgttggaataatgatggttgttttcctcatatctttgtggatctattagaaagcttctggattgcagggctttatcacccatacccaggggagatgacctcgaacagttagaggtctttatcatcaatgaaccttttaaatatcttttctcacaaggacgtcagttattttggggaattgggacagaattgttgaaatttccatcccccttgggaaatgacttgttattgtggacccaggcctgctgaaggtaacatctctcagattctacagtgcttctacttaaaataaggttaatgtagataataggagtgtgtgtgtgtgtgtgtgtgtgtgtgtgtgtgtgtgtgtgtttactactaggattagtgtaaagcgagcactggccattgtggtctagagagccatacacataaaataacacttcaaagaaacatagtgactctagtcccagccaaacagatgtattcagaaaacaaacaaacaagcaagcttgttccaaacaaattcatcattactttgttgcttagtttatggggcagaacagtggctctgttgagcaacagtagctctgttgagccgaggacaaggcatgtgttagacttggaatcggatttggcatctttgctagctttttgcacctgagttttctgagctccttatctttcatcgtgtctgtaagatgagaaaggctgagtcaatacatatagtaccatttcaacccagcccaacaacagaagcattggcaatgttagtaaagacttggcccagctagtctttttttcttagatttacagatatacttccagtttacctttgaaatgctatagagtactgtattgatgactatcagcacagcaggagtccatgaagctgggtttctttttgttcttttgtagttttgtttttgttattgttgttaacatttatttacttttattttatggatgtaggtgttttgtctgcatgtatgtttgggcatcatttacatgcattgcccaagaaggcctgaagtaggtgggtttcagactccctgctggagtttgggcaggttgttgactaccacatgggcgcttggggaatttatttagccctggtccttggagcagcagccagagagctcttaattgctgagccacctccttatccctccataaagcttttccataaaggaattgaaatgattttaatgactcggttcagttttaggttgtggttgatcccctttagcagactggagaaggttgtgtttcattttatcaatgctccccagaattagtgacagtaaagagccacctttcagcagattcccaagtcagctgttgaacaactcctggtgtgagagtgtgacttgactcccagagccttgactgtggagtggagaagcttctcatggtctaacgtttccagtccactctttgctttgtcagtgttttagagactcaaaagtcttttttcccttcccttcccttcccttcccttcccttcccttcccttcccttcccttcccttcccttcccttcccttcccttcccttcccttccctcccctaccttaccctcccctttccctcctctcccctgccctccccttctctctctctctccttccttccttccttccttcctttcttccttccttccttccttccttccttccttccttccttccaaattcctatcactcaataacagacatttacagggctcttgaggacattgcagtgcttttgttaagatgtagagaaaagaagggggcttttagtaaactggtgtttgagagagcagataaaactatcttggaacaggtgagatataacaagtagaagaaagtgaatgttgagagtcacatgtccagaattggcaacttggtgaaggtttactgttggattctaagagtatgaagggcaggcaaggagggcaaccacaatgaggatgggaggaatctttttgagtagattgagaacgggaaaaacctagtccttggccattgaggggttgttaaaggggcgaattggggatgtaataggaagagtttggtcaaatcacccaagattctgagatcttgccaaagaattcaaagtttattatttcaagacctttggctgttattgaagatcttgaaggagggcaccattgtgctttagcaaagttaaactaaccatcgtgttcaagaaactcagaacagtagtgtatggaagggatgaagggacctggcactggattgtctattgcttttctattgctgaagcacgacactataaccaagatgatttattgaagaaagagtttattggggactctcagtttcagaaggcgagtccatggtcatcatgatgaggggcacagcagcaggacgtagtgctggatcaatagcagagagtgtacatctgacccaaaagtactagtcccagagagagggcgactctgctccagtgacataatcctctaacaaggtcacacctcctcacccttaccaaactgtctcactaactggagaccaagtgttccaatatgtgaacctggtggctcattctagctaccacattgcactccctggggcctcataggcgcatacacacacacacacacacacacacacacacacacacacacatgcgcatatatatgcacaaagtgtattcagtccaacttcaaaagtctcaataatgtttcacagtttcaacacagtttaaacacccaagttccttctgaggctcatggaagtttcttaattgtagttctttgtgaattcagaaaaccagttggctacttggattgtacagtagtacagaatatacgccaacattccataagggaggaatggctgcctagtgaggaaatactggaccaaagcaagactgaaactcagccgggcaaactccaaagctccatgtctgaagtcaagtgcctcccctccagctccgctgactgtaacctacttctattaggctggctcagctcacccttttcaggtctctgtggcaaatcttccttgggtctggaatccgaacccagtccaggcttcacacactggtttctccaggttttgatgtaggcattaccctgttgcatgttcagcagctttccttaacctcagagcaagattccagggacctctttagtcctgcatcctttcctgactctaaagccaagttctgctttctgcttggggtggagcctggcgccttgcttgagccttgtttgcataagcttttctctatggttgctcttaagggggaggatcatttcagccttgtgtttctcaagtttcagggctaagtgggtggggtcttgtcctgagggtaccactccctttactccatttcacattaggtctttcagccttggctccaatgtttcctggtgctctccctgcctcccctcagtgctctcctgcctcccaactgattggtttgtttttatttgccccacatttgctctttttcattatagatctgagtaagaatgaccactaattaacaagcaacagaatcaataccaggctgtcctaaaatctgttttgccaatgaaattagtgcaaaaattcttccatttagcctcaggcagatccttaatactccggtaaacagtagtcacatgttggtttgtttgtttgtgtgccttgtttttgttttggccaaaatgtcacaagaatgacccaacccagctgctaatactcttcccctctgaaacctctctagctggatacatacagtccaaattgcgctcagcatggccttccaggcttctactaggatggcctattatggtctgcttctactttttaaccactgtgttaggctaaagtcccaaagtcttccatactcttccaaaaatgcagcatggtcaggcctgtcacatgtgctaagcccacagtgcagtaatgcagggtagatttattaaaaacaaaacaaaaaaaatccatgttccgccgtcatcatatctgcagagatccctgtgggccacttggcatatgaaaagctgtctaattagcttactttgagtcatattttatattgtaaactttccatcgagacatttgataggataatcggagtgatgcttatttgtgtatttgagtcctgtgacttattgactcaatgatcagaattgaaaatgtggactttgctaagaggcattttgcttgtcttgggcttatcactgatacagttttaaagtcattgcagtggaatttacccggattccccagaggagacttgtgaggagctgcagagctcacagagatagattagtgtgtctgtggtcagtgaaaagctaccaaatctgagcaaaagtaacaataaaagccatgtgaatccacctgcctggacatttctctccagtccttcagccctggacattgtctcccatccttcagccatctgctccttgccagaaccaactcccattgcacagaacaaaacttatgtgcacaccttgtctatttgaataggatttgaatagaatacattccatcttctctatacaataagagtatcaagcagtatcaggtgaggcttaagtattttaaaaatataagcaaaaatggagattatttacttatttatttatttatttatttatttaaaaaaaagcctagtcctgaaagtggaatgaggttgttagggatcatttctggctaaaaagcattgtgttaatcatggactgagcaatcatttctctttagggaatgttttataactatatcacagaaattcaagcctaactataactgctaagtgatgtttaatgacttgaatcttcaaagacaagcaaatatggacttggaaaggtcttaactaaaagatatgttaagtattgaaaactcatttaaaaccttaataaaacttcagatttacataactaaacctgcctgttacttctcatctttccactttatttaccatgacactaaaaatcaactcaacaaatacctaaaatccccttagcatagggtccgtaatacatgggttttgtttgtaaagctttcaggaacctctgtagattataggagttcactgttatatctatttataaaactgggctaaagacataaaatttaggattttaaccattttaagtgcacatttcagtggcattaagtatattaactgtggtatgtgacagcggtcagcatctgtttctagaacattctcaccatccacaccagaaactctctacccatttaaacagtatgtcctctgatgccagcccctggagacccccattctataccccatatctatcctgactgcagtaagtccaccacataaaggaaaacaaaatatttatctttgtcttttgtggctggtttgtttattattgagcacggtgcccttaacatttatctaggttgtgtcagaatttccttcttctttcagtatggattttgttctattatgcatgtgacagattttgcttatcggttcatctgttggtggatactgggctatttctccctcccggctgttttgacaatattgctgtgaacattggttaacaagtatttctagaatcactactttcagtctttttgatatgtaaacaagacttttaacctgatttttttcatctcttacgtctggtctcagtatacagttcttttaaaatctatatttatgtagtattctttcatgattttagccctgggaggggagtggcaggttctaggccctctgtgaagatttaataccaggtgtagattctggaactatatgtatattaagccccatttctgtcactgagccacacatctctacctattctttgacacgtgtgacctccaagtgcttcaaacgtcaacctgaaattattggtttctatgccagaagcatttctgcaaagctcagctctttagaagttcagtgcatgatgttgctttagaacttaaactttcaatgctgctgttgctgttgctgctgctgctgctgctgcttctcctcctcccaacccccatctttctgctccttcccactgcatacatgctttgggaaattttcttcattcctgttgctctctgcactggactaacccaacttactaactcatttttctaaactgtgtggtcccccagcatgtggaaatatgttgttgatttcattttagttggcatgttgcgattaagacttcttgctgtataatgaacttcaattttcactgaagattcctggagtctgtgggttatagatcacatgattggcagttcctattatataccgtaagaggagcctggtctgccctactccccatcctggggggggggggttgacatctgaagctaaggactggattaactaatcagggcctttatcctgtttgggctccttacttttaaaacagcataaacctttaggctatggaaatacggttctacaagtgttaaattgactcatgatttccaggtgtatggaaaaatggcatattgaacttgtaactctcttcatatatacgcgcacactcgcgctcacacacacacattgaatatgaacaacagcaggcagcaattacttctgtctttgaagatcttgttccttggccatgagacaccagtctcattgcttaccttcgattttaatactctgcatttgtaagcagatacttcatgtgtccctacttattttctctcattttgcaaaagatagaatgcatgttttgttttaaggctggggaatcaaaaccccttcctgattattgataggagctgcagttttgaaggatagacaccaatactagtttcttttgtcttcttacagactaagttactgtattaggcttagcggggtgtgtgtgtgtgtgtgtgtgtgtgtgtgtgtgtgtgtgtatgctcatgcatgtgtatacctgtgttgtgagcacaggtgcctttataagggttagatgcatgcatgtgcacatgtgtgtagaggccagagattgatttcatgtctttttttttaattgctatctactttatatatcaagactgggtctctcacaggaacccagagttctccaatatggctattatagctcattcccttgctctggaaaccttctgtctccacctcttaggcacagagattacaagcaggctggctgacattaacatgggtattaggcatttgtactctgctccttatgcaagagttttactgactaacatattctctagtctgtattttaaaagcaagcaaacaaccaagcaaacaaataacaaaccctacagaggtttttttccctttgtgtcccaccctggtcttaaactttcgatccctctgcctcaggctcccatgtgcttaggtggtagaaccatcacacctgacttgctttttattttaaaacacaaaatgcaggtggaacagcatataaaacacaggcgctctaaataatcactgcaaagaactcattgaagagaatttctggtctctgcaagctgtatgtgcctcctccatggaattcctccctgctcttaaatagtagccacactgaatcgagtgctgccagcactgtctccattaaaggagcagagcctggtaccctaaccgcgcttgccacgtgctccctaagcggacaggctacaggctaattactgactctgatgagttcttcaatgttcttccacccagggcagatgcgtcttggtaatcacagtgctcctcatctgggctgagactttgcttctgtgttagccgtggcggatttagatgttgctaataagctcatcctgcccgaaagagcactttcaatgcagtgcattcatgttatttgggctacacctgctagtgtagaatgtgcattcagaaaagggaagacggtttttgaaattttggagcaaagcatcactctgattgccagtcatgaaggttatgtcttacaggaagacggaacatgcacagactgcgctgggggaggaaagagagcggggaatatagatagtttgggggatgcaaagagattgagcttgttaattccaacgattatcggagtttctgcaacaaaatcagtgactgaggagtagttatggaacccaaatgaaccactcacctgccccgtgctccaaatgttagacagagggagggaggtggcaaggaagttccagtttggagaacatatgcaataatcatttatcactaaacgttttacttgggaggatggcaatacggatgtgaggtgtggggtgggctctggggagggtggtttctggaagagtggagcagcagggtggatggtgcttagttctgtgaaagccgggggggggggggggggggggggagacaactgggcatgaagaaggatgcgctggttctgagttcaagggagtgtggggatgtctctttgaattttgtgttttctttctttctcttcctttatttttttcctggtttactatagagcatctttctttgctttcaattacatctcttgttgtctgtgggagtttactggctttcttttcttttctttttatttatttatttatttttttgttttgagaaagtttttttgtgggtttgaaatgacattctagctgccattggaaagacaacagtgtcctaagctttatggtgtcagagctctgaggagaaaggaaaagcaggcgactgggaggaacggaagcttcctcttctgagctgcagtgaggccagccagggctgagtcatccttaaaaagtgaagatccgctcagcaaatgaccagatcccatcggaggaggccccaggaaaccccagggagagtcattagaacggtttctcccccagcctctgagttccctatggactgtcagctctcagagcatgcaaaactgtgcaaaactctctctctctctctctctctctctctctctctctctctctctctctctctctctttctccctccccccacctccttcgtcctcttctcccctctccctccccttcccctcctgcgcaagcaagagagagagagaaagagagagagagagcttagttttcacccagtttcatcctctgtgaaaacaagtgaagtctgtgcttggaaccatgcatagaacctgctattttcattgtatatacgctgtgttctgtaccataattgttgaacaaatgtgtctgagtttagtgatgggatgctttccttccatacacaaggctctaggttcaggccctggtgccaaaaagcaaaaagcctcaaactggcaaatataaacctttctaagagtaaggaatcaccacaagtagagccatttgtgaggagagtcctgggtcagagagggctatctccccttccccatagagctcctagaaagcaagagaatgtccagacagtaagatgatgtacagtccttctcgtaactaatttatccccagaaattccagaaatactaggaatgaaacgaaaactagtttgattcctgtgttctgagacctttttaatgattccttataacatgagagagtaatgttttgtgaattattctgccgggctgggtatgcagctccctcctctgtgacttaaacagtcttctttatctttattccaccttgctaaagagagcatagcacttcccctgtggcgtgcactccaggctaccagcagatcttttgtcttttcctcccattgtgatgtagaactcctggaatttgaggcgagggttagctttttaggttcctcagttggaactctgatcctcaggctcttgtggcaaaaaaatgctgtctgctgacccatattgttggctctatcatgaatttctttttaactaccattatagagaataatttagtgtcgtgccaatgtttcattgtgtatttgcaaatgaggcattttacaaaataaaggtaaaatgtgtgttttattcttttacttcttccatcaaatagtttatttcttaaggagtaaagaaaattgatacattatatacatatatgtcatatacacccacacatacatcatctacatcatatacatatataaatacatcatatacacatatagcctacacatatactatatatacacacatacacatttatatcacacacatatttagatgtatatcatcgcttctgtttttgtccacaaaatattttcctcaggagcatagcactacatcgccattgcttcatagtaatgcattgccatgctgagtgtctcctttctcgtagtcactggagttgccatccaaagggaaggaaagcagtgtgtctaccttttaatgagttgtgctgcatccagattcttctgagttctctttgatgaattgactggatatttttagtgatctgttaggatacttttcattcttttctcccccccttagccttaggtgtgaggaattatttaaaactggcatcattcaaccccaggaaacggagaacacttgaaagctgtgttttaatgcttgccaggaatgattgaatccgtgtgttgcaatttcaatgtttgttagtgttgtgtttgtttgtgaggtggcaagggtcttgggttcagtaagcaggtagaagtattctgtgtgtcgtagataccacgttgtgtagcaaaaagagcacctggatacctggatgattggaacgcgttgccccaaagagcccccactgtcacgctgccttcaaggcaatgccaggatatgatgcagaactggggcatccgtgcaggttgctggaatatagcatggacacattcaggcatggggtttatggtagtcttggtgacggaggacccaggaactgaacacaatgaataaataggcacggggactttgggctgttatttattttagttaaatcccaacacttctgccactcagaaatattatggactaagaaacttagtccccatcgaatggaaaagtcctattcttagtggggccttctcaggtgggacggtaagctgttactttgtgcaggtcctttggtggggactagggaatcattcctgggtagcataattgtctgggtgaaaattgaagactcttcctttctacctttttctgtccccctcctttctatatctctgtccctcctcccatctgtctctccctccatccccccagccttcccaccctttctcctcccatccttccctctcttcccaccctctctccctccctttccaagatcttactccttaggtagcctgacctcaaattcttcttcagcctccctgaatgctgagtacaggtgtcagccactatgctaatctcctacagaggcatagcttagagcccctgaatcatagaaacagtgaaagcaagtcttgcttttatttttttaaaatatatttcatataggttacccatatagatgtcatttcaaagcacagtcggccatgcatatccacagcttctttatcagtggatataattaaccagagatgagaaacaattagaaaaacaaaacacaaaacaaaaccaatcagccagccaccaagaacaacaacaaaaataaccctaattgcaccattctgtaaacagtacaacgtgtctgctatttacatagcatttacattgtattcagtatcatgaataagctactgatgacttaactgaattgtagaggaggatgagcacagactatatgcaagcattgcatcattctaagtccaggacctgaaccactttgggattgtggtaacctggaaggatggtgtagacctgacctggcctttctccccatagaccatgggatccctgtcgactcgaaactgtgtactgtcaccacagtctattctaggacctaatctttacttccagagaaacttgaaaccctctgtccatctgatcaacatactccctcaggctcaatgacttgaagatctgccttctcttcctatagctttactattctggctgtttcgaatggatgggatcacatggtatatggctttttttggctgtatttttcatttaacattatatttacaaggtttgcccattttgtagtttgggttggtatttcctttcttgatagataataattcattttatgtatagataccattttatttgtctctattgactgatggttgttggagtaattttcacttttttggctattattaataatcttgctgtaaacatttgattatggctttttgtatagctgtactttttatttctcataagcattttatctagactacaataactaaatccaaaaatatctaagtccaaaaatatctcttatttgctcttcttttcaattccttctctctagctctccgtatcctcctgtttctttaccatgttatggaataccatgcctgcgttcttctgtggcctctcttcaagtttagagaagattgacagggttttacacagtagctcttttctggcagattcattaaaaatcccacatgtttatgtttattatattttcatgttcagaatctaatatagctctttggtgctgagatgatattgtcttctatattgcgttgtttatggaatgattcatttaggggttatttttgtttttatttggttttctagttattcctcatctctggttatatccactaatatagaagtcatgggtactgaggactggctgtgctttgggttggcccactttaaataataacctagaggaaattcttctgtgtttttaaataacatttctcaagtaaagagttataaatcatacattttgttagactttacgttttacaataatgaaagttacccgaaagaaaaacatgactaccatagcccaggaacgctgtaataggaggtgcctcttgccccagatgaagctttacattccgagccccgaatccctgagcaaccgttagttcctatattcctcccagaacatgctaatacattaaatgtatttatagccatatgtgttctaagtgttatccctagtgtcgttccatacattaatatgcttatagcatcgcctgtccctctgcttgtaactgacattacataatgatttaactagtttctgcgttttctgtttgctgtggcagtcaggaatctcatttaaaatttctaggagccctgagctcattgtagttgcctgctgaatgaagccttgactttcttaaaattttctccccttttcttaactatttctttaaaaaaaagaatacttgaaagtttcttttccttgtgtgaactttgtttaaacagtttcagtgtgtaggaggattgaacatgcagctagaagaggcgcgcttgacctgatgcagtggacagtgttctgtgcctatataattttagcatctgggacatcacagagcagagcagtacttaagaagttacccctttaatgagtatttaggactgaaatactccaaagggtaaatgtaacttaccaacttgcaaaagatatttttcagaaagtgttattagaaaagaataattatctagttggaacattttagatatttctatatcacggaaactgtacttacgggtagtgccttttatgtctttaggataagtgcttatgaatttgcagtccttgcttgtgtaatcacactggattgttctttggtatgatattgaaatagaaaatacccccactgccattctttcagactacagtgctgtgctttgaatgtggtaaatatcaattgtagtactttaagaattgcttatctgtagaccctagatgctttctttacatgtgagttcccaggtgggaaatcacttgactttttgcttacgagtgagagaaaccatttcgccgaggcctgtcttgccagggtgggtcactggagcacatactgcatctttgtttcagagacttcggctctagcatacaaagtttacttaatggcgctttggctaccattcatgtttgaagttgactttggatgttacaatgcacttaattagaaatttcctttaatgagggaatggaatgtattgagttggtactgtttgatggtggtccttctagaaggcagctaagtgaactggctgtcatggtgcttttgagtggctctagtgataggcgtccagggttaggagtctgaactaatattgttcttaaattctacaactgttagggtcttgtgaacccatgaggacacagtgtttgtaacattcatgcatgttgtcttttacagtcaatccgctcaaacagcttcttttttttttaaagttttatttatttattgtttatatgagtacactgttactgtctacaccagaagagagcatcagattccattatagatggttgtaaaccaccatgtggttgctgggaattgaactcgggacctctggaagagcagtcactgctcttaagcactgagccatctctccagccttcaaacagcttcttttcctattacctcgacactgcccttttgcattggccatagtacatggtattccagcgtctgcttcaagcatagccttgatatttttaggatctgtcagaaagctgttagttttctcttgtggattttcagttcacttctctttactgtgctagacagaaatcttcccctcggttttcctcctctgtgggccgatcacgtgcttaggattgcattggcacacttggccatttctttccttttttcactgtcttctttcttcccttttgcttgagactttccagatgtgtttcctaaaatgtctcttcactttctgctttccctggcccatgtgtatctaataagtgatgagttgtttctttatctctctccctgctctaagccattatgtctgactgcttcctcgatatagaagttgataattccatctgtcagacctgtaaaacccccaagtatgcctctcactggattcccttgtttggttaatcttgcctagttaacccaagcagacatttacctatcactgaacacaattgttattgttgttcttgcttctccttctccttctccttctccttctccttctccttctccttctccttcttcttcttctcttcttcttccccttctcccttccttcttccttctttcttcttccttctcctcctcctcttccttctcctcctcctccttcaccttctccctcctcttcattttccttttcctcctcttcctccttcttcctctacctcttctcccttctccttactcctcttcctcttcttcagtattcttgaattctcaagctatgcaaacacagtgataagtgcagcattagagccatctgccaatattgctattagactttcaatgtagaacttacaagcattaactgagctttaaagaaatcaaagcaaactgtgtagggaagatgtctgtaggcaattctgaagactatgttggacacgggaatagagattactatgtgtggggcttgctaaaagagtgagagaggcttcaccatgtacctaaaacaatgcagaaagcgttgggatttggaaaatgtgatctggagcaataggtaatctggattgtgaaaagccaggtgtcatggagcagccttgtaatcttagcacattaaaggcaaggacaagcgggtgcttggagctgctgctggcctgacctctgagcttagtcatcaaatcccatgtctctgactcaaaagaccaggttcatatttcccaggagcaacacccaagtttgacctccgtcttctacatatataagtgtgaacacatgcacttgcatctgcacgcatatacccatatagaacatgtgtgtgctcacacacacacacacacacacacactctctctctctctctctctctctcacagaaagaggagacttaaaaatggcttatgagcaaagtatttaaatagagaaaaagagaaactaagctattaataatttcaaatagcagaagggttgtcttttggaaatgtttgtcttgtactagaagaagctaaaatacatcacagacaagatgagtttcagaccctaatgataagaagacattttttcatttggtgtacagagactgagacttgattgcatatcacattgatgataatatagaaggtagaaagtacttcttaaaaatattatgggtaggattggattataataaaaaaatctgattagagcactgctacattccagtccagccctgctgtgtcgagggtgtcccttagaatgatactgaagagcttcctagcctttgcacttttacctatagcttggaagtatttgtgaagctatgcagcacaggagagatggctcagtggttaagaacactgactgctgctcttccagagacatgggttcgattcttagcaccacctggccactcacaactccagtctcagaggattggatgctgctttctggcctcagtgggcactaggcacacatatgatacacaaatgcacatacagggaaaacactcttatacataaaatgaaaataaaaacaaagaatatataaatactctaatagtcatcacagtaaaatatctccatttctctgctaagaatattaaaataatttttaaagaattgctagaaaaacatatatttggttttagtatcctataaactaaatcctataatgcacagattctaggtaggaggcatatagtcagttttatttatttgttcaaaggctagtcttctgaaaattgctatataaatacttattttaacaactgttattattaaggggattgtatgaaagtctgccaacatgatcctaatatttatgtagtagatcaaaatattttgaaaattttgctctcaactgtgatctttgttgttttaaaaatccaaaatatccttgttattttcagttaactgcagctggaatagtttttatcgccaatctttggtttcttttttgcttttaattaaaaaaaaaaacagaaattattatgcaaagaataactatctcatgttagtgatttaagtgaaaggaagagttgggggattgagattgggggcatttcagtcaataaaacaataaaactgatacttatgtgcaaattaacagtcaggacaccaacttgttataaccagtgacctcattataattatttcctaactctagagtaattatagattcatgcttgtatatgaagtgatagcaagcgactttcagagtctgtgtttgtcgtacacaatcaggaaatttaatagtcatctattgaggaaaaaaaacacagatgagctgaataatatctccatgaataaggaaattaatttgtgattggttgatgctgtgcttttaggtttacagacattttcttgctgagtggtcttgactgaggcaatgcaggtgtttacatgaatataaaattggcaactatatttaactctaatttaatgtactgtgataggcaaagcctgtttgtctctgccttggacttatttgaagttaatgacatctcagaggagattgtagatagaatgttcctttttagaaacaaaaccccaagtgtgtgtgtggtaggggcccatggtgatattctttgttatggtctctgtacttgttatcgaatttgattttgttataaagctctggcagggatggacatgtagttcagctgtaggtcaaggttttagtacccatggcactgacaccctgtgcctcacccaggctggctccacatccaacatactccaggctcatcttccaaggcactgtgatgattggtacggtgattgttgtctcgtcctgccaggcttcttattctgggcaactttctttaaactttatgttactcatacaagcacccaggaccgtggtccaggaaatcttacaggaatgaagttaatgtgttccgtggattcacagagatacgctggttgtagtcatccctgagttgtcttggttaatatttcagctcttccaacagtttcctttcagctttgggctcacctgacatcatctccatcgtcctctttgctgtgaatctcttgttcatcttccccttattgccaaggctaagtgggtacattgtgaggaagtttgaacagcacacatatggctcctttccaactatctactgtagctgcagtcagctaagagagattgaatgtctagtctgccctcgactccactcttctctcaaaatagcctccataacttccaattttcatatcctattaattaggaaaaagagaaaaactgtcacagggtccctgggagttttgtctccggctaatcagtacttgtttccttcagagtaaagtgcagttattctttatcttgagggagaagatgtcagtcttggttaccgtgtattatcttttactgggtgtagttattatccctatgacagagccgtgtaaatgctctaaaatactttattttaatctgcctttgtttttggtcttgagtcctaatcgaattattccccatcccctttgggtgttcagacagcctttacatttttctatggagtcttacagaccctagaacccgttcatttcacctgattggattgtttcaggaaaaatgataggagatagtcctggaaaactgcttcattcatagaagtaaattgcagttaaaaaaaaaaaaaaaaaacctaaactaaaaggaagtgtggaacaaggcatttcttgagagggtgagacaggaggatagcaagtttgaagccaacctggttccatggtgaatccatttctaaagaaacatcaaaagcaccaacagttacactgaccgagtcctgtgtaattaacctgttcagtttccaaagggcatggtgaatccagtccctgacctgtgagaatgctgcccatttagcattattagaagacagtggagggccttgggaaatgaagttctgattttgatttaccataaagcaagtagaaagggtgcaggttgggagaaataagaacatatttttgaggagactacaaatacagaaaaccaaaacatgaaatattgcttatgactgaatgggaataagtatcatgttcttcactgagggtaggctcaactggatcattctcatgagaatttgtaactctccatctcttttccttgtaaatgattgaattattaaaattttgtattaatcttgctaaattagcttgagcctgggtgctattacattcttccatgcaatcttaaaaatcatagtctggctatatcatgagtctctgtcaattgtaactgggtatatttgtagattagttggctatttttatcatcctgaaaaggataccataatattttgtcagatgtgtcaaaggagcagtgacatacaaatgcctaaaggcgtgtgtccacactggtttaacccagcctatgtgtgctaacagcaaagtcctgtgtaaccatatagaaaaccaagcactcataaaacttcctaattctcaccatctcatgccttttgggaagcaattctaaaattcatattggatgctcccttcaactggttccaatagctgtcgttatggtcatatgatcagaggtgcaaaatagtgtcacctgtgggttcaaaactcatctaaacgggagttttggaatggcaaaacaagtgtctggtgtgcatggtctcatttcactgattaagaattaagaagccggtctgcctggaacagccggcagagacaggagcctagcatagcagccctctgagaggttctacccagcagctgactgagacagacactcacagacaaacattggatagaggtcagggactcctgtaaaacagtaaaaggaaggatggacaagcgtcaaggggatggcatttccacaggaaaaccaacagtgacaactaacctggacccctgggggctcccagacactgaaccaccaaccaaagagcatacgcaggctggcccaagccccagacacttatgtagtatagggctgccttgtctggcctcagtgggagaggatgcacctagtcctgctgtgacttgatgcaccaaggtggggagatgagaggggagctgccttctcagagtagaaaggggtgggggggggagtggagctgggaagaagcagggaggaagggccagagcagggcaacctttgtgatgaaaacaaataggcaaatgataacgtggccttacttaggtttgcaaatcatccatcatttaatcacaacccaaggaatcatgacaactacgaaatgtaacctatttttatttttggttatttattcttagatggttaactcatataattaacctggcagtgtgtttttacagtttttactttttctatgaagctgtatttcctaattcttaacttaccagggaagttgactttatcctcattaagtagtgataatgaatttaaatccagctgacagaattttctaaaactctgggaatatgtccatgccagtgattcatttggattcctgttcccaaggaattttaatttttgaagctgctataaaattatttttgtcggtcctaactacaatccatattttttacatatttactaaaatggaatcacatttaaaaaaatatagtcctagaaattgcattgagtcaggcttggtggcgcacgcctttaatcccagcacttgggaggcagaggcagaggcaggtggatttctgagttcgaggccagcctggtctacaaagtgagttccaggacagccagggctacacaaaggaaccctgtctcaaaaaaaaaaaaaaaaaaaaaaaccgaaaaacaaaaaacaacccccccaccccccaaaaaaaagaaattgcattgaacttagttataaattactttggattgaatgtgtttttgtattggcttcaaagtccatttctttgattttaaaaattgttgttatcatcatcctcatcgtcaccaccaccatcatcaccatcaccatcattgtgcatgtgtgggtgggtatgagtaccacagtatgcatgtcagagtataaattgtaaagtaggatctttcattctgccaatctgtgtattccagagattgaactcccccgtgggtgtcaagtacctttgcccactgagctttctcacagacccctatttctttgttctccttgggcttttctggaagagaatagaaaaaacagaaacatttagatcaatagtggaaatatgatccacattaccaaatgctgtttataagtgttattggggggctggagagatggctcagtggttaagagcactgactgctcttctggaggtcctgagttcaaatcccagcaaccacatggtggctcacaaccatctgtaacaaggcctgattctctcttctggtgtctgaagacagctagtgtacttaaatataataaataaaaattttaaaaaagggttattgattagctggtccagtatagatggccaaagttcaacccagcaacacccccttcaaacaaacaaacaaacaaacaaacaaaagcaagggaggaaaagccacgttggtgagggattaggcttgctcctggcaatggcagacagtaacgttggctattagcgaaggcaatagagagaaaaccaacaactctttaaagaaatttgtgtcaaaatgggattcagtggcccatcacattaaatcaacacatctgtattgagaacgttgtttagcacacactccaggggttcatttttctcattttctgtacttgcaaaccctgtatttatctccagcatgggtcactgaacaaattctggttttcctcattaggtacagagtaatgaggccttaagtctcctgttctatttcaccttctacccaactttgtctgacatgtacctccaccgctcaatgagagacttcaatgtgagcgccgtgctactttgttccttcccagcttttctgcctttgttgattcccgtgcgtggtgcgtgggttcctgcccaggcagtccactgtgcactggtggtctcaggatgctgaggagctggggagttcagtggtgggcagcaggctccctgagagctgtccagggtatgggcagcgctctaccttcccttttttggcttgagaacccacacaagtgacatgttccctccgagtgtgatggatctgtcttccttgtgcctagggccccggatagtttaatttaaaatattttaaatcatgtgatggttaattttcttctggttttgtgtctcagctcactgagatgttcctgattttctttggctatctgctatttgaacagggaagtatttagaatcctaagtcagaggaattacagtttttctattcttttttttttaaagggatttttttttaaaggaagctgctcgaaaatacaccatactaaccagatacaagcctcctgctctcccttgagactcctctcgactctcacagtgctcctttatcccctgtcataataagactccaaaagtattatgttttcttataaagaaaacttctcacgtataaagattcaaaccagcaaaacaaatgtaccagagggtgatttttaatttgacaaaagatcttctacatgacaaagagttcccccgaagattacgtttaagtagacaatttccttcgagtgctgagagtcacattaaacagttgtcaacattttaaaaacaagcacagacctgttcctaatagttatatgtaaatggtgactgtgtgtccccatgttatgagtcatgatacagtctgtgaaatactcaccatcgccagtgttgaaaaaataagcaagatggctattccagtttgcatctctgttgtgagaagacatcaagttgatcaacaggaacttgtggatgagatggggtgtggctaggtcaccttacacttccctggtccagtccttgggaatcctaggtgggaaggaattttagggcagacatctggaattaggaattgaagcagggttcaaggggagagagctacttgctggcttgctttctcagactttctcagcttcttttcttcgatggtgtaagcccacccacagtgttctgagccaccatgcccaatttaagtaggttttaagtacatgtatttaactggattcttaaagcttatggaatttatagtagccattaccttgacttgtgaatatgtttgttatttatgagatcttggagtgagtcgtttttcatatactttcataactcagaacataatatctcccagaaccatacttgggctatggaagctgcctaaagaagagatggtatatattgtagccattgaatttccatagaccatactgtttgtttgtggcaattagtacttactacgtagcacactctggcctactgcttccctctgctctttcactgtagctcagcacagctctccacagtttgcagtattattgaatactaacttcataggtaaatgattagaacatagacagtttttctcttctctgaggtcatagtcacagtgttgccttgagatttgccatgttggtatcaactcatttttgttgcccttgtccacttcatttgtacagctcctcacctccagcccttcccgaaccttccatttatgtcagggaaacctaccaacccactcattatttttcaattagagtcagccctcatctggttagaaagttgaccggagacaggatggagagcccccaatgggaaacatgcacggttttgcgataaactctttttctcttaatgttaaaatttaactttgcagtatttcctcagctgtcagcccagtgacaaatcttctacctcctttcacgaaggggcaccacttccttctaaagcctgaagtatgactttaaaaaaaatacagtcagttatgtttctccaatataacatcaagtttgaatggttcctagcaggaagggaatcaatctctctctctctctctctctctctctctctctctctctctctctcgtagaattggggagtaagattggaaaaaccatagtacacttgagttccctcttgaaaatgtaatgctaacctctaggattttctgtttgaggcttgaattagtttattaatttgtaatcttataaatggttgagtcaaccaaaaccatgacttcctcttcaactatagaatcgtgtgtgtgtgtgtgtgtgtgtgtgtgtgtgtttgtgattttaatattctaattccttttctcctggaaaaaaaagcatactttgttgtttgtttagcattcaacagctcacttgatggacagattgatataacttttttttttcttctttcaaggaacatgccttagcttgggtttagagagaaagttaaagcaaaaaataagctggcaacaaccagacttcaggtgaagcaatatgggatactagcacagtgtagaagacagactccagtgaacaactgcagagagaaagtcagagggtgaggctttgtgcagagtgtgggtattgaacttgacctcccaactggataaacattgaatggatagaaaacattgggaaggtgggatgaaagagaagagaatccgccagtggagcaaaagtagaattaattccttccttccttccttccttccttccttccttccttccttccttccttccttccttcctgggaaagttatgaagactgtactattgagagcattgtggggaaacagtgtccggctttacagaaccccaaaaccaagtgctaattctgacctctttcttcctcttttgcagcgtgctgtacatcccatgtacaaactagacaagggctctatcactgagctctattactgagctctgtcactgagctctatcactgagctctatcactgagttctgtcactgagctctgtcactgagctctatcactgagctctgtcactgagttctgtcactgagctctgtcactgagctctatcactgagctctatcactgagctctatcactgagctctatcactgagttctgtcactgagctctatcactgagctctatcactgagctctatcactaagctgtagcttcagcccaggctacatttcctagtttcagattcactagccgtatgtgtctttccaacattgtaagtttaaattaagcaaatgctgagttcctccatcgtagcagccacctttcaagggattagtggctctagttcttgctgtgggaatgtcaataatatagactgttttcttatcgcagcaagacctcctggacagcacactgcccagtttcaataatgttaggtttggatatggagaactgtcaagttggagagctggcataataataaaaaccatagttgaattttaatgctgtcagtaaagatcagctttgctgttctcaccctcttcctcctctgccttctttctccccttcctctctattcttccctcttttccttatctttctacttttaattgctattttgttgttcaaggaccaaacacagtttgccagcaaattgtattttgtatatgtttttaagaatgtcatgcttcatttatgttcatcagtcacgtactagtttcatagtcaaggaactagaggattttgggaaacactttttcattaaagtagattttaaggagaattcagcttagtttatcatgacagccagggcatggaaaataatttgagtctagaaagtacaaaaggaatgatggtataaagtgatcctgttgggatgtgagagagatctgaatcaaatgatgttgtaagtcattaggagaggggctgaagagatgacgcagagattaatgttctgagatgcacagagatgagtcatgcacaggacccaagttcatgtcccagcactattgccaagtgcctcagaactgcctgtagctccagttccacgggagtctgcactcctgaccctcaggacacctgcactcatgtgcacaaatacacactcatatacacacacgcacacacacacacatttatataattaaatctttaaaatttaaagatattttgatacttgtttgaatggaggtgtaattcttgaccatttcaagttgttttaaagtattagaatttgccgggcgtggtggtgcacacctttaatcccagcactcgggaggcagaggcaggcggacttctgagttcgaggccagcctggtctacagagtgatctccaggacagccagggctatacagagaaaccttgtcttgaaaaaccaagaaaaaaaaagtattagaatttacttttcgataccatagcaacagtgtgtatgatcagtagcttctgctccgtagcagccagtcccttgcttgtgtttcctatgtgtgagagagtgttagaatctccccaggaaaaacatcaacagagaaacagtgtgttgctatattaggaatcgcttcactgctgtgataaatattttattagttaatattgcattttaataatttgtaatcagtaataaatgtttatgtagcatgtatttatttttaaaattttgttgctaataatagtcactcctaccaagttgtaaacactctgataaaaatgtgcagagatattaaaaataccacatactaggcttctcaaaataagtttctatactatcttaaaaattcatgaaaatttacgagagccctggcccctgaaacattcaatgtagctactccttgtgtcccatgggattataggaacgtcttggttatcctgtaacaactacatctgttctactttaaatgatgtttttgttgccattagtaagaagttatatatggccccactgaacagccttcatgataaaagtgtttgcttaagtgtcacagggacactcttcacacaaaaatcaagattcaggcaaaggctccaggcttgtaaaaccagattagtgtctgagatgaaatggctgaatattatacttttttttattggtctcatgagaaatactatgtctaagagctggggtaaaataaacagatgaggaatataattcaaatatgaatttagtttagcatctcataattacgaaagtttctggttacttttccaactgtcctaatagaagactgtgcccctatgatttgtaataagaaagttatcttctaagccagtggttctcaacctgtgggtcgcaactcctttcacatgagttgcctaaaatccccaggaacacagatagttacattactattcataatagttgcaaaattcccgttctgaagtagcaatgaaaataattttacggttggagggtcaacacaacatgacaaactatgttaaagggtctcagcattaggaaggttgagagccgctgcccgacacactgatggtcttaaccatcctaacctgttgtcctgtgtgtggagagtctggtgctcacagttagctgagcaagaaagaatcgacaccatggctagaggaaagctggtggctttgggggttgggctgatgagtttggagaggatgacatacctgttgtcaataaattaataattctcacagtcacctttagattgcatgtatgtcttctaaattgatttcatgctttttggtattatatagttcttgtagcatccttaatactgtatagtgagtctactgagtgctagtagactggatcaattagtccagacttggggtttgtatctcaacaggtcatacagataactctagtgatcagtaggggtgaaagttacgctataaatcaaacagtgacatctcaaattcattatatgagtcttaaaagattttgcgaagtagctgtatttcaggacctttcagaaatttgttttttgttttttgtttttgtttttgtttttaaattgagagtgggatgaccactagattcagggtgttgcttttaacggattattttacgccatcatctaattataaagctgaaacatgagctcagtcagattcctgatgtgaacatcgctctcagtaccccttgccctgacagtttcttacgcagaggcaggaatgacacatgtacgaccctctctgtacagcagcaggtggctgctgactatgtcacgggatatttctttcagtacttttgcttttttaatagtaatcttagcacatcaagacaagcagggttcatgatattttccttttttcctaagataactttgatcataaatgggttttcaggtaacctgtctggcaggggtggtggttgtcctagtggcaaaccttgcgtcttccttctttgcaaacaaggtgggactactgagcccctctggagaggtcaagtgatggtttcctggggggtaaccccctccccatccccaccacacacacacacacacacacacacacacacaatgtatagcatacagtatcatgtatctgatgataacagaagtaaagatcactttgaagagagagaagctagaatgatatagttgcctatttagacacagttatcatttaaataagcaggtgttgctggttacagagtaacttttcagaacaaaagggctttgtccttgtggcctttagaaaagtttgccatttgtaaaccctgttctgctgaggccagtttttattgagggctgatttgttagaatggtggaccatctggcacttcaaaacttctgagactttcagggaggggggggggaaagattgtgtgctgtgttattaactgtcaagtaaaatgatgctgccattgtggtatggagagcgacctaaaaggatgaacatggtttacttgggagtgttctagtggacttcattttgtgtgaaaaaaaatattacatgatcaggtaaaaaaatgtttttcaatttaaatcaaggagatttaagataaattttatctctccatgtccatttctacattttttctgagtgatagccattatttctatcatttgattgttccgtttaccatagattattactaaataaagcttttatcatcctcctcccctttgaagatacacatatggcttatttctctctgtgcactatttatttgccagcctatccacttttctgtgttccttaatgcgtgaatctgccatcatttctttacatgtttcctgtccaaatggagcttattgtgaattcctgtgggtagaatttctgtgtcaaaggtcataagcatttaaaattatcctctgtccccagactgggcagtttctagtaatcttcaggaaatggagtggttaccctagttctgccaggcataggcagaactctaaacagcccacaattttctgtgtcatggtctgggttgactgactgtgtttggtagaagaagagtgtggagaagaaacaaagaaccagtgtagagctcaatgcgcagaacacccatagaaaggagtcaggcaaagacacagcatgtcaatcagagggtgggtgcagtagagagagataaacaaagaaaattactgtctctgtctttaggggcgctgtatttgtgcttcctgtggaaagtgtacagactttgatttctttaacctgggcattcccacaaagctgccaaaccttccagagccttcttcttaaagctccatgtcacgtggccacatctgtcctatgcgcttacactgaggcttggctgttaagagcattttacccttgtctgatgctgcattgttttcgggaaggatatattttggggacagtaacttgtctcggtattattttctgaataacctactatagtgctctctgaatccttaactatttagagggccgtggaaagctgacccctgcacctggctggctaattcagaagtggatcagctggcgggcctgcccctgaaccccttccccactctcccagggaagaaaaaaagctctttgtgcttttaccataactgttaaaaccttctggccatgaactatggaaacatctaaagtagtaacttttttttcttatgaatggtgttttttttttttatttcccaacacccacccttatcattatcaaaatagatgtggcatttattaaaggtgaacattataaaataagaccttgtgcacagtcttatgccccggcttcctgggatgaaaggaggtttcacccctttcatcagggggctcaggcctccatctcctggttgaactttctgccctttggggctgtatattaccttaaatagcttgcagctgacagactgcactgccggcccatgtgaactggaacgctgtaatggatggggtagcgtctcctaatggaaccaccgtggtaggcgacaatgagaagaaatctctcctcgggattaggggcttggagcgattttattttattttatactttattttattttagttctgacctccaagttagcaggttatgaagaggagaaatgaggtgatttgcttcacaagaaataaacaagggtcttttcttgagtcagaatgggcttacagcaggcacaatgttcttgcccatgcctgaagctgttcattttgtgaatcggccagccgccatttatctgtggccacctattgacccccgtatgctttgctttacaggctcctaaaatctctttcttttctcagggttctttgtattggccacatcaggagaaatctgttaggttttatgcagaaaaaaaaaacactttatttttacagttttaagacatgtgagcttggtatttagagggaaggaacgcttaagttcactgtaggagaaaatatcagttccccaaagctactctttatgttaaccctagataatctcttgctgcttttataaaattacaagtaagttatcttttagcaagctatacgcaacacagtttttaaatgtagaatattactttatcagcctgctctttggaagttcatggggaagccatacaggccttttcattttgacactggaatgtggttttcattaggtaatttggatttggattttattggttggattttcctgtgcttctccatggttccggggccttccttggctttctcatggaactgtatgcttgaatttgaaacatgtcttacttagctaaagattctgggttgcttaggttgatctatcgtagagaccagcagcttggcatgccttcgcactcctgaggattagtgagccttttatttgcacactggtttaaacggagaaaatgtcaactacttcaaatgccaccatccaatttgttgtctctctggtggctttttaatttcactggaggcttctctaggacttataggatttacagaagataatgtatcaagaaaagcttgctgtacaaaaaagggggagtacatatcacaattcatgaactgaatttaaactgaggaaatgtcatcaccaatagatagaaggcagttcactacatttagattttcgaagtcttacttttaatgcctcatttccaagctcttaatttacatgctggagctgcagctgaatgaccgatcactttcataatgtagataaggccctgagtttgatcatctagaacagataaatgaataagaaaacataacaatacagatttagtgtggtgacagtatgtaattaaagtgaagactacggagattgggactggagaggtggcctggcccttaagtgttcatacagttctcccaggccttggggttcagttcccatccaggtcaggtggcttgcagcctcttgtaattccagtcccagcagatccagtgtgtttcttctcgcctttgcaggtaccggcactctcatgcacatacccatacccatacatacatgtataacaaaaaataaaaatcttaaaaacaagagtgtaaagatgtcttctgaggggactggagagatggctcagcagttaagagcaccgactgctcttctgaaggtcctgagttcaaatcccaacaactgcatggtggctcacaaccatcagtaacgagatctggcaccctcttctagagtgtctgaagacagctacagggcacttacatataataaataaataaatcttaaaaaaaaaaagatgtcttctgaacgactccaccacctttccagtggtttattttgaatatagaccccctagtctatgctggtcacctttgtttactgcaccatcatagctaggctgacccccatctttgacagttttgacaacggtgtgaagaaaattctatctcagtgccctctcttctttgccggcagagggtggcaattctgagaacgggcagcagctttggtatgttctactgcaaagctgctggtcccctccttctttttccttatcctgtacagaatatggacatttaccgcactcagaaatgtgtcttctctggaggagatctgccctaaagaaggatgctgttattatgccttgacctttattcttagggaaggaaacaggatatctcaggcacttctaatagcattgtgctccttagcttggtgtaaaaaccctctaagggtaagagccttcttgtgcttcctattgtctgttgcttggtagagtcttttcagttcactctttagatatgtgcggcctgtttgcacatgtcagctcacagtcctgtagcactctgggtggtagctggaagtttgcccagctgagagagtttgctctttttcttcctcttatttatttatttattttctgggtggtggttggtggtggtggtagctgtggtggtggtttcttttgtcttgaatttatgtaaaaagtttatttgttgctgtttaaagatctcagcatgtggcctgagccctggcagactgggtcaccttggctaaagcaagggctgagaaagagtcccctggatgtgtgaatgtcagtactccagtcttgtccagtctgttttgagccacattgcagactgcttttcctctatattttctgaataatggttggagaaaaatgagagtttctatttatccatcaaaatgtggtgctttggaaatcctacatagccatttttgccccccaggggaatatatagatttctataaataagtaatgaaaatattttaaaagcttgttaaattttgtataaatggacatatgtaaaacacatgctatggaaatactgatgtgaaaataggttgggaatgaagtggaaagagaacaggtttgtagatcagacacctgtaatagtgatggattcctggtagatttgaactcttacatgtgaagatctttttgtataggtttaaatggatgctcacaactttgatactcaggtaattgtgtagaaaactctaatttcagcgtgctcttccacctttgctgttgacctgatgcaaaaaagtagattcagttgcattaagaccctttgtgatgtgtccccattaaaacactgtttatggtaaaaatcctccccgtgactagagaaagatgcttcctatggacagccccaccgttcttaccttttatggctatgctaaatagctatgtaaaacaaaacaaaacaagacaaaacaccctgtgaaatggtaggatgactgatcagtacaaaggtgtagtttgttctgaacttccccctccaaagtcatcccacctgaagtggaaaataagttcggtgtcattggttgtcaaaattggaatattttctttcattttgtccgtatcaaattctccttatgcaaacagaccgggcgactttttaataagatcaaagaactttaagaactatttccctcatcattttgcctttgcagcccgttttattttctttgcactaataatggaattaatgaagcttgtttccttttgtggcatgtggtgtgtggcgcacccactcccctttcttttcctgggtgggctcccaaggggactatggctcctggggtctattcaggactgagacaatgtaaaggatactgtactgaagtttggggcagggcggcctccaggaagtgggaggaagcttcagtcctgctgggtgaggggtggcgggagagggaggatgctgattaaaataataaacaggggcctaggagagagtccgggtgctgtcagatcaggtctgggagtcgcgggagctgctgcaaagctccctctgggcactgcacaccctgtcctgaggagggcatcctgagatttgttgcaagacctttccttccggaccggagcaaagcaacttttaaaagttttaactccgcggcactgacagcgtaccttaggctgtgctgaagtgagcaagcggagtgaaactagcttggtggtcaccatagcaactgtgcttctgctgtctgggagaatggaagctggtggtctcgtgtctcgggttttttggggcgtcttcagctaggagcacactcctgcttactggaactctacataagccctgctgttttaaaattggctcttgactcagactttttttttttttcctgtcttttccttttttctttttgaaggcagcctgaatggaggaagttggtaatgcttggctttttttccctcccttctctcttgcaagtttccaggctatagctttttccccctttcctttctgctgtgtgtaattgagaccaaactctaagcctgggctctgaagagaacagtggtggcctgcaggtctttagggaggccggcagaaagagatcctgggcttcccagggcaaaaaaggagaccatgccagcctcgtggaacacagctacaagaaaacacagaagcaggtctctgcctgccgagctccgaagtccgtgaggaaacggacccaaggtggggtggctaaaatgtcccagcgcaagctgctgatgctcatgggccaccgctcaagggcaaggattgaaaaggattttacgaaggagttgaaagtatagctagtgaagatacgggttttaaaagttggacgttgttgtctgaaggaagtttgccaggaagatgtaggcttcaagggctcccggacgatgattggtctgaacttcagcttacgagaattgttgacaaaatttgaaaaggtatgcagaaagaaaacttcacggacgcacttctgttttagttctgtttcttcttctgtttgtgctctcctctttcttcttcttcttcttcttcttcttcttcttcttcttcttcttcttcttcttcttcttcttcttcttcttcttcttcttcttcttcttcttcttctcctcctcctcctcctcctcctcctcctcctcctccttcttctccttctcctcctcctccattgtttactgtaacttctaaagcattttcatttttaattttaatgtaatagcttctttgagattgtgttttagggaacatagttctttcccttggtcaggaagagttctcatgcttgtcagctttaacgttccacatcagaaggaatggcttagagtcaagtcagctggtaacttaattgcaatttatttggggggagaaaacaaaacaacagccaaatccagcaacaaacactgggtttgggtgccaaaggctgacttcatcaagcgtgtattctgttttccatgcccctcaggtttgtttatctctcaggctgctgcggctgagcctgcccttgcagccccggctgaggattcagctctgagccccagaagctggcccttggtaacgatggcacatctgctgtctggcatttccttcagaatctcttgttttaaaagtggataaggtttaaggcttggattactaactttgcacttggcaccctctcttcccccaaggctcttggcacaccccagggtggagcatagcctgtaaaaaggctacctcctcactttttgaattaaacaaagcagaaacctccccgagccagttagtggcttcctgagtgccagtcttgttccagtttctgctacttaaaggagtggggagagaaagaaaagaaagaggcagggtcctttatccctataggcacagatgaactgtttatcaactgttaaatgtgttctggtttttcccaccattcctgaaagtacaaatataagcatcttgaatcattcaaagaataatagactttttcttaggaattgcaactgccagaggaaaagatgtaaaaagtgataccctttaaaaaggtggtaggcttttcctgaacaattgcagccatcctggcttcccagtgatggaagcagcctatcagaagtatgtataacaacagcaaaaagttagtccctcctcatagagtgcttcctatctcacatcccaacttgagtagtggagaatttgcttgtaacatgggacagacctgttgctttcatagttggtaagggtctgaattctggagagcaagagccagttcacagttggcttgctcacttacaaagggcatgacaaagaaagaatatcgctcttgtggcagctgcgaacagcaggtgacaaactttatggccgtaaagaggtctgttagcttgttttctgcagatttgtctcattcacataaaaaggtatagagcatatgtgacaggaataataattcatgcttgtcatcctcacccccctccaataatcatggtgcaatagctggacttttgaattctaattgctgctatttgtcttcaggcttaggtcagatagctgaggtgagcaacctagtttcttaggcctctgggccatcttgtgggtagagtcagatgttctgacattggtatgctttctcctttaattcccaggccttggtatctgaacatgacttaatcttgtttttactttaggagttgacttgacagcaaaagaaaggcttatatatgtaaaaggcttgatttgaaaattttctccaaggatagatttccaagagaccaccctgcttccattgaatatgaactttatgtatgctcattcttgtggtgggcatgttttcaaagcctggatgaaggtaacacttatatgtgtttcactggtaggaagccatcacccaccagtgtgtatttttccaactcgcaccttaaaaaaaatccctttgtatattctaacaaagctgtctcatatattcagtttatgctccattaagtcattgccaggaaaaccggaattctggaaaggtttcactacttcacacctctcaaattcagctacttccctttctctaacccagaaagcaacgctgccatttctggggacatttgaactatttgtaattggaaagccacgtggggtgctgactgccacttgcaacagtacactcaactcccttttcccgtggcatgcagaagctaccatgttcatttgtggtcttgctttattccaaagactgtagaagctgacctgctatgtgcagtggtagactccctttattccatggaatacaggagctgacctactatgtgcactaggggactccctttactttcagttctcttagtttttcttcctccttctcctcctcccctcctcctcctccttgcctcagacatgccaccattttcataacagcagtttaattgttcaatcagatggtaagttatcacaaccaaatgtcaattttgctttatttttaaagccatttctggcttgaagaaaactaagagtccatcttgggatagtagatgcagatttgatatgtttggtaattgaggtccgtgcttggcaggttacccagtgctgactgatactgagagattgacttgttagatatctaagatcattggatggggtgaaagcaaaccttctgcccgcctttaaggcaccagactgtggagatgaagagaaagccacattattttaaggaaactagtgaaaactttgctcttttcacacatatctgaacatctatcatatgaatgaatatctactcctgggcagattgcaactaggactcgtgtctcttcaaaccaccatgttatgagtccttgggggtccaagaggcaggaagctttcagagatgctcatccaagctcagggaaccattccctcctaagaggaggaccttcttactagaggataaggacctcaccgtgtgatggatccgccaataaggaggtctctcagtatccttaagccacatgcagctatgcccatgaacctgagagtgacttctcagcaagctcaagtttgtagacaaagagatgactcaccagggaacccctgtcaaagcctctggcttagtttcatggttccactcattttaattcaccagcgtttttcttgagcaaactttcctaacgaaagcataacagcgttagtgctgtactgtcttagcagagcctcttgtattgtgtactggttttgtgtctgttgcttagtcctacagagacttgagtaatgggcagctctagctcagtgacattttaaatgactgtcgcttttattaatttttttatagccctgctactagatgattaatgataatggtcatcccaaggggttctgtttttgtttttaatcgacagatgataatcatacatctttatggggtaacatgtgacaatgttgttacatttatatattatgtcatgattaactcaggctctttaagccatccatcatctgaaacatttatcattccattgctctttagacatacaaaatctcctatcacagtttgaaacatatgatagaatatggtcggttgtgttctcctttgagggatccttaccatgtatctggatggcagtgttcacttggtgagtctttaaagaaagagactcttcatagtgacaatatagtcactgactatgtaatgcatctctatggcatttaccccctttatcaagcatgagtctgatattttaaaagctagaagagaagtgagccatggttcataggtgatggtctatcatgttggagaaaatatggctgccatggtggttttgttcccactggtggcaattaggatggtttgctcatagatgtgcaggtacaacaggagaaaaactggattggagagaagtggggccagggtataatattcaagcctgcctgccacttggcaaccacatcctccagctagaccctctctcctacagtcttcataacatttcaaaaacaactccagtaaattttaaatacataagtctatgggggacgtttcacattaaaactgttataacctctgagctatacctccaaccctccaattaaatatttaattcaaattaaatatttaatttaaatgtgggtagatcctggaagagacagtaaattccttcatttactgtttagggaatatttctgaagtaccagttatcaaggttgaatgtagggatgggagacaaccacgtggggcccactctttccttcattgggctattgtagtggtaggatatagaccttaagcgagaagatttacatgataagtgtgcagtttatcctattgtcttagttgggtgggtttttgttgttgttgttttttgcttgttttatgcgaggagacacatgccataaccaaggcaaattttataaaggaaaacatttcattggtgctggcttactgttggaggtttagtccattatcatcatgcctggggaagcacggtgtcatataggcagacatggtgctggagaagaagctgagaattctacatcctcaactcacaggcagcagacttgaacatctgagagctcaaagctcataccctagtgatgaacctctaccaaccaaaccacagctactctaacaaggccacacctcctaatagtgaccctcctgatgtgcctctaggaaccactttctttcaaacaggcttattttgtccagtttcttttagcttaactgagttttgttttaattcagcttacttttgagatggggtattctagagttggtcattgtgttgatcagtttgtaatcaagttcttggtgatcctcctgcctcaacctcccaagtgctgggcagttgcaggaatgagccctcacactcagccaatagcaagtatagtaacagtagaaactggttttataaagtctcctctggagaaattgcattatatctgtgatttcaaaacctagtttaagcttaaggagaaactgaggttgtgttccggtttgcgagctcctgcgcagcatgggtggatttgggtggagggagaaactcactaggatcttcattgacagagcacagcagcaacactgattgggatttgaagagaagcttaccccaggattgtagctttgaatgtttgattagtgtgaaggacaacagtccattggtgtgaggtcagacttaagtttgatcacaatgctggatagaggagttgagttaaaacattatattggccacttgaaaggttaagggagtgttcctagaaacttgtgatgcagatagtctgtgcttatgtagtgtgtgctttgaaaggaaagtcactgtagtgtgatttagtgtggcttaaaactatatggtttagacgttcagagttaaaagcttgaaataattttttttttttttttttggtggtagaagatagttctgtttacagcagtgtttacatgttggcatttaaaaagcagtttatagtttattggaaactggcttgttgaaatcaccttgaaattgtagtaaatggtgatcttaaacttagtaaattgtaaattagtaaatagacttgtcataggttttgtctctttgatataagtgtagacagatgttcctgcgactctcagttgaggagtttcctccatcagattgtcctgtgagcttatctgtgggatatcatctttcttaattgcttattgatgtaggagggcacagcccactgtgggcagcaccatccttatgctgaataagaaagttagccaagcaaaccaggaggaacaaggcagtaagcagcatttctcagtggtctctgcttcagttcctacctccaggattctgtcctgacctccctagtgatagactgtgacctaggagttgtaacatgaaataaatcctttcctgccccacttggttttactcagtgtggtatcaaagcaacacaaagcaaaccaagacaaaagtttttctactccattatcttacatatatttacatcacaaacagtgggagaagagcattaattgctctgatttcttaatttgtaaaagtaaccgtcaatactatcagctttacagtcagaatggcattctaatgttgatcaaaataggactcacagcttgactcaaaatttcaagacaagttattggaaggaaatacagtatttagcacaattaatagggtaactgaaatcaataaataattgagtaacttcttacaagtttcaaatgctgaaaacatacttttgacttgacatttgattatattaactatttatttttatttggaaaaatatctggatttttttcaagttatgaaactcctctttaaaatacaaagctccttgagcatctctttcagtccatcttccctatctcctggatccaacatggctttttaaaggcacaccggatttatttttcatcccacgggttactgtgttcatttagcctaagtttgggacaggctaatggaataattgctcatttcccctctccaccttcaggacaggggtcaacactcctccagaggaaacattgctatagccatatagggttagagaaataagccacgcaaaaaataaagttgagtcaattagtctcaaagagaatgcatggaatctagcagggatttagctgttgaagttggcttgatggtattatgccctattagaatgttcatacagttctgtttgggtaaatctaaagaaacatttttaccttccaagttacattagtagtgttagtaagacatagggaacagagtatatcagggcacagtggcctatatctgtaaatctaacacttgaaatagtccatgggaggatcaggctaggatacatagtgaaatactcactcaaaagcaaaaacataacaacaacacaaacaaattgtgtgtgtatttgtatttctgtgatatctttatttatatcttcattaaaagaatgaccaaatgaggcagatctgctattaagatatcaaatataaagtaagtacaatacagaattaatgtattcctttctttgtgccatttattggacctacatagtgagagctattcacagaaacactactgctaatcagcaaatcagcaaatcttacttagctctggaagccctgttttggagagctgtgatggggtttgcatctcatgctactgatggtgtttcagtaagaggaaaagtagtggccttcttttccagcccttcttctttcttaaccctccccattgtgcttacaccccctacatgcatccttaggacatttaccagccttgttttcaaggtattagttcaactacttgctccagtgtgcacatgactggtttatgttaagagcttggaagagaattgctttgtgcttctagatggattacagtcccttgctaattatcagtaactgtttagtgctatttaaccttctgcagggcttgctgggtgacagaggtaagcattaatagaactacatcttcctggatggccaacaaaaggaacacttcctttatggaactttgatttattttagcatttagtgctgcttgagggtcttgccctcaaagccctccgtgctggcatcttgattttaaaagcttcgcatcattgcacagctatctatcaaggagcatgattcattaacttcatttaattctgagtttccagtgagagcgttgataggactttacagcaccggcttctaaatgatttcacgtttttcatatccaaacttttaagtgaggaaattgaacttaaacatttaccccattgctgttcaatccatcacctgcttcctttgtcactactgtggcttacttgtcaaccagtcaagatgtatgagtatttgtttatgacattggtcttttatgttagacttattttgtataacagaagctgtgaaagatgcagaagaaacataatacaattttcttttttttttttttaattttatttttttgtttgtgtgtttgttttcaattctgggtgattttggaagaatatgtcaccaaaaggcaaataaaacaaaataatgtgtggtgatctctttttctttgttcatgttctgattgttggcgtttcttcctaactgttgatgttgctctcatatggaagggtttctcacatcttgcaggctttattccaactgggacatcactgcagttctctctcagtgccttcagggccaaacatctttactgtctttgctgaattgggaaacatatcacctgccatgattgtgaggagaaatttgcttcacatctgcagtgtccaaacgtatgaagttaggcagtgctcttgtggaccatagcatttctatatcctgttgtacatccgtctttctggtctcgtggatctgaagggtagcaggaaccaggtctaatgtgagaataactttaaaagtcccacactctttacatattcttaaaatttcaatctctttataatatccatctcttttaaatccaaagtctttttacaattaaaagtctcttaactgtgggctccactaaaatagtttcttccttcaagagggaaaatatcagggcacagtcacaatcaaaagcaaaaatcaatctccaaccatccaatgtctgggatccaactcacgatcttctgggctcctccaagggcttgggtcacttttccagccatgccctttgtagcacaggcgtcgtcctctaggtgcctgtactccactgctgctgctgctcttggtggtcatctcatggtactggcatctccaaaacactgcatgacccctttagtcctgggcttgaggttgtgttgtgaatttttggcccattgttcttaagaatctgtgcagagaatataaggccaagttcccttggcaatggaaagcaaagagaggccttgttgattctatcattgagtctcttgagaaatatggtaatgatatagatcaacagcactgcaaaagtagtcttctaagtttcatatacaaatctatacgtatgtaggttatactcaatgatgcttcagattttgattcaagtagctatattttgtggttatacctgcaccctttaaagctggggtcccaaaaaggaaactcaggctgcatcctgttctttgaatagatactataacatgtttttaggatagatactgtaacaagttcttaggatagatactgtaacaagttcttaggatagatactgtaacaagttcttaggatagatactataacatgtttttaggatagatactgtaacaagttcttaggatagataatgtaacaagtttgtttttccgtacattctgcaagtaatttcagtattaactttcacattcctatttaatagaagaaaaattatttttcctttattatttcttagtgaagctaaacatatgtgaatattcttcaaaggttttagaataaattgtatgagattaaaatgacaggcagagggagagtaagtagtgacttacaatagtaataaaaatttaaaaaatgcccactccctctaaaatactaacatcaaacaggatggtgcatgaatgtagaatgttataaattctgcttttaggacactgggaattgatgtattagagatttaaagactattattttcaatgatggaactgtgggaatacttggttttgttttacattactgatggtaaaataaagtcttttgattaaaaacagttcttctgcacatccaaaagtaactgttcatgtaaagatcctgcaacgtgccccaagtgacctttagcatttgcatcatctctttgcttttctatttaggacatccaggcagaaattgatgcccacaatgacatatttaaaagcatcgatggaaaccggcagaagatggtgaaagctctggggaattctgaggaagcaacaatgcttcagcatcgactggatgacatgaaccaaagatggaatgatttgaaggcaaaatctgctagcatcaggtcagaccactcgagatttaaaaaaaaaagtgtgtgtgaatgtgtgtgtgtgtgcgcgcttatgtagatttgggtctatcagaaagagaaaggattagtacaactctatcagaatttgtttaagattgaaatccaaagtctgttttctttccagttggtactgaagatatacttaacagtagaggacttaactgtggattaggtcttgggttcaatcctcagcactaccaaaagaataaatatgtagttagaagtttttgcctcgtttatatacccagtgtgctctactatttgttccaggatattcatagtcatgttttaaaccatacaacaatacggataataatgtcactgacacttgctaattgataagtgtttatcattatattgtatgttttatactgtgttaggatcattagagccctattgatctgtctatctatctatctatctatctatctatctatctatctatctatctatctacctacctaccatccatccatctattaatttatttgagacaaggtagtagtactgggtggcttagaaatcactacatgaccggactgactttaaactcagagttatctgctcacctttgccactcaagtgcaggaaataaagacattcatttttcacagagcaggcgtgctatagcccaggttgaccttgagtttattgtgtaggcaaggttggcctttaatgctttgttagaaacaaaaacaaaaacaaaaacaaaacccttcatttaaattatgtacatgtatataacttttgtaaatgtatgtacaccatgtgtgtagcagcccatggaagtggaagaggacatcgaatcccctagaactggagagctgccatgtagatattgggaaccagcctggctcctctgcaagagcactaggtgctcctaacttgtgaactatctttctcaggccctggcctttgactttttcattcttcatccagagtgtgctgacattacatacaagtcccatcctgcccatttagaacaattactttacttagtagtcttgcactgtgtactaacttatccatcactttatgtacagtagttgtttcacacaactacttaatttatactatagagatctgatggcttctcagaacgtgcctctgttgttaagtggcacatgatagttcttgaaaaaaaatccctgtaaagtagaaggtcaggatttccatatgagaagtttaatgaatataaagattaagataataagataatagccagaatttgaatgtagatttctttaaatcttggtattgaatctattttgccccatcaagtgtttatgtccactttgaaaatatatttatttattgagattaattgcctcttataaacactaaaatgtagaagtgatgattcagttctgctttggatgaaagtaaaattcagttaagtacggacaataggatcagggctctgacaaggaaacagcattaacgaattacccagagtaacagactggtaccattattggacttcaagcacattttaagttcatactcagtagctgatagacagtttctaattggcagcaagttaaagggatacttacagaagaccatagtagcaagaatgataattccaaagaggaatgttggttaaagccttagatttggttgtatcatgtgttgaatatgcataaccttaaaaccaaatggtaccgactttgatttttgcactttgctatgtattttctgaagttggacacattactttacccctgtgaactttgccaaggtgtactatctgtatccaacacacttgattgtcaggaagaccaactagaatgatttgattttttctcaggctctgtagaccctggttaaagtagactctaggctattactcatacacaaggttgggtgagtggatcggattcagcaggtgttgggaatccatagagcggctgccagagaatggaaatcatccactattttttgtcctgtatgattttcttattaataaagaaaagtaccatgtgctctactgggtctcataaattaaaacttacaacccctctatttcttaggaagagtgaattgtggcgctatgcactcttctccctatagctccagttggaaattatctctgcatcagccacctctcctgttcatttgtgctagagatggaagcccaagctttgcttatgctgtgtagatactatctatgtttatgtccatatggactcacttgtgttttctatgattagatatgtgtaactaaagaggaaagaacttttcatattttaatcttcaaatatgtaaaaagatgaaatcacgtatcctttatgaatttgtatgagatagtggtttatctttctcagtagtgggctcttcacataggaagttcagcttagaaagaaggggaacaaagcagctttggagagcattgcgctttgcagagacactatgtccaaacactggtgttgtcatgcagcagtcagtgggcaggttattgacccatgtgtgtgcttcagtttccttgtatgtgaagcaagagtaatttccttagtggggcttccatgcatgttttagttagcccacatacaatacatgcaagaagtgggtcatgtttattactgctatcagccactacttgtgtggtaaattcctctcctccccagcccctcccatatcttagtcatgagtgtaggaactgtttgagggactcaccagtaagcagtgccctctttcctggctggattctgaacaaatgtgaaagaaaagtgggtttagccggcttcctcacaaaatctaatgccatgggaatgacggacagaagccaggtgaaaggaggaactggcttagagcttaggttgctaactcaaacctagactgatgcagaattcccagtagtcactactcaaaggtggcttcccaagtgagacaccctacatgcaaggtctattattttacagcaaaattcttccctgggccagtctctttctggctccgcctccttcattatacacgcaaatgatgtgggtggagttgctgttcagatcactcctccctttcttctctggctttaggagtccagcctggtactcacattgcctttaggagtccagcctggttctcacattgccttctgttggtatccgattatcactcttccctgtaattaattgaaaattgacttttctcttaattgccaaactttacttgaaatgttctttaatagaggttaatttcctccattttccttgcctagaagccagtgggaatactctgaatattaagcctcctgtggacaccacgcattaggatatcagtcataaactggccgtggaaggcagtttgcctgcagaagtagccctgtcacatagggataggtggccaattggcagcctcttgtggctcctcctgccttgattcccatctcttcacatctcccccccccctttttttttttaaaacaatgcatctatatttctgcccctttatcatcttactcctaatctataggggcatatggttcctttctctttgaagtacacacactacttccttttatcttccgccctcagctctcagccttggtggaaacattcacactggtaactttttcttccccgacacagactttctctgtgtagtcatgactgttctggaacttgctctctataccaggctggccttgaactcagagagttgcctgtatctgcctctctagagctgcgattaaaggtatatactatcacccagcaataacatttttgtattttaatcttcaagtctctctttgcactgtctgtgaacgttctcagctcatttctattcttaagtcccatagacctgctcatcctgggcttccattgatttcatcttcatcttggcctccttgagatcacccagtccccaggggaccatgggcagggtgatctccagagggattcaggtgcattccactggacacgtgaattcctcagagatgggccttggttaaaccaaatcaaacttaggcattattaatgaaaccctctcatatgaaagtgatggaccttctccagctagggcccctttcctccttagctggagccatctgtgtactattctataactgtgttatttacttcatacaatttatttataatgaagctacattactctagccacctgcactatatttaaaaatgtagatcctccaacattttctttttattcattgatttaacatttttcacacaattttgatcatattccgtcctctccctcaggtcctctcaggccaccccagccttgttccagccttttccatgatggactgcttcatttctgtcttagtttggttttccagtgctgtaataaaagcaatttggggagggaaggctttatctccctcacacttcaacgtcacagtctttcagggtaggaactgagcagagactgctagggagccttgctctctggcctcttccgtggcttgtgcagctttcctatacaactctggaccacaagggtgacctcacccaccgtgagctgggcctttctacatcagtcattaatcaagacagtactccacagatttgcctacaggccagtgtgatagaggcattttctcaaccccttccatccagcttggagctcttcataacacattctagtcagagccatgcccttgtattgtcccccaaaccccagttgagctttctcttctacttctattcacattgatatatcctggtcaccaccttctctctatcccctactattaatcttggattaattgccccctccttccctccctccttccttccctttctgtgtatgtgtgtgctcatgaccatgtgtctcttaagatgcttctgcatgtagacacacaaacatggagagattaaagatgtgtattttcctttccacttttaaaaacaatttttgtttttgttgttgttgttgttaattttgaggcaggttctctcattgaacctggagccaggaagccccagggatttttcctgtttccacatctccagggttacaagtgccaccttttatgtggaagctgggaatctgaacatagaggctcatgcttgtatcccaagcattttaccaactgaaccatctccccagatgtgtggtgctttaggaaggggggtggcaggcagaagctaaggtttctttgatataatttgatactgcctactattgctgttataattctgaatatttttctattttattcactgccatgtctatcttcaaaggccttgttttctcttcagtttccaagcctttctttctctggatgacttaatcattttctgaggatgaggccatttgattgataacaccctgccccttcaattccataatatttgtggattgtgtatttcaaatagtgtttagttcatactaccaccatggggaaatgtttcttttaatttgtttttaggaagtggatgtatgctctttattgttttgttttgataatctactcttaaatatttatggacatcacctactttaaccatgctgtggtcattggaacagctacctgaactattactttaaagatttttggatgaccatgattgagccctttaaatattaaaattcagtgtgctaaatatgctgtatcatcttaaatacaatccataacattataatatatacttgtatatattatataatgttgcatagcattatatataattatatataacattgattttatacacacacacacacacacacacacacacacacacacacacacacacatacacacgccagtacacaatggagtatcaggtcagtatataacaaattagctgaagacttaagatttcatttataaaagaggctcttaggagtgctggcagtactttatgatcacttttaaaactgattggaattatactaataaattcaagactgaatgccatggcttacatttttaaattaaatttatttaatgtaagattatgttaattaaatatccacttatcggcttaatgatgtttaatatagatccatcctaacactgggtttcaaaggctgggcaagttgtcaaatgtgacagaaacagagtttaaagataaaaatctatcttgcatttcttttataagtctttttaacatttgggtcattgttctccaagcccttatgggcgatggctattcactgtcatccttggtgttgtcacattttacagcaccattcttaaccttaagggcttgtttttgctaactacattacaaagctaaagtctccttctcctaaatgtaacaaaacaagattctattctcctcttagaacgttctccagcagggctctctgtggtggcaggaaggagccctgtcaatctggttacaccatgcccggttagctacaagtggcattttgaactcttaaattatggctagtgtgactgaggagctgagtttaagtcctagttatctgaagatgtgtgtttccatagctgcacatcacaggtgtccgccatatccagtcatagctctggggtgctctttagtggctgaattttaaggactgtctgttttatttggttggccttccatgctcattttgggagcaggaataatctcttttgaatgttgtcaccttacatgtacattcttagttacatttgttgttggtttttttttttcattgttacacaatttaaattaagtgagtttcacaatatctgaaaagagatcacacttgtacttgaatgacagatttcatctgtgtagttttctctgctctgggaggtagcatgtctctgtctttgttgtcttttcactgagatccttacaaagcttaggagactgagtttgcgaaagtgcttttgacttgtgtaccatttagttgagcagtttatagttttcctccttttgctgttgctaaccaaagccgtggttggctgaagtccacatcttcctagtgctgcctgaggcctttggctccctcagtgtcccgatatttagcagagtggccatcagccttcccatcttgggagtgtatttggtgaacttgaaatttttccaatttgaccttcaaatattaacattttgccttttgttttagaagtcttgttgtacctaagggtgctccttgaacactggttcgtactgatgattgagaactgttttccttcctgcctctctccctctcactcccccttaccctcccacaccttttcttccccattttcttccttggacagcgtctcatgcatcacaggctggcttggaagccgctgtggagaatgatcttgcactgttgattctcctgcctctacctcctgaatgccgaggttacaggagggcaccacctcacctggtttatgagatgctggggaaccaaaccaggatatgtgcatgctaaacaaacactctaccaactgacttctggctctggtccccaaatgggtatcttttagcttacacgattttctttgttgataattatattctggagaggagtcagataatttgtttgatgacagttactttgaaaaatcactttggtgattcaaaacagatatgagtgtacatttcactctgtagttcttttcttaccatagccaattggtaaggaaagcttttaataaatgtttttcttctaataagtctataatttttgaataactagtcatgtaaaaacttataaaacttagagctttataaaatgatatttcacccagagttgggaaatctgtgtaaggcagaatccattatggatactatctaaggttaatactataatcaatgagagggtctattgcactgcaaatcttacatatggtaagtattaactgatgtcaataagacactgtgataattattgaaaaacgtttctacagataatgaactaggtaaagcagtgtttacctgtaaatgccctgaacatgtggatgacctgcgatctgtagtattggcacagttcaagctataaaatgtctatagtcaatggtgagagaccacaactaagccaagcacaaatatacagtttctccttacagagccttccacccactgaccaggaaaagactttcatcttgaaagatgaaagaactaaactgaatcaggaacagcaaaggctactgcagcaggctgggcctgtttgggcatatggtagtaatctgctaagcacaaaggtgcgatgtggagagtaagcagagcaggttttctaggcagagattctgtcagatgagctcagtgtttataatgggaaggcagagctatggagatgtacatggaatcgatgcttccattttcatttcaaagcagctttagcatctcttgtaaaagtgtagccttcatttgtgcagatgctccttctggggctggattcctgaacattgtaatgatcaatgatcaatcccagtatttctgtctagtcaatagagtccattgcactaggaagacatttgtgtgctcttcaggaaacatatagggttttattatcaagggaattgatatgtagcttatttattgatgatgaaattacagacactgatgatgccgcatcagatctgggtaagaggtcggatatgcacagaagtggtttactcagtagatagtcaacacttctgggttgaatggagagctgtgatttctagctgtctttgcatttaacagtggtttgtaagcaattgtaacagccctgtcagatatacatcatgcaacaagcattttgcattagggttcataactgtacagggattttggttaatatgattggaatgatttagacatgctctatggcaagaaagtttgtttatcaggatgacttgccccaaattaataagaatccagaaaagctggagctcatgtggaagcaggatcttgtcagaacacagctttgacacagaacactgagctcatcggacagaatctccgcctagaaaacccgctctgcttcctctccgcatcacacctctgtgcttagcagattactaccatatgcccatcctggcatttatggaacaaatagaaacaatagtaaaagaaagaagagaaaatgaatgtgtttgtgtgtgtcttgtgtatatgtgtcctcatgggttcatgctcatgtgtgtaagtacatcggaggccagaagttgaatcatgtgtctccccctctgtttttctctacttcattagttagtcagggtctccagctgaactcagagctcatggattccagctaatgtagctagatttctttgcctttctattgttgggattatgtgtagctaccatgtctgccttccctttttatttgattttttgcttggtagtgtggtttggtttggcttggtttgagttggtttggtttggtttggtttgagttggtttggtttggttggtttgggttggtttgggttagtttggttggtttggtttgggttagtttgggttggtttggtttggttggtttggttgggttggtttgggttggtttggtttggtttgggttagtttggtttggtttggtttgggttgggttagtttgggttggtttggtttggttgggttagtttggttgatttggtttggtttggtttggtttgggttagcttggttggttgggttagtttggttggtttgggttggtttggtttggtttgtttttgatgtgggttctggggatctgaatccagttttcatgcttgtccagcaaacaccctatctactgatctgtttctcaattctaaactaaactgagatttaagctatacagttttgaggtagttacaaaattctttgaacatgtttaagacttaaaaattatgttttagtattttatagctaaccttttggaatgaggcatagaatgttcaagtttgagtagttggttttattagccagatggcaacacatctgtgaagagatgggaagataattggcctttgcaataactgtgtgaatgctggcatgcagtattttaaagtgcacccagagaaccggctttcctttccatctagagtattggacggtagactccagttattgttatatgagctagagatgaactagatgaacttttagccaaaatttacgataattgttgagtgaggatcgctggaaatagctcctaaatgcgatcagtgaggtaatgcttgtcgtggtacctctagcaaaactgttcactttgagacagacgtgcaagtggaacagaggtgcacaggacattacctccgtggtctgagagacagcagtggctgagcctggtggatagcttccatgtccttggtaaagaatcagatttatggaagtgaggatcctaatgccaacatcatggtgaaggttgtcttagaagacatggagtctgctgaggtcccaaggcctgacactattactgaggctgtggagcgctcacaaaaagggacctatcatgactgctctctgaaagacccaacaagcagttgaaagagtcagatgcagatatttgcacccaatcaatggacagaagcagctggctcctgttgttgagttagggaagggcgattctgtaggaggaccagcagtctcaatctggacccctgagatctctcaaactctggaccaccaaacagacagcatacaccagctgattggaggcttccagcacacatagagtagaggactgctgagtcagtgtgcattcagagatgatgcacccaaccctcaagacactggaggccccagggagtttagaggtcaggtggtgtggggacatccacgtggagacagggggtggggagaaggtatagactgtaaaagagtcagagggtagatgtggggggggggggataaaatatggagtgtaaaaaataaaaataaattaattaattagaaaaaataaagaagacacagagtctgaatgtgtgctctatgtggctgaagcttctaagataacactctctctctttctctctccctctctctctctctttctctctctctctgtctctgtctctctgtctctgtctctgtctctctctctctctctctctcacacacacacacacacacacacacacctgttcacatacatgctaagcctttccctttggaagatgttgagcagtgaggctatgtgaatttccagtaggctcgaccctctgcacctggctgattgcagatgtgcaaggcagcccatctcaccagctcagcactgagttcacattcatgcccatgcactgggtatagcagtcctgagggaaatggattccttgaatgaatggaggttctctaaatagtacatgtttttaaatccagccctcctatgggatccaatctagatggatgggccttttccagggtcttagtgaaaaccaggaagaatttgtcctctgcttaatactaagattctcaaaggattctagtcaacttaaagccaagcagttcttggctagatagtgacttactgattttcaacagtttggagtaaatatttctaatgtcttaattctaacaatttacttcagtgtaagaaagattgggggttaatgatttcctctccttaaatgattagtctgggcgctgcagagatggctcagtggttaagagcaccgactactcttccagaggtcctgagttcaattcccagcaaccacatggtggctcacaactatctgcaatcagatctgatgccctcttctgatgtgtctgaggacagctacagtgtactcatataaataaaatagagagctgggcgtggtagcgcatgcctttaatcccagcacttgggaggcagaggcaggtggatttctgggttcgaggccagcctggtctacagagtgtgttccaggacagccagggctatacagagaaaccctgtctcggaaaaccctaaataaatagataaaatagaaaaataaatctttaaaaaaataagattagtctgttcatttagagagaaaaatgaataaattttaaataaatactttttaaacataaaagttagtaactagtgtctgtgtgtcttttttctttcctgtgtgtgtgtgtgtgtgtgtgtgtgtgtgtgtgtgtgtgtgtgtatttgcaacaagcctcactgtttatcccttgctcaactactttgatctgtgtctgtagataaggctgttcttgaactgatagatatctccctgcctctgtctcctgagggctgggattaaaggtgtaagacaccaactagactccagatgtttcgtatgcattctttttcttctccctctaactatgtattttgataaaaatgagaaaaatatttgaatttttgtatttaatatttgcatagggtatgcgaacaatcagaacctggtttgtaattttaagcatttcagacatagcctggataatatagctgttttgaaataactgtttctcacagagtattttttgtgcaccacaagaaaaatttctcctcctcctcctcctcctcctcctcctcctcctcctcctcctcctctccctcgttgatttggatgtgttgtttggtgattagttgtgtgtatatggtgattaggtcaaaggagtatgtatcactttttaatttgttgctagcacctggaaggtcttcatcaccttcattcttatctgtcaccagggcccatttggaggccagtgctgagaaatggaaccggttgctggcatcgctggaagagctgatcaaatggctcaatatgaaagatgaggagcttaagaagcagatgcccattggaggggacgtccctgccttacagctccagtatgaccactgcaaggtaagtacaacatttgtgcccttttttaaaaattaatttcgataaacaaactgaatgaagttctcaagaaatgaaaatttaaactaattaccacagcgttcccccctctttggcatctagttggttgctaaaggatcaatataaggttgaaattagcttaggtaacatgattaagtctgaggccagactaggctataaagcaagaccctacctttaaaatccatgcacacatgcatctatacatccatacttagataaaaataaaagataacttgtgaagttttttccaatatgctgatatccaaagaaatcttctagaaagcctcccagtgctaggattacaggggcgtgtctgctgttatatctaactgtaacctaatcaggagtatagaagtcatggtgtcagaaagggttttaatgtagaactcgggaggcagaagcaggtggatctatgtgagtttgaggccagcaaaggtgatacactcagaccctgtttcaagtcaatgaataaatacataaataaaattccaaagtagttctaaggatatagctttaaagtgtgagcttttcctattggccccaagctcctcggatgaagacttttgagactcaaaatatatctgcaatcaccttggccatatgctttggtttggtctccatctaacttataacctgtttattctaatctaagttttgccatgtgactggctacgtctgctcaggtctcatgcatctgtcctctgtcctcttcctgggtgaacactgctctccctgccttactctatcccacaattcttaatcttttctgcctctggatgtcccaccttctttctattctaccctttcctatagggcagaggtttttgtttgtttgtttgtttgtttgtttttactgacaaacaatacatccatacaatacacaagatattctctgtacatatagcccagtggtagagcacttgcctagcttgctggagattaaactaagacaaacaaaacctgaaattatcttgttcattaaaattaaaagtagagaaaatctgtagggcagatttcagtcctgtatcaaatgaagatcacagtgtgaaacaaaagatcattttatggtctttttatgtttcattttctttctctaagttctgtttccttctgcatgacatccacctctacacacgctgtgtttgcattctgacaatgaacaaggaatcctgaaatgtcacctgacatatccctcagcctttagatttttaaatatcttctcctattccaagttccattaatttatttatatccttttatactcttttctcatatattaaatgtcatttagttctgttgtattttttcctacccatgtgcagtatgaattctccttctaagtctgcacatttcaatgcaacattgtgtccttgttcccaattgaaagatgaatgcaaatgcatgttcctgagggaagatagcatctattacagaagatgttctaaccgatgttgatagggtcttgaattctattttattttgaccctgtgcttggtgaataaaattactatttcagtagaaagagaacatgatagacagataaccctgagatagaaagacacagagactaagaaaatacccactaggtgtgcctacatgagagcctcagggaggcggttacttcatttacattcccaggtgttaacaaagcaagattttccattgcacagagagcttgggtctgaggtagagcagcccctgccactgggctgcaaagctgaaagcttctagaacctccctacatagcactaccagctagtgcccaagtgtccacacatcatcctgtaaatgtaacgtttattctcctgtcattgatgtctcagaagcttactaactgaggcctagtcctgaaagtttttagcttctgtacagtcttatctaggcctacaatgttttctgcctctgagacttacactcaccgtttctagatctttctgatctctggctggctggtctaatctagcttctctcagtttcttactgagttgctctgcttggcctcatactaactttagcaatatgttctaattttctggctccttcccattctctggctggctccttcttcaatctgtctctgtaaaattctcccagtaaaactgtttcttccctccctctctctgcattgctctcttaagtagcttcccttccctctctcgtttcctgagagttgggcatgtgctgtgaagtctttctctgattcatcactttgtctgccactcagttagacatcacattcaaacatggctgcttccttctgcaaaccatctttacctttgtttgggattaaagttgtgtgctagggactgagccacaccacaactagaaacagttttgttttgtttttcagtaaagaacacagtaattcacagtgtggttaaatatcctgcagtgtgttcctctggaagatggtgcacactgaagccctaatacctgtctgaagttacgtacctttcttatggaacaccaccatcatttgaaaaatctctgacagttgaactacagtagaatcaagcaattcccttaaagttagtctcttacaggtgtgctgccaggcaacatttttttttaaagtccattttctccaatctcacattcttcctatgaagagaaatctttacttactatgtgtacacctgcaacatctaaccagttgtcagaagctcaaggacctgctcactgcatagaggaaaatggatgagtgctgcttagcttgatgaaatccgagcagctgtgccccccctccacctcccgcgtcccccttcactttcacagatactcatcatattcctgttgtgggctggtagtttctaagccactggtacagagagcagacacagctcctgttctgtgcaggggacagcctgtgtctgtgtagtaagagagcattcagagaaagctatggcaggactgtgacatgcttattcatgcagtttcccctggttgctgtctgtctgtccatccctgtttgttcactcctatcttccagtctttgttcttgcttacactgcacacggactcaattgaggtcatggacatgtttatctccaaattcctctctaaaggacttagaactctctttatttatagcattacagtgcagaacatgaaatgatttttttttaaacaatgttttcacagatatgtttttagctttgtgaaaaattcattgggcttttttttttctccctcttttagttttttttttattataaagtgcaaggttgggtttttggggggttggttgttttttgttattgttggtttttattatctgctttagatgcttaaattttcctgataaagttgaaaaaagtcttcctaattaaaaaaaaatgtgatttaatgatacatttccaaagcatttctttgataatagaattaccagtctgttcaccacccacaccccttgtatactattcatggaatgccttatatgttaaagttggtgcctttgtccagaaagcagtataacctggcctctgtaccgctctgatatgtttcaatagttcctttcccccagagatctgttcttgtggtttctttggatgtatccaaaggaaatcctatccatttaaaatttggctctgagattgtcagttagaaaggtaatacaggatcatgctttaaatcgctccttgaccaaacatcttgcaattataggaaaaacattaaaaagtagaaaaccacccatagcataactctgctccaaaacacaacagctacctttagcctacaagaagcaaagtagctactgaagttgatgctcctgaagagatgaaaaaaggcttgcaggaagatgagccatactgaagacttggggtggcatctctcctcagagcttgtctctccttgctggtgtgagccctctatggatggaaatttttccactttctagtacagatgctagatcatgcctgtagttttctggaagatgtgttgtgttgatactaatttcattgggcttgttgatgacctggcctgtgactggatacaaggtagaatgctcagcatgaagaagctggtgtttactcttgtaattgttgagactctgtgcatttactttgtttctgttgctgtgatcaaaagcgctgtcaaaaagtaacttgggagagaaaggatttatgtgagctcacaactccaggttacagtgcatcattttaaggaagggatgtcaagtaaccaggaactggaagcagtaaatcctatctaacccacacttaggagtagagagaaatgctttaatgcaagaatgcttattactcctctctactattaagtgattcagaacctaaaccgagggaatggtgtagcccactgcatgctgggtgttcccacatcagttaatgtaatcaacgaaatgtcccatagacaagcccataggctgactgagtgtagacaattcctcattgaaatgttttccaagctgattctagactgtgtcaaattggcagttaaagcttagcaccatggtctgtgttggtggttttgatcactctgtcttaattctgtctaggctatatgagctctttcagggagctacaatgccattaatacctagtaaccatccaacacagcccaacagtgcttcccccacctccccacttcctatgcagtattaatttgttgaattattcaagagtcacattccagactttacagattgggtagataacacagtcgtgttattttctcatatatgtacatatttaattcctttaaatattaaaataaataactaccatataacttttagtggcttgaaaaatgagtgaagatggctgaacgttcctctcaatgactttaattattattattttttgcctctttgagtcttgaaagtggatgatttatatgcaacttcattgtcaacatgtcgtccagtcagttatttcttataaagcacctacagtgtgcatagtgttgatatgcatgccatgaattaacttcagatactcaaaagttgcctacagttgcatatgcagttttgaatattcaatttgcactttattttcacagtaatgtaaatactgagttatgcgtaggcaattatcagagctctaacacgcttttcccaataaaatgcatgttggttttataaaagcaaatcaccaagaatgattaaattgcatgattcaggtataatttcctggtgtgcatcttttccctcagggttactttgccctttgcctaactcaatttaatttcttatatccaaacctcattatgtaagaatcaggacatttgggccttaaaccaaactgccaagatacataagaaaacttagtcattaaagtaacagattctgatgtcgtttttaaaacctccaccacgtgtggacacatacgcctttaatctcagcactcaagaaccagaagtaggtgggcctttatgagtttgaggtcagcctggtctacatagtgagttccaggctagtcaaggctatgtaataagaccctttctcaaaaaccagcaagctacaacaaaaatgaaatgtcaatacctccttgttaaatttgggttctgtgcatttgcatgtgtgtatgatgcagttctattaatctgaggttgcctacaaacctgtaatgttgaggtcttgctgtatgttatgagatttttttctatggtagtaaattagttattttctgattgggttgaggagttcccatgcaggtatattatgcacatctctgtgtgtacatccatatggaggctaggaataaccttgagtatcaatcctagagtccttcctcctttccctccttttgtcttccctccttccctccccaccccactttctttgtatatcttttggagacaaagtcttacactggctagggtggttggccagtgagcctcacggtcccatgcagctctccctccctcctgggttctgagatgacaagcatatgccccactgtgtctagcttttaaaaagtagattctggagaccaagctcacatcctcagtgtacaaggccattgcaagcactttacaaactgtactacctcttcaacccaatgttctaaagttaagcatttctaagtgctcttctgaaatttgcaactgtattgctttccttctcagaaacacactgcaccccatctgttggtagagcctatacctataggcaccctgaatcagctttcttaaggagccatctctactccagttaaccattcatatggctacaggtgatcatgtcctctaagtttgggagcaatagatgaagactcactcccaagagctggggctcacacaatgtccgtgtttagagggacagggggcagcttgagagctgtcagactggtgatgaaataaagagtatggccattcttgggcacgaaatggcctctgtgaaaccagccacccgcttccaggtgaaccacttctatgatctttgttgcttagtgaccatttcctttgtttaacagctcatttcttctttcagcttccatgttaaatctgatagttgacatcctgtattaggtactatggtggtttggatatgcttggtccagggagtggcgctattattaggaggtgtggccttgttggaggaagtgtgtcactgtgggggtaggctttgaggtctctgatatatgctcaagtctgtccagagtcagtcatcctatgtcaacctttggatcaagatgtagaactcttggcaccttctttatcactgtgtcttcctggatgctgccatgcttcctgccatgatgagaatgcactgaaccaagccagccctaattaagtgttgttccttagatgggttgcctgggtcatggtgtctcttctgagcaactgaaaccctaactaagacagatactcagcacacatcactcaatagagggtcctgtattttcacaaaacacactgcctagtcgcaggattgaccttcacaagaagataaacactatcaaaagccctgcatcagggacatgaacacacagccaggaagcagagatgcttatgactgtatgctgtggctgataaagaaaggctttaggaagtcctggagtagagagtccgtaaagtaaaaagtccttaaagaatgttatccaggttactatggtgaagatcttgcgtgttcctggttgtgtttcttagagtaatggggtgtactgcattcatgcttgtagctcagggggtctcaactttcctaatgctggggccatttgaaacagttccttatgttgtggtgactctccctgccaactgtaaaattatttaattgctactacatagatgcaattttgatactttaatgaatcataaatatctgtgtgttctgatggtcttaggtaacccctgtcaaagagtcattcgaccccacaaaggggtcagctcacagattaaaaatggatgctttagcctaacactgagagcaaagctcaaagagaaggaacttgaatgttagcacctaacaggggctgatgagagaagctactaatggatttgctgaataagagggatgcaggcgcatgtctgtgtatctccatgcatgtgtacgtgtgtgtgtctgtgttcaacaatgcagaggaaagactggtttgttactgtgacacgttggagagtcctgtcttgctcttagcattcatacttagtattcctattttgcctttattttttgatgccagtggggtggaaccaaaatgaatttatacatttaactgatcatttagggacattaaccaaaacttttacggcactgtgcactatgaaggagaattaaaagaattttttgcttgcataccaatggaacataatcccatttttctcttttttttctttgagttttattagtgctatcaactttaacgactgtctggccttctttgctaccgtacaaaatgacttagatccatacatgctgatttagctctgaaagcaagctgggaggaggaagggagtaaattatattctggcagattctccttacgtttccatcattttttttctatctctcttctgcagtaagccatgaagttcttttgagaaccaaaggttaaagaagcctggtgtgtaccaacactgcctccagcctgccccagtgcagatgcccctcgtccatgccagctactagggcacccatatgctctcattagtgccaggttgtgggaagggctctccgtgctttgttgtaggccttgctgttatagtgaatgcccaaatattcagataagtggccctgtggtttcatcttgctgtggagtttgctgttttatagttagatctgttggcatcaagaacagttatgtaagctaggtattggtggcacacacctttaatcccagcccttgggagggaggagccggtgatctttgtgtgttcgaggccaccctggtctacagagtgagttccaggacagccagggctatatagagagaccctgtctcaaaacaaacaaacaaacaaacaaacaaacaaaacaaaacaaaaaacacaaaaaaaaccccatccagccaaacagacaaataaaaagtatattatgcttcaacatatataaactataatgtgttaaaaataacaaaagactctgagaatgtatttccaggagcgtctctctcctcagttcaggcatggtccttacactgagtcgtgtgcctcttgtcttaacttgtggatgttagagttggctagtcttgggcttcggcccacacttggtcctctctacttgacttctaggtaccctgccctcctgattttctcatcctctcaatgaagctccgtctctttccctctctggtccgttctttaagctccttgtagaactgggaagcactaggagccaggccatcctgatgtcactatatgtagcctttcctgggtttagaatctatctgcaggccagacactcccagctttgtgaatgtgctgatgtgtcacctctacagggatcctaattttgcacatcctatggccaagctgaaagcactgcagagttgacttttaagacattctaccctgaattctatacccccatctcacttggtagagatgtgacttaagttgcttaaaataataataataataccttgaaccccatctttctcattcaatgtgttagggagttttaagttttctcatcaagatagagaatctaaattggccacttgccaccattcatctgactctggggtccccagcacagcagccagtatgttcctgttaataaatcaaacacccagtaatagacatagtctcaggaaggcatgcaagagccccgtgtggccccctacgcctcccacacaccaagctcagttcagctcttgctcatcttctcccacactggtctcagccatgctggcctcttgctgtgattcaatcacagacccttgctgtgtcctagaatgttctttctgatagtctacaaagttaactctccgctgctcctcaaggtgctggatggcaccttccaatcctggcaacctctctttgttccagcattctcatcttcctatgtagctgctgtactattttctattctttgtgtacccacagttccataaactcaataaagacttgttgaatgcaaaatgactgacacatacctaagggtatttgattctttttaatttctttatatctatgtaatccttttaatttcgttcatttaccaaatatcacatttaaaaaacacttgtgtgcgtaattttctaaaacactgtcttatttatgtatgccaggtgaatatcaaacttgcagtgtagctgagggtgaccttgaacttctaactctcctgcttccacctcctgagtactttttcaggagtgtaccactatacccaggctatgttaagctgaggattggaccagggacctcgtgcatgcgaggcaagccctctcccagtttagctgttaccttggcgtttttgctactttaagtaactgaatttttaggaaaaatgatcctctctttagacatataagcaaggatctttcatcgacagcttagagataattttttgatatttttttgatctgcaagagttggactgtaagaaaccctaccggcacagctatagtttaacatgtattagttaagagacttcttttccttccgtgtcagttcacattggccttgaacttgtggctttacctttcagtgtcatcccagtgctgagagtctaagtgggtgccatcatttctggtcaagaaattatctcttctctgtctcaatattgccttaattgttccactcagggggtgggaaagtaatgtttatgggatgagagggagtggactggcaaatcaaggttattgaggcatcctctaaatatggttcattttacttctggaatatgctatcagattgtccctctgtgcatggctcctattatcccttaaatagatgctttaaaaataaatatcagatactctttaaaactaaatatgttaagatctccaatgaccataggaatgtaaatgtacagactctttgattcaatgattgtcgtagatctcattttataaatgaatctaacctggaagagatcactgaaggaaatccgtagaaaaatttatatacactgccttagaaatgaagcattggcttctaatacacagtctcccttttatttcataaatttatttttagttatgagtttgtttgtgtatatatgtgtgtctgcagttatagatttatttgtagttatgggttgtccaggaaggccagaagaagctgtctgaccccttggacctacaggtagttatgggccacccagttctggtgctgggaagcaaactcgggtcatttggaagaacagcaatccctttttgccactgagccattgccctggcccatacatatgtaattgctaatagtgtgttatttaaaggtagtaatttgttcacgacttctgttttgcagcctagagactataattaataacatgtataacattcttgaaaattgttgaaagactatattttaatattattgtaagaagctcaaactatatgagatattacatatgttagctgcatgatccattctgcaagtttattatttatttcaaaataaagcattatatgaggtagatgtatatattttatttcttaatgaaaagtagaaaaaatagtttagaactattgggaaaagatctttaccaatgctacatccaatagagggctaatatccaatatatacaaagaactcaagaagttagattccagagaaccaaataaccctattaaaaaatgggaaacggagctaaacagaatttttaattaaggaaactcgaagggctgagagcacctaaagaaatattcaacatccttagccagcagggaaatgcaaatcaaaacaaccctgagattccacctcacaccaatcagaatggcttagatcaaaaactcaggtgacagcagatgctggcaaggatgtggagaaagaggaacactcctccattgctcgtgggattacaaactggtacaaccattctggaaatctttctggtggttcctcagaaaattggacatagtattacctgagtacctagctataagactcctgggcatatactcagaagatgctccaacatgtaataaggacatgctccactatgttcataggagccatatttataatagccaggagctggaaaccacccagacatccctcaacagaggaatggatacagaaaatatggtacatttacacagttgaacactactcagctattaaaaacagtgacttcatgaaattcataggcaaatgaatggaacttggaaatatcatccagagtgaggtaactcagtcacaaaagaacacacatggtaacaaaaaaacctaggacagcaaaaactcttctcaatgataaaaggacctctggtggaatcaccatgcctgacctaaagctgtactacagagcaattgtgataaaaactgcatggtactgctatagagccagaagctggaaagaaccctcaacagaggaatggatacagaaaatgtggtacatttacacaatggaggactactcagctattaaaaagaatgaatttatgaaattcctaggcaaatggatggacctggagggcatcatcctgagtgaggtaacccaatcacaaaagaactcacatgatatgtactcattcataagtggatattagcccagaaacttagaatacccaagatacaatttgcaaaacacatgaaagtcaagaagaaggaagaccaaagtgtggacactttgccctttcttagaattgggagcaaaacacccatggaaggagttacagagacaaagtttggagctgagacgaaaggatggaccatctagagactgccacacctgcagatccatcccataatcagcctccaaacgggcgctgacaccattgcatacactagcaagattttactgaaaggacccagatatagctgtctcttgtgaggccatgccgggggcctagcaaacacagaagtggatgctcacagttagctattggatggatcacagggcccctaatgaaggagttagagaaagtacctaaggagctaaaggggtctgcaaccctataggtggaacagcaatcaatatgaactacccagtacctcccagagctcatgtctctagctgaatatgtatcagaagatggcctagtcggccatcattggaaagagaggcccattggtcttgcaaactttatatgcctcagcacaggggaacgccagggccaaaaagtgggagtgagtgggtaggggagtgggaggggagggtatgggggacttttgggatagcattggaaatgtaaatgaagaaaatattaaataaataagtaaataaacaaacaaacaaacaaataagaaaaaaaaagagttgccatgttcacagtgtctcttttcaacaataaaatccctaaggcaaaacaaaaccacacatggtaggcactcactgataagtggatattagcccaaacatttgaaatttccaagatacaattcacagaccatatgaggcctaagaagaaggaaaatcaaagagtggatgcttcagtgattcttagaagggggaacaaaatactcacaggaggaagtatggagacaacgtgtagagcatagactgaagaaaaggcctccagagactgccccacctggggatccatcccatatacagtcgccaaacgtggatactattgtggataccccgaagtgcttgctgacaggagcctgatatggctgtctcctggggggctctgtcagagcctgacaaatacagaggtggatgctagcagccaaccatgggactgagcatggggtccccagtggaggagttggaaagagctgaggggatttgcagccccatgtggggagcaacagtattaaccggccatattctcagagctcccaggaactggaccactaactgaagagtacacatggagggacccatggctctggccacgtatgtggcagaggatgatcttgttaaacatcagtgggaggagtggcctttgggcctgagtgtgtttgatgcttcagtgcaggggaatgccagggtgggaaggcagaaatgggtgggtggggagcatccacatagaggcaaggggggatgggatagggggtttctgaagagaagatctagataggggataacatttgaaatgtaaataaagaaaatatccaattaaaaaaaacccaaaacctattttcaatgatattttaaatgattaatgagctctctgttaagtgttcttttaggtataattttcaatcataaagataatatttacagatgaaataatgaacagctgggtcttgattattcaagcttatctcttcagcttctcaagagctgaagtaggggggaccacacatttaagtcctgcctggagtgcatttctcagtgaatttaaggccagaccagtctgatcttaactcaactgagtgagatcttgcctcagagtaaaaagggatagccagctggggttgtatgtcagtggtcagactctagctgggctcgcacaagtcgctgcttccatccctcacactgcagagtgatagcaaagcaaaatacacactcttctgtcttaccttcctctagtgccattgttctcatccttcctaatgcttcgaccttttaatactgttcttcatgtggaagtcaccactcctaccataaaattgctttcattactagctcataactgtcattttgctactattgcagatcgtaatgtgaatatctgtgttatccaaaggtcttaggtgacccctgtaagaaggtaatttgacctctgcaaaggggccatgacccatgttcccatggtggtatctcctcttgtatacacaccgtccttagctttaattggaggcctcgttttcttactctgctttcacctttaggtttctgtcatgctcacgttctgaccttgctcttgtggccattatcatagtaatctttgaaggttgtgtaatggttcctagtgtggacctgccattgtggatctcaataatttcctagtgttggatatttaagctgccctcaatttcttaaagacataaataatgttgcagtggacacctttttatgtgtagacttttttttcccctcctctggttcattttcttagactccatcctcaaaggtgaaattcttgtttcataccatgtgatcagcataatgactttatagactgccaaattgggtttcccaaatgatcaaaccatttccctccctctagaaaatatggacacgtcagtgctctcttgcttgactctctcacttctgctccttgtctgatggacttgcactgctagcacccaaactctgctactccacagtgggtggaaaaaacagttttcagattctatacaggtctggcccatgcttctcttcttttcaaagaataaagaggaaaatttgggagatctgtttgacttagccatgtgtagagtagcagggagatgtggtttcttgaactttctgggggagaaagttcctatttatatcacatgggatgtgatctaatcaacccctaagtccccatagctttacttcactgttatggagaagatttagataaaaaaagactaaatttttttctcatctaagagtctaaatatattgcaaagttttatatgtatcaaatattttagcttaatcttggggaatcacaaagtttcacagccttcctaaccacatcacgtgaacattgggatacatattaagttcagtttttcctggaaaggggagattggtgtgttagcgagtttttcttgctataacaaaatacttgaggtaaccaccttaaaacagtagaaaggtttgctctttagttcatgatataagaagatccagtccatgactctaatatttttaggcatatggtaagggggcagcatcatagtgggaatgtatgagggaagaaagctgcttgcccctctgtcagcccagaaagaaaggacgcatgtcaaggagagaagggaagagcagagctgcttcaccgcattctgtctcctgtgagcctgttttcttagggagagacttgcaggctctccacgtttctgcagaagaacggataatattgtttgtttagcagcaacttttacatgacaccaagctgatgctgtgcccagaatgaaaacgaagagctgtgattgacaggtggtagtttttgacctttgccaagccagtcacttcttcaaccaccttaccccttaatccctggcctttccagtaagttctagcaggtggagtgttccctgaccagtgagccagaagtgttccctgaccagtgagccacagtgaagaatctctgcaggtgcttatagttggatctgcagaaattcattgtgctgcctggcactctgggaaatagccgtggctactggagccctccttgctgttcagatgctcgggacggtcagatggaagaagggatggctcagttaagagggatgctgagctcctagatattctggaaggaataaaattctgatactaatgttcaggttttcgtttgaggcacatgagagactagatggctttactctcaattattctgtctttctgtccatttatgtgtttttaaacctgtagttcacatgaaaagttcaatgggaaatgcctctgcagttaaatcatttgcctggcaagactagcatttggatccccagatctcaagtaaatgccaggtgggcaggggtggtcctgtgtaacttgagccttggaaagaggagcgggaggattcccagggcaggcaggctagtgatacaggggtagtgtttgactgagagatgatggaagagtgatggagtgatcaggagtgattcctcatttcaatcaggagctctacatacatgctcactcatatatgttcgtatcctgatacacatgcacttaacacatgcaaactcacacagattcatacacatacacacacaccactcaaaaggcaaaatgcagagagaaagagagagagagagagatgcatatgcctttaagagactcctatgtttgagaagttgttcacccttcctccctgcattgtatgtttgtacttagtagggctcttgatagcctgcttgtgcttttcaaagtctggtgacaattatcacattctgcccttctcctcccccttttagattgtatgacatgatctgtggctatgtctagccattttctgtatattcagtatgagagtagtgtttgttttaacttttttattagggtggaaaactctatggtactttgctagctccataccttgggagacagtagaatgtctccactcgagacaggttttcaggtagactatgctgtcccggaacttgtgttgttcctgccttagtctcttgagagctgagactactgtactcagctaagtgaattttattttttaatggacacaaaatactttttgtattctcccttttctattgttgtctcttgagcatttgaggtctagtaaacattttagaacgtttaggctttaaagtccagtttctgctttctttggtgaagttatcttatttttgtgagttattttgaagttttcttccttgttccggttgagtcttgtttactacatgtaagctaaaatttccctttacactgttctgtcctggagattatttagggcacttatttactgggaaggtatattagttcatttacttttgctataacagagtccttgagactgaacaatatataaggaaaagtagttcacatatctcatagctctagaagcagagctgtatctagtgaggtcttcatactctatgcacactgatagcagaaggcagtggctgcctctgacagcaggggacaggacagatgctgtgacctgctgtgcagtaattggaccttatgagaatttatcagttcctgggagaacttgtccagtctcacaagaaagacatcatcccctcttaaatcctcacgttccaaccctacgtcaaccaatccgtctcaacatgagtggtgattgtatcagctgaatgtgtcacaggcagggccaagctgccacacgagtgtgcttctagcttagtggccgagctttgtttggtttggcaaagtcaccaggtgtctgcaaagacaggaagtgcatgtttaccaggtatttctccctgcaaacacaaagactcagattctaaaacactgtcacagaaagaacatccctgatccttcctcgctcggcataatttcagctgtcactaggcagtacccacttggatgagcctcacagcctgtgaaatgcttcctttgaacagctggactgaatgttaccaatcccaattcattcttgcttgtctgcgtatggtattgttagaataatggataatgccttcctcttgagctgacatgattgttcctctcatccagtgatggagtatagttctccattctccttagccagttgatgcaggggacgggtgcatagccacacagggtatccagacagcaaggtaggaagtgttccagaatgagtgagaggatccattgtatgactaaatatgctcaaaccctgaagatcaactcttacacacacatgtgatatatagtgatatatagtaacacatatatgtttgtgtatatgcatgtatgtgtgttataaagaaactgaaaaagaaacatgacctgcagttttttttttttttatgttttagtttaagaacaagatatttgcatatcgttaagtttaccccattaagtgtatggttcagcctttggtctatttacagaatcaagtgagcatcattgactcctaagtttagcatttcattatcttcgaaagaatggaacaaagctatagccttagctttggcctcactgttgctgaagccttgatgggctgactagactgcatcctctatccatgtcatttggggtaggtagatattttacaaagccaaacttggaaacttggaaacctggaaaccatgcccttgacaccaatactggaagcatctatccctgtagacttccacagtcctccttcagttgctgagtcctgtgagctaccaccatgaggctgccctgggaactggaaacagccagatgcctcaaagcaaacatgtagagtttggccatcatctatgacttggggaaggagattagaaacaggtatgcagcaagcaagagcaccgtggagaggctaaaatgaggcctcacctcattcactccagggctggttctggagtgcgtggctgaagcagattacaatgtcagatcctggcctttgatagttcagaaggtccccacatctttctatgagatgggagggttcagctcatttctcctgttgaaagaaaattcatccccccaacctgaaaatagtaactgcacggcttctttttgctttgtttcccctgtcctggctcattatactctgaaacactcaaaaattgggtaaatattttggagttagttaagatgagcattttaagtggttaggaatggcctaggtctttttcttccctccccttttttaaagctttcatgtaaaaggtgcctatgaagttcccttatagccctccagtgtctccccttcatcttcctatggatgtgtttaccatttgtatcactcacattggctcattgtaacccaagttcctcttcataacatcccaggacttaggcccccagtggttaggactcaatgattgacttagaagctcactgcatggctgtccagtgtggcacctgcgagatagagtttctttgattaaacagttgtgtggcgagtgctctcaagtcaatctaaaatgtgcaagttgtaagtaaagcaaagagagtgttctatcaggacttgagcacccgtggaatttctctactgacatgtttgcactaagctgatggactttccctggaagagaaggactaaaaccatttgcaccttggtttgcatttattacccagtgtaatgaagtttattctcatgaaaaagaacccctgtgtacctgaaccccctcaggcctccaacactaggcagctgctgatatacttttttttctctctgtagacacctctgtggtaatggaatctcacaccacaggcttccctctgagtcatttcgctgagaacatttgttaggtttttatctagtggtagtctgcattggtctgtaactcattttccttgctaagatctgtcgtgcagctcggttgcattttgcttatctactgatcaatggctgcatgtttggttggtccctcggtctggctatgatggcgtgctgttatgaacatttgatgccgtgctgttatgaacattcacgtgtgtgtgtgtgtgtgtgtgtgtttaatctgtacagatgttttatttctgggtagacctagttatgggatatctaggatacagggtaaaataaaccctgtatttaacttttgaggaaccaccaaactgaaatgtcttatgagtctacgatccccaacagtgtgtgagaattcagttcctcacaactttacctaagcttgttattgtttggatagaggttgttttcggtaaaaatataaagtcattaacacagaaaaattccaattaggttatcttatactcatttaagtggctcccaaatgagacacgagataccagaaagtggatgctactttgtatacaaaacaactcattggactctaattaccttatcattaatgctcaggaaaatgaaggctttcttttacgtcgaatggagaggtaaaaggtgtggtgattatgtgtgtaatacagttgagagtcgaatccctttgtgagtgcaattaaatacaattgaaatagggcaaattgaataacaaaattaaaacgtcaaaagagcgtatgtacaggtatactgagtgtgttctctaggctactggggagagagatggtatcagggtcagagtcccagaagtttttacttagggtgctttccacctgcccatgcctgctgtacttcttctctggcttatcaagtcagctcacctgatattccttaccaagaattcaaggctgggtgatcctccccccccccaacacacacctttggcaggttgtagattaatgtgctaagaaatgcaaattaactatggaagactctctactactctgatttcatttttattatctagacgacccaacaatattgttaagaagactatgtaaatttgtagtcacttcctaacccatttgcctgcctggctcttcatcagtttgcctgtcatttggtatcaggtgtacaaaggtgcgcacatagacttctgccttcacttctacctgtgtcttgagccttagctattgccttgtataggggccaaaggcgtgtggttctctcctgatctacacactggaatcttccccccaaggctggcgcatggtttttctctgggggaagaaactttctctctttgcaagactcagatgaagccccctccccagcccccaccccacatcatgaggaagcactttggagccaagctcagtgctcaacttcctgtagtataagatccagaagtcctgagaatttatggtgtatctgagaaaggtagaaattaaataaaacataaaaaaaggaatacatactgtccttgactaatagatctgggaagtacaaaaagacataaacagagtaatgggaacaggaaatgtacagaacgggaaaggtgagcgctactgtaatggtagggtgactgtgcgaacctccatctataaagcattaatggtttgaagaacctccagtgtggctgtctggggagagagctttctgagctcagccaacagccagccaacacaattgctctcctgtgagagtctccatgcataattgataaagtttcagccatgtggggaatcgatcagtttgtctcctcagtagtttttctgtagacaaacgtttattttctatttgaatgtgagagactctaaacacaattttaagaacaactgtcctctgtctgtccccttccctcccacagcactctccaaggcactttgtgaactgagacattttgactggccaggcacaaatactccttttccagtcactggatcacctctcctaggttccccaccatagcatctgggatttaccctctgggacatctccccatcagaattttcttcctcctgaggcccaacatctgtctgctctccctcatttcctcttcagacttagtctttcttccattttttaaaatgtctgttctggtttccctttagcaatgtctctaaaacactctaaggaatttcaatctctctctctctgtctctctgtctctgtctctgtctctgtctctctctctctctctctctctctctccctctctctctctctgtgtcagatgcccccgagggaaggtgtagtcttctagcacctctgcctcttcttctgtaccttgcatttgaacagttacatttctggcaagtcctctcagggaggagagttgcagcagagccctggttgccattttatgaatcttcactgcttttctattacctagttgcactcagctctaggagatgagtactcttgactattaattttttttaagttcaaaaatataaatgaatgtgatattctcataccaccattttatatttatttataagtggttttggaagttaactattaggaatgcctctgcatctctagatccctctcatctaaagatgtgataatctcttgttaagaaatgtggagcagacccataaatacatgtatttcttctcattctcttctgactttttctttacatacatgaaaacactatgtgtcagaaaactgatctgtttcatctcgtgcagctatgagaccctggaacaccttgagctgcttttcttgaccaggaatgctgaaggctgtgtttcctaacatgaccatttaataacactccttgactgggggtttgtcccctctccactgactctgctgtcaggctttggtgtgataagtgagggagtatgcataagtgttatctatggaaattattttcagagacagttttccttcccacctagatccttacatatattgggttgtagattttattttataaggggctggggaggtcctactttcattttttaaaattcttagcagataataattgtccatgaagtcaaataaccttgaattgtccttgccctggctgtccctttcctctccacctgtaacagctccctctgactttggcccacgccagtttatctttgctgtctctatgtgatgattattctggaacttctacattttttccatttttactgagtacaaaagatgatgatttggcctccaagtaaccttgcgtcctatcaccattgtgtcaagcactatccaaacatttaatgattccggaaaggcaaaaggaaagacttgattctacaatcttaaggggaaatattttagggaggaaaaagaccccttgcatgttcatagtgcatagccactggcttgttctatgatcagttattagggcctgaagacgtggctgtgtctgtactggccagaaatgacagcagcagctttcagttagctttgctttagtattgaaaacagggcacgagacatatttacatgttggtgtcttatccccgagtgagtgtggctgtcatgaaacccttgtcaattagagtcctaatcaccaaacattttataggagcaggggtgaaagttcatctctacttaaaagaataaatgtgctagagaccagttgttctgggagtcccagatctgcatgcaaacctcaccagggaaaacagtaattgcctcagcatgagagacggacggactgtgttttaagataattggagactgtcttttatgtgttctctttgctttagttttgatttcatacactttaatttgtgcctatctcttaattttttctcagtgtattctaaagaacataaaaccctctgaggccttcattaccacatgtgaactcacctccttcagtatcattggatgcgattgttcttgtcagtcttaaggaagaagtgtctttgagcaggctattatgttttagcaactctacacagtggggattctctaagttcacatttggtaaattcaaatacaatagctaactcctgtagatgaaaatcttaaagtgtccttcccgacattcatcattttcttctttccttcaacacagacaacattttcaggagccctctctttggcttttattcacactttctgttgttcctacctgtaacacattttcacttgtaacttatctgaatgttggcttaagccactccctctgcagcttcagtcagaagtggtaaagctaaaccctgcgttcatttgctgaaaacatgggaagttgtttatatactccatttctgtttctttttgcaaaggtgctgagacgtgagctaaaggagaaagagtattctgtgctgaacgccgtagatcaagctcgagtttttctggctgatcagccaatagaggcccccgaagaaccaagaagaaacccacaatcaaagacaggtgagcgtggttcatttctttagaaaaaaaaaaaaaaaaaagacaaccaaccaagcctttttcttgcagcatcaagcatgtacaaatgacggcctgtcacatcgggatatttagcttaaaatgaagcaggaactaacttctttattaggaaacatcaattcttaatatcattattagattttgcagtgttgccaaaagaagctctgtggtatattcaaaaacaaacaaacatgcagagccttggatatggttcagcagttcggcgccctggctactctaccagaagacctgggtttgaatctctgcaaccattggtaaccccagtcccagggaatctcatgacctattctggcatccaaggataccgggtacacacatggtatgcatacataacatgggtatgggtaaaccgctcatacatgttgtataaaaacacatgttgcccaaagtattttcccatcattcactttacccaggaaaagcaggcatgcagagtgccttactgtgtttagcagtgcagatcacttccttatgaggggcggggtcagtgggagcccctttcctcactgaaggtgaactctatatgtataacttacctcagctctcattccagtttaagcatcatgctagatcccctgcttccccttttaagatattgccttcctgcagcaaccggataataatgacaagcaaatgacagcgtgagccagctgacttcagtgtgactccccaggaaggctcctcgtggctggctctcctcatcaccaccctggtttctcagttgctcctctctgcatcctcatttctgccttcctggctgcactgctatgttttgaacattcagggttgctccaatctcgaaacctttgtgtgtctcttccctgtttctggaacattcctgctcctctcccagatccccatgcctactcctaccaccactacctccccacttctcctcccaccctcccttcctctctgcttctatccctcttcctactcctcccttcccttctacttgggtcttcatccaaatgttgcatctttagttcttcccagtgttgtgcccacatgtgtgcacatgtgcatcaatgtgtgtgtccgtgtgtatgtggaggacacagtcaacatggagtattttcctcaatcctgctttaccttggatttttagttttctactataaacggtccctatggtttggctagactgacccatcagcaagcttgggggtcaccagtcttgacgtccacaagcatgtacagtctggtgatgcctgcacagaaccttgcccagcttcttaacgcagtgctgggatcggaactcaggtcctcctgtttctgtatcacacactcttcccactatccatctccttcactgatgtattttgtagtgtctgggatgtgatccctgcctctcacatagttactaaatggattaaagtatcaacagagtacggcgtggggataggtaagacccccccccccccggacacatttcataaaaaggatttaggctagttgcagatgaagcctaacacaaagaggtaagaaagaaagcaattgccactacccacaataccctgtatttgtccaggggcttggttgtacaccacaaaggacagggagtttgaggatcagagtagagactactgtctccgtgcacacccttaaaatgggagaagaggtgattaggtgagaagacagccacacaggaaactcaagaagaacgaagaccaaagtgtggacactttgccccttcttagaattgggaacaaaacacccatggaaggagttacagagacaaagtttggagctgagacaaaaggatggaccatctagaaactgccatatccagggatccatcccataatcagctcccaaacgctgacaccattgcatacaccggcaagattttgctgaaaggacccagatgtagctgtctcttgtgagactatgccagggcctagcaaacacagaagtagatgctcacagtcagctattgaatggatcacagggcccccaatgaaggagctagagaaagtatccaaggagctaaagggatctgcaaccctataggtgaaacaacaatatgaactaaccagtacccaccccagagctcgtgtctctagctgcgtatgtatcagaagatggcctagtcagccatcagtggaaagagaggcccattggtcatgcaaactttctatgcctcagtacaggggaacgccagggccaagaagtgggagtgggtgggtgggggagcgtgtgggtgacttttgggatagcattggaaatgtaaatgaaataaatacctaattaaaaaaaaaaacaactttaaaggggcagggcgtggtggcgtacacctttaatcccagcacttgggaagcagagtcaggcagatttctgagttcgaggccagcctggtctacagagtgagttccaggacagccagggctatacagagaaactctgtctcgaaaaacaaaaaaaaacaaaaaaatctttaaaggacacttttgtagcttctctcctttgttcttagactcaggattttgctcagttcccatttccaaccaccaattgggggtgggggggaactggcaagagaaaaatgttacatcaatttaactttatgaggtttgtccttttggtttggtttggttttgcaaggaaccattttccaaccctctccttccttgatattattttctgtaatggtagcccattttacctgctgttaaaagtaaatggagggaaattatccataatagcttctatcctttttttgtttactgtgacttatgcacaactgcgatcagaaacagagactgtttgagcattagtcatcccgagtaatagtgaagtgctctgtgttggaggcattagtgctagcccaagccgtagatggcttttagttctacttaataagcagtttttgaatacgctctgtgcattatgccctagggtacaaagatagatccatctctttttaattctagaaaatagttttctccattatttttctctcaaacgtctttttcccttgcaagccccattccactcattttgttcttctgttatcaactttattaataactggtgttgcatgtattttcaaatatttgggaagcagtaccacccagcattatcatgtgtgagggtgcgcatacatgtgagtgtgtgcagaagccagaggttaacctctggtacctttcctttttttttttttttttaacctcttctttacctccttttgagacacggtctctcatttttacctatagctctccatccagctatgctgtgctgtctggccgtcgagccccaggtctacatgttgtctctgcctccctgtcagtaggattacaggcatgtgactttatagctgactttttacatgggagttctgggcattggattcaggtcatcctgctggcatggtacatatgttacttactgaaccatcagcccgtgacccaagtgatctgtctaaagaccagcactggcattcctttagaatgggacctggtgtagaaggttgagcagacacctgacgtcagtgttcgaccagtctgctccagtgacgaccctgtctcatgccacccactctgtgccccacgctcgatgtccactggacaccagacttctgctttctgcagccatgcactgccttgtcttactgttcacttttccagtcatgatccctctactctgctctccagctccttcctcatatactggcacagcacctacttgctcgaccaaccccctcccaagctcagccctgtctcagcgacttcttaagtactctgctgacagattcttgcctgatttcctagcactttatcatcggtgaaaccatgccaccaaaggctgactcgggcacttagcccaccctggggccccactgacttcctgtttatcaagaatctgaagaagggatttgaacatgaacagtaaatacaataagtgggacatatagaccctgttctgaacgcaggtgaagcctacaggtactttctcagagacacagactgacattttagacaggttgtaagtactcgaactccatgacctgtgaattgcgaacaagtaactaggtagaagtgacaagacagggacaaggttgacaggagtgaccacagccagatgacacaaaccaggggaaattaaaaaatacagatactagataagacctgtaaaatctgaagctatgagttgcagtttatttctgaaggcagaaggcataagaggtcttactgtattttaataagtttcctccccaaagtgaaaacaataaagaaattgagttaaatggggtatcatgtaactatgtggaaaactcagttaccagaacaacgtgcactgtttagaaatgattcaagtaaatacgatttctttttgtgcaactaaagtaggagatttaaagagctttgtgttcagtgttcttgtttgaacggcatggaagtaatctcatttaatctatcatatcgacacatttttccttttaatgcaaattgcttttagttgatcattatcatccagtgtataatgggatatacgtttcttatcatttgtgttgtttttttttccctactttttaaactgcatttgtgttcattctttgaaccaggtgaatgtgctagacagattataaaggtaccatttattattttttaaaaaaaataccaaatactaaggccaagagcatcttgcttggccgagcaaggtcattgagataatcaaaggaagatgcagatccagcactaagctgctgcttattcaccttctctcacccctgggctttcactggctttaggcccatccctgtaatttcaccctctccatctctgctcatgtggaatgctctggctgctgacctcctagctccttcttgactcccgtgtcaagaacctcttagccttgcacacacatttcttggctcttctttgtgctgccaacttcccttgctgttctcagagctgcatctgaattgtgtgctggctcaaggatctactcactgtggggtacacagccagggaccacctctgcctccccaccctccattctctagagttagtggggggcagaacatggcattttcccaactgcccatcaccatcaatagcaatttctaatgcattataacacaatatgatattttgttcattaattttcccacaaataagctttaaaaatgatttcagctaaagccttcctgttaccgtgactacagtatccttctcttgtgagaatggctcgctttatcctaggctggtcatctttgcttcatttaaatgatattcacaaatagtcatagaaaaatatagttcttagtgtaatgtgtttatctgtgtatagttagttatatgtctggtgtatgttagtgctatacccgcaattagttcaatgtgactggaccgggggtcaatgggaaataatcattttttttagatcagtgtttcctctttgggtctccgatggctagctgtgtgtattaacaacatttgttctatctcagtgtatgttgtactctttgaaataccaaacacaacaatataatgtttccaaaggccaattcctggcagtgtttctctcttatggggctcctatattgtaggatattgatgctcactgataattaacagggcaaggcccagctcactgtgggtgcttccacctctgggctggtgggcttgggagctactagatagtgggttgaacaaaccatgaggtccaagctagtaaacagcattccttcatggcctctccatcactcttaccttcaggttcctgccctgaatgggttcctgacctgacttccttcaacaatcaagtgtgattttagaattgtacgctgacataaatccttctgcccaagttgtttttgtgcatggtgttttatcgtgggactagaacccctcggacagagttatctggcagaagaacccagctgggcttggtgtgacaggctgaagggtgcttatccttttggagaactacagacatatttcagaatctaaatcacattgcaattccatgtcagctcattttatagcagcaatgacagatttgtgcagaaaaaaattttatgatcattgaatgaatgacggtagggaattgtcatatagtttaatagaatgtcctttttgtatggcttctccaagtaacttagggttccattgtttccttgtagccaataaaatgaggccaaattacatcttacctaacagaaataattaagctattaaactggcaggtggttttcccctccaggctttttgtttgtttgttttgcaagtaacaggcttatctttcaaatcccttcattgtaaaggtggaccctcatgcccctaccagcgtccttgcttccctgcttccccactcctaggccctatgggccccacaacccagtcacaggaggagcagggatggagctggcagcagcagctgaaatgccacccaggaacctggccttcctggtttcctctctgctggttttcttttccttagcttctttttcacaagggatgggagtagactgcctctctcgtcatctggagtctcttgaggaaagccttcccctcgtttaggttaagtgaggaggaatgaggctttctaggactggccaggatctatcctcagaagccccaggctaagtccatgagaacactctgcattaagagtgctttctaccacccattgtacagatagggacatttagaatgctcagttcataagtctatgcaagttagaagccaagatttgagtcattaaacttggtgcttgtaacctctagaggtttttaaatttacttctatcctcattggtatttctgtaggaaacttagcagcataattaaatgcatataccttctttgtaccctctgctacacttcccatcctaaagtcccacactgcttaatagagtcatacaccagttcaccgattcccttaccgagggagaaggtgtttaagcaacattagaatttgtcttttcaattttcacataaagagttgaagtatgagtaattgctctcagatctgtagagcacagcaataatttaattagcttcccaagtccaagttagatgggtaaagttgtaacacatgaaagggcatagaaaaatatgttactttctgtttcagtgttcttaactacagatagatatagtgatccaaccttgaactgaagaagcccatggattgggcagacattttttagaaagcaaaacttcttttagtggttatgaatatcactgcaagaaagttctgtgtaagtaaataagtcagcactctctctattgagaacagaagttagtgttatggacagacatggttttaataaattgcttgccagctgctactttccccagccagtgttgtggccatcaataaataaaacacatttgcttcataaaaagatatggtgacactttacagggatatattttatggggatctgcatccgggatgtcactttctgattttagcataaaggacaggaaggtgctacagcccttgagcagagtgtggtgttttttctggttgttgtttcttggttgggagctagaaacttctgagatgtcaccgtggttttgaagatggaaggccatcaaaggcatatatgtccctcttccgctgaactcatcgattgttttcacagaacataaacatgaaacgtacttcttcaataagaatagctaagctcaggtagaaagcttctgaaatttctgacttaaagatcactagcttttgtgtgttgcggggaaacagcccaaggtgtggggagaaatggatgctaatgtgtcaagaaagagcttttaaatctatggctcctgtcctctgattctttggtgtgtgttgggttgggtgggtagggggagatggttgtgggtcggtgtcttagtcagggtttctattcctgcacaaaacatcatgaccacgaagcaagttgggaggaaagggtttattcagcttaaacttccacattgctgttcatcatcaaaggaagtcaggacaggaactcaaacagagtaggaacttggaggcaggagctgatgcagaagccatggagggatgctgcttactgccttatttcccctggcttgctcagcttgctttcttatagaacccatggggtattagaggccctgggaatacatgtgagagcattgtggatcccttgtcctgctgacatcgaatgttctcagtatttttaccccattcagtactgtcttcctgtccccagtgacctgctcattgctgtccagtgtgacactgttgtcagcaggaggacattcagggagtcactgctgcagagagtcagtccggagggtcaggagttggctctctgggtgccacgcaagctgccctgctgcgttcagcttcttcctgcccctcctgctcctgccctgtgtatggctgtcattaggagtttctcccttagctcagcacactggcactgcttacatctgagagcatggtgggaatccttgtctgttttgtaggcagaataaaatctcagtgaccaccagtgattttctttctttctttcttttatttaatttaatttttttttacttattcacttgacatcctgttcacttccccctcctggttactccctctcctacagtgtttcccctatcccccttccccaacaaaacagtgattttctaatcagaattgccctcactgagacccctcagccctcagggtggtcctcctgcctctctcctcctccttcctcacctcatgctctgcagaaagttgccttttgagattctggaagatgtttcctaccttttttttcttgaactttatatatatatatatatatatatatatatatatatattttctctcattcccccctcccatgcgcgcgctctctctctctctctttctctctctctctctctctctctctctctctctctctctctctctctctctctctctctctcattcaccatactacctttagcctatcctcattgaaagctgtagttttctcatctgctgggcaatcagctgagtagcccctactaacttgtcaaccttataatttgctagatgagcataattagaagtcttaaccagctgagtgcacttgatattcttgtgatcttgtccataatgaactgttaccatctgccacctcccagactagaagtggacagggtccccttagccactgacagaccattttaaagagattaatttgatcttaattatttaatcagaatacttgggagtggaaataagatattccccattattttaatcagaaataccttttgattatgaagagaggggaggggctgtaaagagagagaaataaagatactggaagtgtgagcatccatagggaggcacaacccatcacttttgccagaatcccaaggaatgtgaccttttgcttactccactcagataaaacagaagtatttagggagacatgagtgtgcgctggagtcatattgaactacctttaaaagacacgcatgcatgcacatctttcaatggatgtaatttgtaacaagatttaaaacaaacttaaaagtgaagtttacaagtaaaataatagtcaatttacttgtttctcttaccttacaggatttcctttggtaaaggaaattgcaaagtggttttaggatgcacactgataggtttgggcattagatcgaacattagaaacatcccaggtttcccctgcataaccattgttcatttattgacttatccttattaaacatcctccttggagaggtctcttgtagagcctacattatctctgtagtcaactttggttttatcagtttttaaattccttgagtctcaactatgcaagcaggaaaggccaatcagattccagagtgaatcttcttttatgtcccatgtccccttaatctaaccctgtcccatgtgactcagaaacaccaaaagagagtgagtaaatttttctttttttttttctgttgaactccagtggtctaatcagccaggattatgcggacaatcactggaggattccagagctccagattagaactagacgcttcactgaggaccgactgtgtgatgtgtgtgtgtgtgtgtgttttgtagttataaactcagcttctaacaaataagagtgagcagcatctaggataatatatcgtactgctagaatttctaatcttttcttacggagagttgtatagcagtgaaatcctacttacaatctttttctttgtcattgttaacattaacctttcatgtattgataaagtataaaagactgcaaataaatgcaaaaaggaccccacatagtacacgtcaaatatttggaatgaccataggttaaatgacttttgaaggtttataatttgaatatgtagcttgacatggggttggcaaggaggggaaaaatgaagtgggcatttaaaaatggagtttagtattgcttttaaaaagtacagctaaagtatttactgcaagtcagtgacagactgggcccctgtctgggttctcaacccacatggaaaggaaataaatgttcgtgacataaacgtttagaatcagtagtaacgagaagtagaagccgggccagtaccaaaactaagaaaaaaatatgataaggttaggaaatcgtccttaccaaccttaaggttaacgttgaccttaatcatccttaagaccaggatgactccagtaaatgacaacatcactattttatataagaattatgtttaaaataaatattttcacaagcacacacaggggaaatgtctacctctcgtaaacactgaagagtagagtgttttcctagaatgagagaagaggattccatggagtttcctcttggaaagacaggggtgaagtaagtattcatgctgcgtgcccgtgcttgagcaacctgcatgcacatgaaggaagtgcttctgcttcggaagtctgggcctggctcctagcctccgtctgctttcctccctctagtcttcgctcccactgtacagaagagcctgtgacagatgcaggacaatccacgagcacacacggagagatataaagactgctgagttttctctcctcttctccgtgcagcccagactggcctcaaacttaaagggcagaggttacaggcatgtgacaccaactttacccctctcggtcttctaaaaatctgtcgcacattatagactgtactatttaaaataacagaataaaaatagaaaacacacaagatatccataaagtatggtaggacgtagaatatactgtcaaatgaacccaagaatgtaaatataattcttccttcaaattctgggcagttggatccccaggcctgaacaggggagggtggagagtttgggatgaatatatccatacaggtgcacacagacactgggtgggaaggccagtgacaaggaaagagctcttctggcatcagaagtgcaggcaaatgggtttggctttgtcctcctatttcccctctcagctcctgttcctgttttcaaatgcaaattagagtgctctcttatcactgggctcccaggtctcctagactgagtagctgtgttgtacatgggattgatacatcaacgcagtggaaggcaaatgtgtctttagcttcaagaccagcgcatcactgtgttccattaagctaggcatgctctactgacagatgctgggaccactggggcagtgtgggcatctctccaggaatctccagcttgatgggccaagtcactatgctggagtgtgggtctctgatagcagcttctagagagtatcggtttgaatcagctctcagcagggtttctcagacaataccatgctatagaaagactggctaggatgcgtctccacccggggcttcagaatttaccatagaagcttttcatacttgaaaaaaacattcatcctttggttttcaaatgagaaggttttgtttttaaagaatgcatcctttaagaactttattcttttccctgtaaatcttttctgcctcttcgagtttactttctttcctttttcttcttctctttcttctttgtcccctcaaattgccctaacttgaacttttatgtattgcttcattttatatgcctcacaaacgtggacaactttgggtttgttttgtttgttatcctctcgttggctttgaacagcttctaaggcttgctgcagcgggacacagtggtgttctgactacagagtgcttagtgggcacaggtcctctgtggtaaacagatggggagtttagtgtcgagctttgctcctctattggcgagctgcttgagaggggattatatgataaaccaacgaaaggactgtacaaagagaagaacttccactgggcgaaaatgtggcagccaatatgggatgtttcatcccaggatgagaaagctctgtgtgcccctctgtggactgatatttagtggttggtttagaaacagtttgtatttcatccaagggaaaccactgtgagtaagctgtcttgcctcgaacatgaacaggcagtctgtctgtctgtctgtctgtctgtctgtctgtctctctgcctctgtctctctgtctgtctctcactgtctctctcttcctccctccctcctcccctccctcccacagacattgaaacacaaatgcttaaaatacattcttcgcaaagcccagtaacttattaaccagcacaggtgtagccctcataaaagctactccacttctcctgaggctgctaggaatgaaattttcatctcacacataacattttacatttgtgtaaaatataaaatataggtgttatatttagcattttacagatgtctcgaaggcataagtatttagaggagcttgccttttaatgacactgtttccccctctctggagtctggctgccttatgtgttggttaaacttattggcccttctctctagacttcctggcttaggatcctaaattggctttcacttattattagtgtgtgtgtgtgttagtgtgtgtgtgcatgtgtgagtacgtgtgcatgtggtgtgggtaggtgtgtgcatgtatggttttagagatgtgtgtgtgtgtgcacgctcgtactggtgaggctcagtctggtatagtcagagtacccactattttggtgctttcccgtctcaccctggactctcctacccagtagtcccttgagactgggttcttcgtaggccatttggtcacagtctgagtatcagtgtttaaaattttctggaaaattaaacaaacatacagtctgtgttctttaaattgtcttttgaatcacacttagatgaggacagagaggcaggctttttataaggatggatattaaggtttaagaacgctggcttccgttcattttatgatgtcgtttatacttaaagatgggatattattccagataaagacttaggatgagtcatcttaaaacatttggggggctccagccatgggagactacagccctgtggccattccgtttcaagcatttggagtagtattctgcacattatgagacctttagcattttatcatgaaggaagctttgtgttcagtgcgcttgtctaactacaggcttatatcgggactctatccatattcagtataggctgagctgtggtgtttgctaggtcagatctaataaatgtgcttttgatttctgagattcccctcagcttaggatgggcgtatccacaacactaccttaagtcccgaaacatctgtatacgtgtctgccttagacaaccctgccttttgccatatctgtgtgggtttggtctgcctctctgtttctggggacagtcaagaaggtacacttaagccagctagaataaagagggggtcctcaagtgtgggggtgagagtcccagacattcctatacttgggttgtcccgctttgggagtcactctctgtgtccaaatgtgtccttttgtctttgctttgttggattcagtgtttctgtgcctgagctttgttccaacctgactttggtttctctgtgcaacttttcttcattgctgggctgtcgcttttcttgctagccttacattgtgtgtttcctttccattggaaaggcttagtttatttcttaaactcagactcctggctctgttacatgtcaaggatggtccttgtaatcttgcagacttcctggtgaagtgtggataaacattcagtttccatatgtctagtcttcggaaaatgtcctttgttaaatatgaacaggcaagcaaatttacagatgatgaagtctctaagatgtcatatgccttgaatttgttctttaaagaaacatggtaaattaatctttttttaaataacttacagctaatctttgctaattatgcttctaatttcacttgagaacaatgaaataaaaaactgtctttggattttcacagaagtaaatttatggtaaaggaaaaatgttttctttcttgagttattttgctacatctcaagccttacacgtgttaaagtattaaaattcagaagtttccatgaacgttaaaccacttactaatctgcgcaaccattttcttttccttttgagtatccatttagatgtaactatgccttactggtaaacgcatatagataccattgtaactcagcctttttaatctatacactagtaacccttttaacagtgagattcatacttggatttgaagaatacctgtataactgagtagacacccaggttagaccttctcgtttttatcaacagagttgactcctgaggagagagcccagaagatcgccaaagccatgcgcaagcagtcttctgaagtccgagagaagtgggaaaatctaaatgctgtcactagcaactggcaaaagcaagtagggaaggcgttagagaaactccgagacctgcagggagctatggacgacctggacgcagacatgaaggaggtggaggctgtgcggaatggctggaagcccgtgggagacctgcttatagactccctgcaggatcacatcgagaaaaccctggtcagcaccactgcctttgacaaagaatatttaagaaatgtattcttgttgttgcagagaacacatataaggagacccacatataagggattcttataagctggtaccacttcagctccccacctaaatcaggaattatggcagatgttttccatatataaccccctcaaaaaaacaagaccccaccaagatggctttatgataatttagtttgtttaaacattttaaaaattccattcaagtatccctaaatagtgtagattaggcttaaccatttaaaacaagacaaaacctctcacaaactttttaagttcaatttgtttctagatatgccttccatttcatttacttttgtttcctattcatttgtttttttttttatattgtttattttgtaatgattcctgcagcctagatttaatagaatcgtgcccatgtggtacagcctacaggtctgtctcctagaaactggtggttggatttacaggtttaataaaaaaacaaactgccttagtgggaattctcatctataatttctatcttattgtctaagtaagtgaaaaataaatttggttataaattccatttgtaatcaggagttgcccgaggttaaggatattagttctatggtgtaaagcagctttgcttactcattctacattttcaggatgtgtgtgtgtgtgtgtgtgtgtgtgtgtgtgtgtgtgtatgggtgggtgggtgggtgggggagtaacagaatttaggcagcagaagacacagagagaaactttagagaaagcaatgtttgtatagacatgaatcacgccagagggtgagcactgagacaatcagaagggatgcatccaacattatccatcatgcatggagttttcattgcaaaaggtacacacatcctgtgttcatagacaccgggtaacagtcttcctttatatgagtgtggctgagtggaaaggcaagctctgggaaattaacttaatgctcaggccagttacaggagtgagagcatctgtgtgtgtagacaggggagtagtgacagccagcatttcttaaagctgaattgttcttagtcatttcacgtggttatctcgtttaatccacacactgtcaacacggtaaggattatttcctgaaggcaaaactgcagttgtccaagcccacacagctagttaggtttagggtctctgtgatacttttttggtttttttggttttttttaattgtccttctctttcactgcagagatctaatgttaaacacagccttgaccaaccctttgaatttaaaccctctaaaattcaaacacttttaaacttaaaacttttaaatgtaaaacaaatgttaacaaagaatatagtgttctccatttctgatgatagatatgcatctgcctactctataaattaagcagacctcttcaagaacttagagcattctgaaaaacatttctctggatacatgtgaatttaacatagtctaagaaaaaaataatcattcatttatcagtgcatctttatcaaatattggacactggatttttcctacttgtttatcttaggtagtgtgggttgtacttgggccttgtgtattcgggttaatgcagcgccactcagctgggtgcaaagccttctttttactttttattttgatacaagatcctgctagggtgtgtgggctagtcttgaactcactccatagccccaatagcccttaatcttgcaggctttctgcctcaccctcccatgtagctgttattacaggcctttgacatcaaatctggcttaactaattttaaagcctaaaaagtctaaatacaattagtatcaaaaaaaaaaaaaaacccaacaaccttaatacctccggatttgagtgggaacttacctttttgaatttgaaagtatcacatgataactggggaaaattagtgtggaaaaaaataaaaatttgtatctgcagaaaagaccaaagagtttgagaattggcagtcttactaaattaaaggactgacttgcctctccagccaaattcttttgttcaaatctacttaagtgggaagcttaaaaaaaaaaaagcaaaaacacagaagcaaatagtctaatgggaaagaataaattggattaaattacttttatatctttagaggtaaaaattaaaaattcaagtctcactgaatcaaatcaagtaaactcaatgtgtgtaatagtttacattttccgtaaagtatatcccctctcttactgtaggcatatagagaggtaaaacctaaatactagaagttgcaaaatattagttaatatgtcaaagctggaaataaaatcctcagaaataagtaaataatttcagttgctaaagttgtctttaataatgctggttttttgtttttttttttttttttgcatatataccttgtggtaccagacgggtttgagacacacacctgccaacagtctaatgagcacctttgatagtagcagatgtttctgtttttatagcagtgagggctacgtagacttgtattctcttataggaaaatacagtcaaaacatgatgaattagttctttatacaagaacacatggcagttctgaaagccatttataactccatttatttcaagccccaatttggaaactcttaaaaggcaaaagataaacttccttgatagaaagtttcctcattgccataaaaacaccttgccataaaagtgcaaacagagccagaaagactttcctgttaaagctctgtcaatgtttcacctatgacttgtaatagaaacaaaacaaaacaaaaataggatttttttttacacagtagaaatataagcttctttattgttccttaaaattaaaaaaaaatcctgtcctgaaattatgcatgaagttataatcaagttctaaaacacctttctaaatttctaaatcaccatctgttgatataaaactggttgttatttaaaattaaaaacctatcaaatagcatgttaactttaaaattttaatatctaaaactaaaaggatattgattttaaaatatggatccagttttaaggtctttgaatttatctgtgaaagagaatattaatataccaagctaaaaaatcccagttaaaaactctagaaacatttgaggtctagcatgtgtgttcagctgtgtctgggagaatctgacttgtttcagagtccacgctgataaactctgtgtccttccctctgtctcccacacctgtattatttgttaatcctttgcacctgtcatgcctgtcactatgtcactgtatgccccataaccagatttatacattgtgcacattgcccaattacattacaatctgcgtgtgcattttggaccatcttcagatgtctggcatcggcagggatagacaaaactgactgcaaatcaaaattctttctctttccatgttgtagcaggacatgtgtcctttggggcttcctttcttctgacttcttttgatacagtggtatctactgaggttggaaatagatcttattaaacacctggtgactcccatgtctacaaattcaaacagcattcataccctgctctctctgatgcctgtattttacatgttggcttctggctctcagtctcttctcatgtggtttgttcttcaactctcctttgaacttaaccgcatgcctttaggcagagtcaagaacttgaaaacactaaagtatattccctgtttaccattggaaatatttgattcctgaatattgggttttagcaataattataattcaggataggttttaggagaggcaaaattttatccctgccatcttggaaggctgtttatctgtcctaaaatctaacataagaccaaggaacaaaggaggtacattccattccttactataaaaaagcatcagaaagacagcagatgagtgcgtgcgtgcgtgtgtgtgtgtgtgtgtgtgtgtgtgtgtgtgcgcgcgcacgtgcgcgcaggttctaaatgtaagaaagtgtcccctcccaagcagcttcttccatggggcaggaggaatgtgaatgctaagggataggaactgaaatctgaggtgtccagcagtggggttggaatagctctgaactgtcagaatagctatgtcatgacatgtgacacgtgtgtggtttgtacgttttgatatgttggctgaaagtcatagctgggttagtgacaccgaacagaaaatccaggagtgctggggaaaggcctccaggcaaggctgccgagggccatctcctcacggaggcatttcagcatccagtgggatgtagagaaagacttgtcagagaaagcgaaccagtgctttagaagacaggtggaattcagcggagaactgaggccatgactatatcattatgctgtttgctctcattggctttaaagtctagcttcccttttcatatgcttgcccaggacatatactttttacctgggtctattcttcacccagaggcagcagttcaatactgagactcagctatagattttccatgatgctctgctcttcctgcccatcccctaagcacagactgtgatcctagcgggttcagggagatacagaacttttctctcctatccaataactatagcttagtagtgaggaaagctacttttactcgacccctaatctaagcatgactgagatcaagtcaacttgttgtgtctggtgaaataaaggagtaaggcagccatgcttcaataaaaacagcaaatggaccatgcaacagtaatcctgtggtttgcatattatagactagacagaaatgtttagtgtcttaaatgagttcacaacttgagtttgtctcattgcccacatactttaaggctcagggagtctctggctgtataggttattacaggtctgatccagtcagctgctgttaagtagtgtctctacttgacagcatcactatggccttcctatggtcttcactaagaagatggcaactctggcttttgagaaagtctcttctggcgacattctaaaataatctgttttctaccaggcgtttagagaagaaattgcaccaatcaacttaaaagtaaaaacaatgaatgacctgtccagtcagctgtctccacttgacttgcatccatctctaaagatgtctcgccagctggatgaccttaatatgcgatggaaacttctacaggtatcggcttagccccttcagaatgctatctaacactgcataaagaatacagaacaggaatagaaatgtcaggctatacaattgttgatttgtatttagtttcttagtgtaacaattctttgtggggttttttttttaaacctgaaaaacacacattaggatgtacacaaacagaaacactcagatggtctttaaaactcacctcagttgtaaactacatattatctcgtctctctctttactgagggtgtttgataataaatttagtaggcaggtacttgtctttctatatcttgaaaccaagagcatcatttagttatgagtatggatttcttggttataatttatatttacactgtatataatacttgtaaaaaatacacaaaagccagtaagttgcagcaatgataacctggagtcagccacaggatcctttgtcctgttgtaacctgtaaagaaatcattgtcttactttcattatgtgttctttctcttttgaaaaagttacaaagcttttcttcgttttctttacattgttcactgtgcaggagttttctttctgtttacagaaagcacacctgcacttagtgtctagatccgaccttcccaaggcaattgtttcagtggctcctgaccctacttgtagactccagattagctgagccaggactcatgagtgttccaggtctaagcattggctgactactgtccatgccaggcagcagttcatggtacaaagggtctgggacacatttgctctccacctcctatcagtcaaagcagctatgcctttttgctgaaaatccgcaggggaggctgtaactagaagagtaatagtaaataattctgactaatttctctacaatataacatgtagtaatacaaatgtgcagttccgtcattttatttgaaaagtactgtacattttaggttataatatattcttacattatccaacatcaaaatgcataaggaggtgactgagattggacttggtatgtaaatgcatttgtaaacaccagaatctgtccctagcaactcacttggtagaggaaagggccaccttctaaaagatgctttgtgacgcctgtgtcctgaccacccgcacgcctctccatgtagaatacatgaacgttaatttttttttttaatttaatgttacatgttttcttaatgaagttgaaagtgtgagatgtgaatattccatatgtgacgatctttcctatccttgtgaaggatgtcaataatccgggattagtcaggctaagcatattaaatttgtaagtgctcacagagatgtctgaacctaattctttttgcttctgtcccatctctctgcatcgttatcattcattatactcatttgaagattgcttttctggtctttcttgatttccttttgctttgcctctgttatcctcatctctacagatgtcagatgtattgttagatttgatgggaacattcttccacctttatctttgatgttggtagctactagggttcaaatatcagtcctggataagcaaagacaaatccctgttagcagacagtgctgttaaatttcaggactagcagcttacttataaaatatgacatttgagcatctctcataatgaataaagtacactctgatgcaatttatgtagctgaccaggagaaagctgagatgcccagtgagctaggcagatgcaagttttatttacagtgtgctgaaaatgaaattgttcattcaaatggaacagctcaccaccactgcacagacaaataacagggccagggaaatggaaatgtcagaaggcagtatgcaattgttgttcatttgcatttggtttcataactggttttgtcctgtggcacggtaacaatagaatccacactaacaaccatagaagggagtcatggctgggatgcactggtgacacattgcagcctggagcagggattctcagaggctcctctttcctttggtaaagaccatcagatgcaaacttgtagggaaatcagaagatgtttcacacccagcttccagttttctctcttctgtcatctcatatactcatttatctatctcccatctgtctgcctgcctaccttcctacctacttatcaatatgcttatcaacctgtgtaaccatctaggatcatctgcttaactgcctgtctacccatctatccatctgtttatgtctttatctttagagttctctaagctccatttcctacacattctctgtggtacttttatcctctttttttataaaagaggcatggataagggctcctcccatggccacatcttaagctgtcttagaagcatgcttcctgccaccaagttggggagaacagttttcaggcataaagatgggctccgatggccaaggcatgaatattcactttgttctgactagttgtgtcctctggcccttccttgtgtcttgctttcttcatatctaaaatgataaccacaattaatattaagctaatgtggttattgtatagattgaaagttcatatagatagtttagaatgatctctgactttctttaccattatttaatgtcagaagttgattttcatgctgccgcattaataagaagagaagttttctgcccaaacagtaatgaattgatagagcaacagcattacttgataaagtaattacgtcaaggatgttatgaaaaccattgtcttgaagtcagtcgtttcatctggcgtgtgcttgtgtgcaggtttccgtggacgatcgccttaagcagctccaggaagcccacagagattttgggccatcttctcaacactttctgtccagtaagtatcaataaatttgagtgttcttgcttaacttgaatgaatttgcaaattcgttcagttctgcccaagaagctctatctttgctctaactatactttaaattaagagaacatgttcatgaaatattacttattgcttatgtaataaatgcagtatgtaaattggtaaatattcaaaggaaaacaaaagtaaatttgtatctagatatgttttctcatttaaacattggttatgataacatatatggtatttgtcatgcaaagcttatgaatgtctcataccaaaaatttatgctgtaaggttttttaaccagtttatttcaattctctctctatatatgtatacttagttttttttttaaagcttcacatgaattttaattcactatataaatacttaaatgagaaaatgttggtttactaagctcaaggtagtcatctcatggacaaatgttatacattaagtgttgcaccaaggtaggtttaatggaacatcctccaactggaacttgtaattttatgtgcacttcatgaagtcttagggaaataattttgagccctgttttatttatcatccacttctgatgatacttaagaatgctgaattttgaaactcccaaactgattttaaatgttaacattgtcttttactagacctgagaatttttgaaaattaatttcttgatctctgcatacctatttcctcagattgcctcaagaatgaaattcagtagtctatcctgttagaccaagcacgcaagccacaccttggcaaagatgctttcagcacatattaatgccttttctttaatttcctatgggaagtatatggaaaaaaaacaagttgtgtaatttaattaaatttaagtaaattttaagctcaaggccaagaatacttctcaattatggaaacttattttctctgaaaccacagagaaagggtcagggtttatttacttttgtattcttgtgaagtcacatttgtcattttctgtcccctacctctaagacttacccatcttcagttcctaagctgagcctgtgggtgtttgtctctgagtgaggtatagccctttgtggtgggtaagggcggacctttttttttaatgcttaacatatggatagcactattgttgaaataaatagcctcttattatactcattagatattaagtattatagatttctaaaccctatagaataactaagaccaaattgaagaagcatttgtaaataatggagactctgtagttcaaatgatcagtttatctgctaatattgatggagccctacctttccacctggcaacctctcccatggaaatctagttcatgtttcttcagtcataaagcactgcagaattgcaatacactacatggtgttcaagcacgtggtcttcaaccgacagtccaagaagcttggttattcgaatcaaaataattactgaataaatgaagaagtgtgagaaaacttgcaattagtacatttaataattcttattccttgctgcttacggtctttggcttgattgtgttctttggactttacccatgcttgttaaaaagcaagttccatgaggcacacaataaaacctgacctatcagcctggtgccaccatgaagtgaggctagctcttatgagaagtttagcatacctgagtcttcatttctgtgtctgtttgtgaatatctgtggacacagttgtaaagatgagtgcttgcctttgatcaagaccagaacaattgttaaggaggaagtttgctgagctagtttttggaaaggtgttgtagtatctgaactacaccattttgaaaaggactttgggcagcttcttcttttttaggggaggggggctcatatcacaggactctctctctctctctctctctctctctctctctcattatttatttattttatgtatatgagtacactgttactctcttcagacgcaccagttgagggcattgattcccattacagatggttgtgagccatcatctggttgctgagactagagctcaggacgtctggaagagcgggcagtgctcttagacagtgagccatctctccagcccttgggcagctatttttaactctgcgtatttagcttcttctccattatactggacattggtgtgtggatcttgctgcattttcaaaataaagtttggatttgggatgcttggcaaagtttagaatgttgcatatttgcaagatatcaatgtgccaagaaattatgaaaaaatagtgacgtgtctatatgaaggtctagagatagttgtaaactttcattttaatttacctggtaccttgcttagcaaaattcttctggttctaaattcatgtggctactctacttaaataaacatttaactaattgatttactaaagcactaatgtaatgtatctttacaagtaatcagtaaacagaatttcaaaaaggaaagaacttccattaaaaggcatcatatctcaatcgtggcaaacatctcaaacatactacaaacatggaaaactgttttttaaatactgcggatcaaaataaatatctgatatttttcttagatgatctgcttgcttcttaaaaaaccccttgcctatttttatgttgaattttctttctaaaaccttcttataattaaatttgcttgagtgccatctgttcataatagctgagcctatgaatatggtgcaaagtgaagaatactattagtgatctagaaattccatcttgggaactgtcattttaaatctgaatgtacagcatatagggagcatgctttgcagatggcactgtgttctgtgttgcaatgtttatgaacaataacctgattttgtgaaagtgttttcattgttagggtctgacagaatcggctctggacgttgagtcttggttcttttcctcacttcacatgaagctttaaagctgtgctgcttggcctcgtgcttttcttaattgcaggaatccagctcagagccagaacgggtccctcaagagttgctccgaaatgtgttcatttgttttacattaaggtgtaaggcttgctgcttccaataacttccttttgtttcctcagcttcagtccagctgccgtggcagagatccatttcacataataaagtgccctattacatcaagtaagtccacttcagttctcttttatgtaccaagaaaataaagttttaccgaataattgaagagcgctcctgctcccctatgtaacttgttttgttgttggtcatttttgtttgtttgtttgttctgagacagggtctccctatgtagtcctggctggcctggaacttattatgaagctaggttggccttgaacgcagggagatccccacccccacccccacccccagcctttgccttccaagtgctgggaataaagctgtgtaccggacccagagggtctgcggcacaaacccagctccctggacgttttaatccagaattcaatccgcttaccaagaggaagatgtgcatgataataatgggaagaaattaattttaagatcagcgagttgtccttccttaggtctttctggccttggggacaggtcactgagttgctattttatcatcatcttcatcttcctctttctcctcatcataaggttttttcagcctagtttctctctcctgttacttcttatgtgacatattctgacccttatctagtttgcacaccatctcaggatgctggtcctttacttactgtatactttgtcccagaaaagaatgatgaagcactcctctgttatctctggaaggggaggttagtgaagcagttgctttacaacgcaatccagcactaagcattgtcatcgaccctattatgtattaggagaactagattgtaattctgagagtgcacactgagtatcaaaagacagctgtggctcacattagctgtgtggccttgggtgagttgaataaaaaaaagtctctgtgccaagatctctttgtatggtgtctgaaactaactgtggtctcttgaaaatcaaagtgtgttctcttaaaaatcctatttcaatattaattgactttcggatctttgtttggaaaaagcttgtgaaaccaatatttgttgaataggacattttaatatgcccttccttctatcctgaaatccattcttatttttaaaacaaactggtcatcatctataaaaatataagcagtatgtgttacattgtcttgtgagaattgaactcttttgttcatagacagcatttggtatattgagttgtgatggattctagaatgaggcatcaaggcaattgatgagtgtgtcatttctacagacaggaatggaaaggactccaagactgggtgagatgatttgtcttggttgaaagcagttgtggccatctaattaaaattttaaaatttcttagctgttttacattttaatttcaattaataataactttagcaatggtattgaagagctttagtctgcttgggtaaatatttacctgaatcaaataataaggctttagttataaatctgagacagaataagccctccccttaaagaagtccaatcctaacccctgggactttgactcagttctctttatacataacagtgttgacaacaacatttagcaacagtctccaggttgtaggctaccataggcagattatcctgatgtcagtgaaatcatgtgagccttttaaaaggaagaaagcagctgaggagaagccagactggaagagggaaatacagatgcaactttgaaaatggaggaagtggaatgtccttctgggaatagagacaattggaagaagctgggaaagaaggggtgtggtccttatagacctcccagaagcatccatgccgtgctcaatgctagcctttggaagctttttgtgtggtagcattaaaaaatgagtatacatacagtcccaagtttagaaatccataaagattgattaaaatgaattcatggatagtttgacctagactcctctataatcagatattttaaaatgtaaacgcgatctagtaaaacagaatttgttttcactagatagagaaaattggaaatggcttactcttttcctttgttttgtttttgtgggggtcgggaagacatctacagttcatttcacacacacacacacacacacacacacacacacacacacacacacacacttccattagctgaagaatttccatttgtatacatcagtaatagatgacgaagaattaagcagttggaccttgtctaacccctggagtttatgttgcggcacagtggaagagtgttcttgctcagtcagtcaattctcatggagagaaaacacgtgggagcaaagttggcctatccgacatcttattgcttgctcataaccaacactggaaaaataatatataaaacagcactggcaattctttaattctttaatgtttaaaggttaagcttcctataatgttttctatatcttagtaaatatcagattttcttttctctttttagtaattattacttggcagtttcatacatacattctggtaactgctcatctcctcactctctcctgtccttttcccacctccattaatcccccctcctaccaagagctcctcttcttgctttcttgtcttttgctttgttttgtttgtactttgtgcctcagatcctccatggctacccacctggaaatgggtcattttcttaaatacatacagatttagcgttaaatgtcttttatggtattcacaatttagagcaaagtctccgggttctataaaattcactaatctggcagtttttcattgtttactctgttatgcaactttccagtttatttccccatagaaaaaggaacattaaacttgggaggtagagtttagagtgccagttttcacttagaattgttacgaaaacaagagtcaatccttgggtaaattcataagcaagtaaatgatgaatgaaagaacttttaatgtgtatttcctcttgcatgtctgtacatataagtagaaaaaaatgtttaaaacctacttagcattattgtcacgctattagaatttcctggggcaaagtgagtgaattaatttagctgtcagaaaatagtattcaagtagaaattttaagcttgcattttcgtacatgtaatgctggagtgcagcaagagacttaaggagaggtgaaacttattttggggttatatcttaattgtataggtgaattaaaaatataggatacagatcgagatggcccttcattagcgttttgaagttcatggtagtgagaggcatgtctttgaagagcatcaggatgtagatgtgaactgtgagaacatgtctatctggcatgactctgttactgcctgtgatagttgggtgcctggtgcactaacaaatgccagagaggaataaataaggtcataaagaaaaacaggtttaatcaaaatgctgagttgtggagcctggtcctaatggctacatctacaaacactccctcacctaagactcagggaatattgcagaagaggtggtggaaagattgtaagagccagaggggatcagggagtttactctgagactgtgtttcctagtaacattggaagctacacccataaagtctcactgacctatctgcccaaacaggagcgcaaggatgacatcagtggatgccagcctgactggaggaaaatccacaggtcctcaacactggacaaaaaactataggcgactgaagacggctgggagtaggcgaggtggccttccccagtgaagagaataccaattggttgcctagggccttacaaacatacatacaaacaaacatttagcagcttatactttggagtgtgtgtgtgtgtgtgtgtgtgtgtgtgtgtgtggtatagagcatacaataacaaatagtgaggatggcagtgttgtttttccctaaccaagggtagggaagctgggctattataggaaaccctaatacccagccagacaacaaaggggaagctcgtgaaggtgtttctctaccagcaacagcttaagtgataaggacaacttatttttaaggattcttgaaagttcaaactagaaccaattgaatctatagcaatggtttaatgcccagtacaagaaaaatatgttaccctctacatctctccctacaacacatttcctccttttcccttgtccaaaggacagattatatctctgagctcctgatttgtaagtagaggcccacaggacacactgagtccctttaaaggggaaggctgtgtatgtgtatgtgtgtgttttgttttgtttgtttgttttgcgtcccagggacaaggcaaaaggagatggcttccagcagtgttgatgggtggtccccgttcccttatttgaggatgagagggaggtggagatattaggtggcagttgggggtgccttattagttctggtgcccctgtatctattgaggtagtgcacatgtttattcttctaatcaatctttagtgccctgtagcaaagtgtcgcctgcccctccccttaccccaggttcattccaccctgaaaattaattctgctggtcctttaaagccaagaaccaacacagcttctcgcacagttctataccaactattctgtcatccctgcccacagtattgactttctgaatttagggatgtagtgaacctacttatagctttgcctttggacttgctcctgaatctcaaattatcttaaataaactgtacagtcaaatccagttctttgctgtttgtagtttgtattttcttcctcatgtcctcattaccatgaggagccaggacatttttagggttgactctggccctttacaatctgtctcacttgcatgaggagtaacactctctgttatggaatgttgactgtcaagccctctccttaactctgtgagtttctaattccattccctcccaaaaaatataatcttaaatttcctgcctttaaaagtccaaaagacaaaatgctgtgacgaggttcgagaagttttctattgcctgaggatcatggggttactgttaggcttgctggacagtgccttgctgccccagcagaccctcagcctatgcaatcctgttcacagtgaggactcaagttatgttggtgagcgctggggtactggagtttcttcttatggggcacactcggcgaaaccaaaaattgagatgatgacggtggcaaataccatcttttagggctttgagactgtatcacttggatgactggcatcacttgggactaacagcgtttgtttcactatatagtttaggggcctctaaaaaattgattggttattggattactaatccaacttttataaaccatatttaaacaattgttacaataatctcaaggcttatgttttatcttaatcaggtttattatctgtgtttttttcttatcatttcttatcttctgtcctattacataacatccttaggaaatgtcttatcccttaagttagggcttttccactgggaacgttgtggcgtgttgacagttttgataagaccagtttagatggaggagaaatttaggagccaaaggcaaattgattgagtagataatgtgacagcaggaagtttaactattgcataatagatggtaatggtaagttttgtttgtggagaagcgggaaaagggtatgtttaaggttatggtgtgtgtgtgtgtgtgtgtgtgtgtgtgtgtgtgtgtgtgtgtgtgtgtgtgtttggcaggagaattgagcagatcagttttattgtgagatgagctgataatatagcacatttttttccctttgaatcattggtggggaattggccactgctggtatcagtgactttcaattgagggtggcaaggaaggcgggtagaagagagaacgttgtggatttggaagtagggagatggaatctatcagtttatagtttttcaatgaagtgtgagacaaaggcaagatagtatcagggaagggaacttccttttgggtaagcaaggagaaggaggaaggaaggggtgtgtgatcttggactttagggacactagttcacttgtttgtaggcaggcatttgaagcttggaatcaaatgtttaaagtagaaacagtctgtatgtagactgtttttttgggtttttttgttttttcttctccatattcaggcgcagctgctttgattcagaaacggcaaagtaattgagtagatccaggcccgagatttgccaggggtaagggggaaggcagagtgataaaagttgtttgtagtgattataatgatggactgtgggctcaaatctggatggattcatcaagaaatatttaaaaacgttaattctgcaaatccacttccatatcaagagctcaggcttaaatcagaccatctgtgttcagatctccatactgctcctggcccgaggccttcagtgagttatctaagtgccttctctccactgtgccctcccacatctgaaaacagccatcagagtcccctaagtcacgggcagcatcataacgtggactgagcttttcacatacagaaaagtccaagctgctcactggaatattaggctaatacctaatattacttagtaaaacttgattttcaaaatgtatagaatatgtaagccatgccttaatgtaatattatcctattacttaatatccctcagcagaagtttgctcagaaatccatatatttcctatttgcctatcaaaaaggacaccaaagctgaactgtgcagttggttgcttcatggcctctctgcagtgctaatttcgttcgtttgaatgctttcctgtatgatctgcattttgctttctatggcatatcaaaataaatgtaagtcccagggtaccctgtagacttttcctcatcaaaggcttcaacagttttgctattgtttcccctatgaaggcaaacccttggatggaaggccgtcctggtgagaggtcacttctcacactatcctttgcttcaagagattttttgaacctaaatattcatttggatatttaaattttaattttattccgggacaccttcctggatcaggtacaattttttgaagtaagattttggtagcagcactccagtgtggcagaatagtttctccggggtgctgtggttaacttctccccctaccgggccttgggattgcttggaagataagaagattgcctctgttgttttgagggaagacattcctttgcttctgtcttggttgcctgctctaggcaagctggaagttttatggcaagggttccctgctctagggatcctgcagctgctcatatacttagcttttacatctcatatggattgtgttctgatcctctttctccacttaaaaaggagagaaagaaagagagagagagagggagggaggaaggaaagaaggaaggaaggaaggaaggaaggaaggaaggaaggaaggaaggaaggaagaaagaaagaaagaaagaaagaaagaaagaaagaaagaaagaaagaaagaaagaaagagagaggaagaaagaaagggagaaagaaagacatccccccccccaaattgttgttgtgtaacccacagctttactttgtaaccagaggctgtgtttactttgagcctttgcagttctgcctaatgaatcaactagtattgaattcacaaaggagcctccctgctcctccctccatctgcttgccaaatgtgtgtgttccttaggctcccaggatgccgagccatcagcgcagaaccattagcagcctgctttggaatcctcaattgtttgcctaacttgccagtggtattttgcccttgtggcaatgtaggattgtccaaggggaaggtccacatttgtagttctagagaaggcatacataatatttaagcctgaagtctgattctgcattgctgagagctctagtttggcccgtgagctttggtttgtcctggtatctttggatgagatgggtatctttggacaatagtgctgtgaccaggactgaaattgcttggaggggaaaaaagagagagagagagagagagagagagagagagagagaaaactatcaactgagtcttagttgtttgagattaggaacccatgatagcagcatgggactgtactacattttcactaaactgttctttaaatcttactggtggctgatagatgtgtttctgccaagctcatggctatactgtgaacagccattcttttaggccagacatcttctacatgcccatgatctttaaggcagtatgggtagttagaggatagagtggttttgttgatgttcaggtcaagtggaaatacttgtccctttgtactggagctaagcatgagaggatgggaggcaaacagctttccagtgggttctaaaacctattccctccatagaactattcgatttgagattcttaggacgtcttactgactcagttcaagggcataggacgtcttactgactcagttcaaaagtaagctttatttatttatttatttatttatttatttatttatttattgaaacccactttgaattaccagggcattctattacccaagtatacaaaataatgattctgttccttgcccagcaatgcaagcgacttttctggtgcatcatgtaagttataaaagcagtgatttctcttaaatttatttttatgaatattctaatatcatctctcatggtctgtgctatttcacatagcttgctaaacagtttcttaagaattaagggtcatctgagaagtcttttgagaaccattagctgttattgctttgttatggcctagataatggactgcaaactatttttaaatataaggctactaaatcatcaaagttaactcatattaactcattattaatattatcacattgattcatattccccccacacatgcttacactcacacacatatgtttgcatgctaacagtcacacacacatacaaacatgcccatgcacacatatatgcacacacctaatttgtgacccactgtaatttgttttacaatctattcttttaagatttccaagtaacatatatgaattatagcaataaaataaaggtgtgtttttcaaataaagaatagggatcatacgtaaaattatccacctccaaaaataatagtactcgttattgagtaaaactaggaagatggagctagagtttaaaaatcacaagagaaaagcacttagctaaggagaggctggggcctggggttgtgtaaggaaaggagagctagcaggcatgaactagggaggaagagaaccggggttaacaaacagaagagctcaggagatggcaaagtgagcacatgatattcagatttagagtcttcatttctctgctctttagaaatttgattaggacttttaaagtgtggtaactcttcagaatgcagcaactcgtcatagccttctgctgtcaaagcatttactgggaatggaaaaaaaacatcagcctaacaagatggatattattccggaggccacattgatttggccacaccctactctgggtccaagcatccctggcagtcatcccttatgtctgtgtttcagattgtagttgcaattgttttttcgatacagaaggcagaattttgtctatcttttcttaatacagttacacaagcaaaattggttattcatagtgtttttgtatgtatatgtgtctgtgtattgtgcaagtttatgcatgttcccatgtatgtggaaaatgacgagagagagagagagagaatatatgtacatatatggaggtcacaggtcctttattcctctacactttatatattgaggcagggtacctcacttgaacccagagctcaccaaagtctagcttgctagttcactgcagacaccccctgcctctctccgctgtcctggcattatagatgagttccaaacctaccaggattcacagagtacagggctctgaattttcatcctcatatttccttggcaaacattttactcctgaagccatctccccagcccctattattcataacttgaatactgagtaataattgagtactagatttctgagcgatccataatggagtttttttttttttttttttgcctgctttgcaagtctatgtgggattttagaagacgatagcttatattgtattttgtagtgtgttgtttatacttacatttttgttttctccccagccatcaaacacagacaacctgttgggatcatcctaaaatgactgagctcttccaatcccttggtgagtgctgctgtgtttatgagtaggccttagtgagtgctgctgtatttatgagtaggccttagtgagtgctgctgtatttatgagtaggccttagcgagtgttgctgtgtttagtagtgatgaacggccttcatagccaaggactgaatagtcgtaaaaagaaactcagctactcatcttttcttcttgtgtggatgaaaggatcatgctgtggcatgagaagacagtgccccgacatgctacaacaagagtcctgaaatttaaaggtagttgcactcctaaggtaaacacacaaagcaagactcggtgatttggaagtgtaccagccaaaaggacttcattttctgggagagatctgattgttgtaggtcttacctcatcttatagttcagctctgcacactaaaaaaagggaaaacatagtaacaatatagtaacctcaaatttaccgatttaaaccattttgttttctatgtgggaaaattttctcaaattagcttacttaatttttaagtcataaactaaacttattttgacagggggaaaaaaagatttctgtttttagactgtcagtaggcagtgactttcagcttattggtgagatggccttcatcaggttgacagtagtcactgaagtttagtccttgagaaaccgaggcggtgctaagggaggatatggcagcatcctgtgctccactccttcccattttaagaccaggcgcacacacttgtttctcttaaacactgggctctgttgggcactctcccttggtagttgagtctgcagaagaaaagcaagagaaaagtcactgctttgcttgatttagagactgagatgggggaaaagaggcagtgatctttgagttttcttccaactctgtcagtttctgctaacctatctttagggaacagaggaagaaattgtaatattcactggttccaagataggaatgttgattattttcatagatctgcttagaacaaccaaatctgtgaaccaataaaagaagcaaattgatcagggtagacagagcgtagaagaacagcccccatgagtactgggatgagctggcagatgacagaaaactaattgccccagtaagccaatgactctgaaggagaaaccctgttagctgagcagtctggtagtccccagtcatagtggtacctcctgttttcccgcagggcagaacttttccccatgctcattacccccacgggtcatggctgacacacccacagcacaagacaggttctatagaaaagcagtgcaaaattattggatcaaagctttgtgttatgaaagagaagtggaaagtaaggaaatgttttacttctgtatggctctgatgaagtcaggtagtctgatgagacgaggagagatgttctgctggtgaatagaatgaaggagaagccaccttatgtgtccaggttctccccaacttctatgcatattgttcttttcctccaaaggggaggacatgatatgttacttgtagtttcaaatgaggatggaaaaggtcacagtgacctccattttatcactcgtcttggaaaagaggcgtctaagatctgtgatttggtcatggaaagggaatttgagtttcctgtataagattgttttgcagtgtctcccaataaggtatgaacaatcatttgatcatatttttatagattgatgtgaaatttaggaagtttttttttatcatgaactcacacatttttttatgatccaaaataagcaaatatgttcattcttggcattcagtagaagttaaataataagcaggcctttaacttgttctcttttccatttcagctgatctgaataatgtacgtttctctgcctaccgcacagcaatcaaaattcgaaggctgcaaaaagcattatgtcgtgagttatcacactaactgaatcaccttgctttgggaggttgactttgttgttatcattaagacagagacaaatggcgaggctgaggtatttgcagagtcaatctgactttcagtgcccctcattgaaggagttagctgcatttctactcatacttcatgattggtgtcgtcagtgggtactggcaaaaccaatgagcagtgccactcgaattcagagtgcaaaatttatccaaacgcaggaaaagctctttggaaatttatactgccacccagttttaaaagattaagccattgaatcaaagctgtaggttgttgcctagtaagtcctttttgtccactccaaactggaggcttccaagctgtttgactcagtacaatcatgaaagagaaatgcaaagcagtcacattgctgatttctctgggaactaaaaccataaacatgatagaaaattctgttttcctttaaacatgacagaagttatctgtgtcattaatggatttttccctgtggagggcatgctcatgggatattctatggtagtcattctaaccaaaggttctttttatgccgagaatatcaaaaagtgagcagacatgtgtatccttgtaaatagagtattgatttaggctttctggattctgtctttgcttggattattgacctgacccaagcaacatttaagccttgctagatactattatgcaaagtaatatttgcatgtactttaaagattgggagatttggaaaattccatatatgcttgttttctactctttgttaagaactactatctgcctgggtagctcagtgaagttttgaaaactaccctcagaaaaatggtatgttagggtcaaaaattgtgcttaaaaccaatcatgggagggctgatgagtgtctcatatggaagaagaacttgttgtatatgacaatgacttctgttgccggatctcatggtagaaggagagaaccaactcctgtaagttttcctctgtggactcacagttgcacaccacacccctccccccaactaaggaaaataaatttcaatagctaaatataagttatggatccattttaagttggctgggtgagcagagtcgagcaaagggagatgttcaatcacttagagaagacagagttgtacaaagtattaaataagaaagacctatgttccttttggatgagatgtctaacaggcagagaaacagcaatatctaagccacggaatggaaggaggaggtgacctcaagccttgcgttatcccctcaggctcaaaggtagtcagcatgttgtagtagttacaaaacatgttccagaatgacctgttcaaaacatgggagctctcgcacttgggctagagatctgtgtattgggtgggaatgggataggaagctgactgtgaacagaaggcaggttgtctatctcctcaatgtgtctgtagtgataatagttttgaaccctacatccagctagtcttgtctttccaggcctgttgggttttaaaatgagggcagatgacccagccatggactttccactggccaaccactgttttgtaacatggcgaacatgttaccaatgttctgttctgcacctgggtagagagccctctttatgcactaagggtttgctttcttggtttctcttactcctgaaggaagatgtctctctctggatcacgtccaaacccgagaggagcagaagagcgaaaagatattttataaagtacagtgaacaatgtccccagtttgtgtcagcttaaatagcttcagggatctcctgacagccactggcatccctctttccactgcctctggccaccacagggctccagcctggagcctctatactacttgtcacatttacctgtttgaccaaatcaacttttctctctcaaattctctgtttacttgaactgccctggctcatcttttatttcttcctgatgctttttagaatttgcctcttctacaattttcatgctcatcccacctgtttctaattttcccagcatttttatgatggcctgaagctgctgtttttcacttgcttgcctggtgtaatagttgtgtgtcaggaggttgacctgtctctacacacagtggctttgaggtcatggtcacctctcattctgtgcctgtctgcactcagcatagtgccttcttgccagcataaaagagagagcacatttgtctttattctttcactcttgctttattgatttggttctgagaacaaggcaagagactcattccaccctgcaaagggctcagatccaaagggcacaatgcaggtggctggaaggttcatgctttcagcagattgcactccccttataatttagggctctttacctggctggcatctgctttctgtctccctacttccttccctttgctcccatcagctcaccttgaagagtggcctagcagattatacccagtttctccagcctaaaagctctgggtgccagctcttcacatttgcaatcttcccgtgactggtgtgtgctatcctgtgggtctcaggctgccagctatgctttaataccatggctcctcttccctcactcctggtagctccatctagtcttttcttatgtgagtgtgtgcttttgttttattacactgcttgtcttagacacgtggtcagaatcataactcttaatattctttctacatacttcttgcctgcctttccaaaataactatatttttatgagaaggaagagtctgtgctgtgttcttccctacctgagccctcctatagtttctggtgcagagctggagtcatgtaggccatcctgagcaaggttcgagtttgaaggtgacataggtgtgtactagaagacacgtaaaagatttagagtcatgctttgtagtagtcagatttatttaattttgacttactcaaaatatgttacaatacaggaacaaaacctgaatgaactgaccgtcagcatcagcatggtccatgcgaaagctgtaaaactaatgggaaaagacatttgcatagttcactttcatttatatatagttcaaagccttactattctatttatggtacacacatgcttttaagaacttaaagtaaattcaaagtttagagattaccctcgtgatcatgatggcatataattacatatgatgctagtatgttcattttctttggtgtgtaacagattgtgtattcttttttcttcaacacactatgcattctatgtgttatacacacacacacacacacacacacacacgactttttgtagcaggccatgcagagaagtaagagaaaacactggctgagacagaagcagtccctatggtgtttagaaagccagtgtccttgtatcacagttctatttactcgaccataagagccaccttggatttcggcatgtggacactaatctgagataaggatataggagttagatgcatccaatcaaatgcttggatacaggtcgagagtgtcaaccaatgtattatggttaattagcttactcagtatcaagaggtttccctaaatcccatttagattccttcagagttcatttaaattttgttcttgaaatttctgatttggaggtattattattaactattactaacattacttatcaagacagtattttactatgtagcccagatgtcttggagctcactatgtagcccaggctagccttgcattcctcctgtttccctagttctaggataagagatgtttgacaaagtgaagccatttctaatttctttagtattttgatctccatggtattggctttaaagtttggataatttttctgtctagaattcagtagtatacaatcattttctactttgagacagtcaaaccaagtagacggtgtatgtcctaaatagtattttagcatgaagacaagagagaatagaatgggtaggtgcttcttgccagagatgaccgaggctaagcccactataagggaagattcataggactgcctgtttgtgactggtttacaaagggattggtagttggagaattgtaaaggatgaaggagagaaggtcctagaattgctaaagaccagatttccgaaggtaaggttttgattaggaatacagccaggtagaagtttctgagagatggggactgagcagtgaaaacaggctggtgttcaccacgagactcgaggcaggaaagggaatgtggaatcatctaaagagatgctgtgtggtgagaggtatgagccatcatctctgcagattaaaactccaagcctgaaagcttgcgtgtagaagtgtttcccaggaagaggacatggtgcacacagccaagacctggagaggtgtccaaagccctgaatcaggtactcagcagtgtccttctgtttttatcagttctaccctcccctgacctagaagagggcatgatgatgtctctttttgacccctgtgcttcatatgtgagaatctagaaaagtctgtaacttgcttagaaaacaaattgcctgtttgttccatttactgcatgcatgactaagctgtcatttttctccctctgaagagacaaaaatcataatttcctgtgatttaaatgtagtctgttctttaaaaggtaccgaaatgtgacatgcttcagcaagatgcctgcttggcttaggcactaagtcaaagtgtcagtgtaaatcactggaaattgaagacaggatcgtttgtgggaagtggcaagttactgtctgggtcccagagtggataacaaggaaggcttttctgaacggagtgaagggtggactgatcccggaatgatgtttttgcaatttggtccattgtccctgtgtgttttgcggctggcataattagtgttggaattcagaaatcttaacattctggcagtaattgaatatatttctttgtatctgtggagaaccatgcttctcagtcgactgtccttgattaagcaggtccctttgtcagatgctgtagaaagtggattttgctactgctatcctaggttcagagttgaaaataatttatagtaccaagaaatggagcaaaatgataatgaaaaatatagatgattcccaggtcacttactcttgtgtgggtttttttttttttttttttttggcactatttccagctcatggaatgcttatgcaaattatttttgttagtagcatacatttagagggtgatattgttgacatctaaaagaaaagggactggcctcttcctcagaattcctatgtctcctgctggagtctttttaagaagtcttccctattgagttattgaagaagttgtatttgtctatgttattttaacatatacttcttttctactgtagtcaacttgaaaaaagaaatgttgtttaaacagccagcatagacatatttcataaatgtacttaaaatttaaaattagtaattagtcactagctacaagtactcagatacaaaggaagctgtttctttgctttggttcactgtcaaacgatgccatgggggctggggaagtttatttattagaaaagaaagaagtagttgcttaaatgttctcagtcccacttagatgcttttcagtgctaaaaacctggaaacggaagatgaagcaaacattttacataatggtcatttccatgagcaaactttaaattagcgccagcctgcgatttcccttgcctgtctgttacgaattgggtcatttccacgttcagtaagtgcatagtggtttgatggtctgcttggctttgttttcaccttgctaaggaataacttttttagggggtggaagctttgtgtacagtagctgcctcagtaagaccatagcccactatgtgtcacaattgatactagctgccatctgttttctctagtggaatcctagagtaatttaatttctgtcttttctaaagcaacatctcttcctggaagatagtgcttttaaatatctccccctcccttgctttcctggatctcttatattttgtctatcttatctttcaaagactatttcaaaatttaccttctagggagtcttttcaagctttcctttggccaagcattcctaatccaaacatctgcaatgtgaaaaccacaggatcagaagcttatggtttgctgccatggttgcagaattgcatgcctgacccttggtgcatgaatctcagtagaaatgcagtcgcattaaaaatactgtataaggggttagagagatgactcagcaaaatgtttgctgctcttttggaagaacagggttcagttcccagcacccacatcaggtactcactgatcactcttggaaggctccaaaccttcaaggacatctgcagtcacatggtgtacagatatacacagacacagtaataagcactgttctttcaaattacttaccagcttactttagggcatacataaggtatacatgaaacataaatgacaattgtattagacttgagccccatccacaatagctgcataaaatagctgagtttatgcatatgttacaaaaccaccaagaaggtagaaggtaaagaaagtaaaaatgcaaaatgctccccttacagcatttccaaccatgagttggtagcctgtgtctgctctctcacacggttgtccatccttctcccaggtgtttccctccttcctcttagtaatgtgcttaagaaagagctccgtgcacaccctacatgctctagcaccagccttaccctccatctgtgctttacataagaagagtaaagatgaaatgaaataaatacctgaaggccagtgatctgtgaagcagtaggaatccatcttagtgacaggtggtctgaaatgcaaaggggcttgacttgatttgggccaattctggtagttgagaataattctgatgtcactcatttcaggtggtagagagctattacttttctatgaaatctggttcttttatttatttatttgtttgcttcatttttctaaaaaactatctccggtgatcttttaatgccattatatacatttttgcatactgttagagaattgttagcttgacagtggtatggagattaactgcttgataggccataattatataattacaggttataattaaaactagggttctggtgtctgttgttgtgactatagataataaaacttgctttacttttcaaagagttagagtaaaggatttttgaatgttttccctgcacacatgttaagaaacgtttgaggggatgatgggttacccagatttaaatatcacctagtgtagatatctgttgaaatcacagagttcctcctcaatattcgcaactttggtgtttctatgagaatcacttaagactaactttagagaatttaaaaagcagttagaaagtgagctaacatgaggtgaccagtgttgttacttgggatattttaatgtttggaataaatttgtagactactcatttctgtactgaaaaacacagagcgactataacaaggatgtcaaaaagaaagaaaaattcaaagaccaaaaatttgtaaaagatccaaaagctacagcgtctagatgaacaggcacaaaggtagagagaatatatttgatctgagagaatgaaaatgttatctcactaacagctgaagttaactgggaaggatcagttcatgagttggccagtcaagctaaaagctggagaataggagtgctgggcttcaatgttgttgggtaaggcgatgcctctctctaatcctttctcctcattcaattagtggatctcttagagctgaatacgacgaatgaagttttcaagcagcacaaactgaaccaaaatgatcagctcctgagtgtcccagacgtcatcaactgtctgaccaccacttacgatgggcttgagcagctgcacaaggacttggtcaatgttccactctgcgtcgatatgtgtctcaactggctgctcaacgtatacgacacgtaagtgtgtcatttatcctttaaatgatcactagtgagcgaagcacattgataataaactgggcactatcatcatcgccttgttgttgttgttgttgttgttgttgttgttgttgttgttgttgttgttgttgttcttcttcttcttcttcttcttcttcttcttcttcttcttcttcttcttcttcttcttcttcttcttcttcttcttcttcttcttcttcttcttcttcttcttcttctcctcctcctctccttctcctcctcctcctcctcctcctcctcctcctcctcctcctccttccccttccccttcccctttcccttccccttcttccccttccccttcttccccttcttccccttcttccccttcttccccttcttccccttcttccccttcttccccttcttccccttcttccccttcttccccttcttccccttcttccccttcttccccttcttccccttcttccccttcttccccttcttccccttccccttcttccccttccctttccccttctccttcttcttctttcttcctcctcgtcctcttcctcctccttctccttcttctctgtcaccctcattaatgggtgatactaaagttttaacttgggaataagtttgcacatggcaaacactttaccattgagctacatctccgaccctagtgtgatttctttaaaaagatgttttcataatcctctcgcccagtagaaagatttattctgattgtttaaaagtaactggttttccaagtccttttgctcctaaccataggataagagggaacatacaagtgttctttcgtgacttcctagtcagtgaaggctggggatgtagcatgcattctctttcaggaaacagctagggaaacctgagctgcatggtttcttttctttctctctgctccttactatcttagattattatttttcaacaggcaaacaaaagctgacattcactgtgaattaaaatgatttttagcatataagaatctctataactttgtaaggtggcggtttgagtgtaatttggacagcagtgaataaaacttggtttgtccttaaataattgccattgtggttatgtttttctaaagtggtcttgcctttataattgatgctatatgacactaacacatgtacttgaactgtttctcagtgtatagaaggagcacccttaacttccagcccagcacatcccgcatatgtgtgacccttttgattttgacaatgtatttgtgcactaatcagttatcaaaagacttgctgtgagctgacatttcagaaatgttgggaattattcattctctggtagggggttgaagtatgcaaaaatgaaagaggaaaatgaagacttgcttttctcttgaatctcaaaacttagttctcattaagtagctacatgaagatttacatttgtcagcctttgatctgaagacagagaaggtaagtggtcgtcatagacagagaatatagatgatagttcataaatgtacatgttctgaagccgattcattctgtgtaaatgatgatgataatagacatgacttatctataattttatctactcctttcattaggaaaagagatcctttatctttcagtagtaacaaatatcaatatatcttttaaaaaaataaaataaaaggatagccttgtgagtgagagtgaagctcagttaccagaaagagaagaggatttactgtaatacactgctgcctggtatcttttattatgctttttaatacaaagttgtaattcttcttggatacaatattaattttagtgtaagtagctcattaatttgctcatcactatttcaaagtctcaaaggacatcttttctacaataaattcaccgcaaatagctcgttatttccgtgttttctgtgcagtagcctgtaacatggcttcccatctcagaaagaaagctaaatgagaacgtctggggacttcatctgactctgaaatagcaagaggaggacaacttgatcaaagtttctggggaacaatctgccccccagcaggttcctactatgacaattgtagatttctaggttgctgaaaccaaacctagtatactaggttgcttaaacatcatttcctcacatctgtaaaggcctgaagactgagctcacggtgatggtggggctgactgctgtgttgttttctccagaacgtctccttggctcttcagtttctctcttctttccataaagagccataaattctttctacttgctcttttttcctacaagtgcaccaggcattctggattaaggtctccccttccatcttcatgttaactgactcttgaaagatgctgttggcatgaaaagcagtatcctaagatacaaagagttaggacttcagtgtgcaaatcgagaggaacacagttaagctcagaacatatagagaggatgctgttattctagaatgaggaggcagtgactctttgttaggacccacccagtgtgcaaaatgttgtgattcatttctgggagttaaatgttggcacaatcccatttctgactgccagatgtgaacacatagaaatgctacatagaatttttttttctactagaaaaacaatacctcgaaatatgccattgttttgtttttaatggataaaaaaaatcctgcaaaacttacttcccctcaataccaatgaaacatcaatcacccctctgggtcagatgggttcccttcggtctcactttctattgggataaatgaattaagctaagcatttgaaatttgaaatgtatataaagaaaatatctaataaaaaacaaataacaaattaattaagctaaggaaaattcagttactttgtaggcagtaatcactgatgtccagcaatgactacctgagtttctctacttcatatggcccattcgtttatctgagcaatgactgttaactctacttcaagtaatggtcctctgagtgactctgatcaactaactataattttactctacccagagtagggatcttggatattacagaaccatcagaaggctttgaacttaaaaatgatgcctgtgttcagctaattttttaaaaaagttttatgtgacagagttatagttctttaagaaaatattttaatgtagatttacttgaagcacaggtgttgggggagcgaaagagtttcttaggaaatggacagtgaattcccaagagaaaagcagaccacttgaaagagttacattgatttacctatccatccatcatccatccatccatccacccatcaattcattcattcattcattcattcattcattcattgtttgggtttctattgttgtaaaaaaacaccacaaccaaggcaagtcttataaaggcaaacatttaattggagttagcttactgtttctgaggttcagtccattattatcatggcagagtccagatagatgtggtggacgaacagagttctacatcttgatctgatggcaattaggagactgtgtctttccctgggcagagcttgagcatatatattacctaaaggccccgcctccacagtgacatacctcctccaataaggctacatctcctaatagtgccacttcccatgggccaagcctattcaaaccaccacacaacactatcataagcaggtgatgaaatcaactcacacagaggaagatagtttttggatagtcatttgagaggtttcaacccatgactggcttgcccctgactgtaggtgaggtagcacagcatggtgggaatgctggtggaccaaactgtcatcacatgacccagaaatgcaagaaagggaagacaatcctgttttcttctgggagggtttgcctctcagaggtcatctaataggttctggcttttaaagtttctcctggtcctcagggaccttttcagatgtaaactgtaaactgttaggtattttcaactccttgatttattgccatatgatgtaaccagggcagaccttctcaacgtcaacttgaaataatgagtcatgcagatagaggagatcaaagaattctaatacacatatgacttagagatgagatatgatctttccattttgccctctatttaactgattggaaaacaaacacatggagataccagagtttttctgtaaccacctgttacaaatcaatcatagttacagggctaacttgtagattttatttccttggttgcatggatagtcttatcatattgctgtagcttagccatgacgctttataaaatcaactaaacttttgagttttaacatatacccagcttcacgtcatattttcagttttgtgccctggttgctatgttacttggcaaccacttaacttttggcatctcagtatctggaaaatttagttaaaaataaacacacagcttaccatacaaaaggtgaatactaggggcaaatgagctaatatatatagaaaggggctttataaactatagcaatcaaatcgattccatttatgaattcacagcctcactctgtctttatcttgccaggttcaaaagtcttaatttcacaatcttccttctagatttaatggaaatccaaatcatttaaatcatacttcagagcaatagtctggaacacttggttcaaacattttttttctctatagagaatattagcttcatttgttataataagtcatatttctcccactatcctgagatgaatataattttgaaggcacttaacttcacagttaaactaatttcagaagtcacttacaaaaactgtcctgggaattggatacttagctattgggctagatcgctcactcatacattttattagctctcagatgcatctccaattagatatcctacttgacatcaaaatagtcaagaatggccccatgtatgcacagattaatcagccagtgagcctgtgtataaatgctcaccccaccctatgtgttggagggggtgtgtttgcacccacacctatgttctcttacgcaggcgtgtgctatgacatctcatgtatgtctgattgtaatcttctctttcttagagggaggaggacagtactagggattaactagggctggcccactccatgtaaggcaagcactctgccactgagctccaatggcaggccttaagtttgaacttcttgattaactgtgagaggctgggaactactcaaagtgctctctcaaaaacctaccaaccacagtcatcttgtatttggtttttcatttccacacattagggttgatactgtattttctatagtcaccctcttgtcttacttccctagctagtatgtgggttattgagtaagaatcaggttctctacttcttcttgaagttcatggaacaattctgggatcttagattacagtaagcctttacagctgatggtagctgattgacattttcaattgtctttctgatgatgtagctctcctgttttcccagtagacttggaagtcagctctactggtatctttctgatcccttaaaggactggtttgtttttaccaacattcttgcaccaatcccttagctacattcattcattaacctttattactttctaaaagtaaattgcctgtgttcagaggataaacactttccagctcttgaagggaataaacactatttcatatgataatttggaaaactctacaaatattaagtagaaacatgatttgaagtatggctcagtttatttgaaactggctggtatttcttgactctaggctaggttaggctagaacttgtcatttttctgcctgttgaattctcagaggttgctaccatccttagccataatctaagcatgctttctttttcttttaaagaacatttatatgtttggtgtcatgctatatatgcagacatttacttgatcatttatcacttgaaaatggaagactattacttagtatgactaacaaagcacattacagatgtttatgtatttttcaaatactgtaaatcacaacctgtattagttacttttctattgctgggataaaacactgtgtccaaggcagcttatagaaagacaggttttttatggcttatagttccaggggcatgggagaccatcagcatcatggtaaagtgccaaccatggatgcaatatggggcctggaggagcaagcagagtaagagaactcaaagtccgccttcagtaacatcccttctccagtgaggacacacctcctaaacctacccaagacagggccacaaccagggacatagctcaaaaactaacattgcttattcatacaactacactgtcttatgtgcccatatagtaagtgaacattcgcttatgtgttttaaacgttcaatatgtatgccttaaatctaagaaattttagagaataaacccaagctgaaaacggatgaagattatgaaacaagaaatatagtgagaagactttttcctgggttgtgtgttgttccactggaaagatcatgttctgttaattttatggtgcttttctgcatcccagggcttgtttaacagcttaatactttgataggcattggaataaaaatgtgtgtgtgtgtgtgtgtgtgtgtgtgtaaaatctccagttcttaagtgaaattgaaatgatgtttcactgtcttagtgtgaaagtatttcctagagctgactaattaatacattccatttttaattacaatttcatgcttcctctaatacagatatcaccccagcctatttgaaaccattcactattaaaattgcaataataatttatagactacattggcagagatcaaagtgaatgaagacagcaaactctaaagtttcataagccctgagtcttcaacatataattttctacgtatattttttttacatttgggttttaatttattagtattcttctcttgctatataatgttgcgttcatatgttgtacagcctgcttgctatctagctttgatgcgtattttgattttacatttaaaaccaacagatttcagttatagcatttctttaagtaaaatctatttggctttatgattgttgtttttatattcatttcatgtgttcttgggctgtgtcttgtgtgtaaaaggacgtcagtgtatttttctggacttgttcaaagatgttgaactgtcatgaagttgtgatgtaggtttggcagtaatggttaaaaccaagtagacaagttgaatctttaactcgaatttattatgcagtagtttactcccaagaaaatggcattcaacttgctgtgtaaatgcatataacccatcttataatttcaggggccggactggaaaaattcgggtacagagtctgaagattggattgatgtctctctccaaaggcctcttagaagagaaatacagatgtatgtaagaccttttactccatggtgcttctaataataatctaaatttattgggcgctgactttatatagtttgcggtaatgttagcttccaattggaggtgcttactatgtgtaccagtttgaacaaagatgacaatgtgaagagaatttggatgatttgaaaaactgattgtggggcaagagtgaggtgtacagatacagcacaaactaagcacaaatgtacattcatttaatattagaatattctagtaggtattacaactcccattcttttaggtgagcaaattaatgctgaaataggtcaagaatctagtcaaaggccgtatgacccattaaaatgttggtgttgagctaaggactccataacccccttttttttctctcttaaaaatctcatttcttccgtttattgtagcaagtagtttttgctaccccactttaagctccaggtggaccacactaccagccccacccagactcccttgcatccatggattaaaaacaacacacatactctccagtgagtcttagagtgcttttgctaactcagtgaccgcaactgaaaactcacatcactggttggcttaatctcctgctgctactgcctccttcttcttccccagattctccctgaatcctcctgggtaactcttaagtatcccaccccatcctcagtcattgattggtccctggtatctttattgagcaatcaagaaccacctgggaacaggaccttagcattagactccctacagtttatggttaatgataattagaaaaaaaaaagaaaagaaagaagaaagaaagaaagagagagagagagagagagagagagagagaaagaaaggaaggaaggaagaaagagagagagagagagagaaaagtaagagggactaaaacttttattagcctttattctaaatagtattattttgtaatttggacattataaagtgatagatgctttcaacttttatttcggttattcaagtaagtgcctcattagctattgattactgaacaatgtcttggcatgctcaagagtgggacctgtagttatatctttcccacttagtgatcaagtgtcattagatgggtgtcttgatcccttttagtacgtctagccaaaagtaatattaccactatttcctggtacactgagctgtacaccagagggtgagagatgagaccaacaattgtaccattgggaggaaatcaaggtaatagattacaaattgtcaaaaatagcagtggtcaagtaaatgattaccatctccatgtgtctccaaactcattgccatggtgacagcatgtcgtttagttttatttgttcataaaatataagtagcttgatgctgccaagcctacttctagatgagtctgtgcaaataaatctgtgtatttggaggagagtgtggataataatttttgaatagaaagatatcagaagacaaaaatgggtacaagaaaggagtagtagtatgagggtctattaatagctcagtggtccatctcatgctacgcaatgtccttgctcctatccccaaaatcaagaaaaaaattttccccaagtaaaggtatgtgatcattgttcttataacctaagtcaattgagtttcttctaaaagcattcaacatcgtgtattttggggataactgttattgtttgatttaaatgtcaagcctagaatccaaaggcatgattttcttacaaatgttaacaagaatgttcaagaaagagctgtgggttttgtacagagcatgagcttactgaagaaccaggagttgaggatgctgaagtgtgtctgagccttgcaagccatgtagagagacgggaagaagccctgaataaataaaccttacataaagttttgtctatggtcctttgtctagaacttcaggaatcttcaccattatcaggaaaagatatttccaaagcggagaacttgccatttctaaactgattaggaaaggaaagaattactgaaaaatcagtgttccaaaattaggaaaagattttcttactaatcatctgtgattcggggtttttcatacgctcccaaaagacttggggctttaaaagtaacagttacatcatagtgctgaatggactctaaaatgaatgcaaattcaagctcaagatttgcattttctgcaaaacagcattaagtgctcacatttgggcaagaaagcagaggcccttgcattgcaagtttctactagtctatataactcatgatggatgtcacttcaggacataattaaataagaaatctcttgggctaaatctttaatctaaatctttacttaaatattgaggccctggaaatgtcctgaggttcagttttgtttcttatcttgagatcttgagcaactccgattccacctttgatttccccagtgttgtgggaacatctcttcattattattttctttgttaaaattaatattcaaaacaaactgctcgttagcctcagtaacaggaggcatccatctgaaaagcattttgcagtggctgatattagagtctttgtcctacttgtgcctattacttgtgacttactgagaatgactttggagtggtttctgacattccatgggccgtcctgcaaatggccaggggcttgctggcatcagcagaagcacactcaggaagcatcttttggagagccccttggatctcctctggtttgttttttttttttttttttttttttttcaagcttgtctcttagttgtttctttccattttttttgttaattatttatatttcaaatgctagattgctcttcccaattccccctcctcgagctgtccatctcatccttcctccccccatgcttctatgagagtgctcccccacccatccactcctgcctcaccaccctagcattcccctacactggggcatctagcctccacaggaccaagggcctctcctcccattgatactagaaaaggaactcctctgttacatgtgtgactggagccatgggtccctccatgtgtactctttggttggtggtttagtccctgggagctctgggggaaggaggtctggttggttgatattgttgttcttcctatggggttgcaatccctttccgttctttcagaccttcccctaactcctccattggggtccctgtgctcagtctgatggttggctgtgagccaacctcctctgtattggtcaggttctggcagatcctctcaattaaaaacttgttgtgacccattcttcacatcctctgcataccacctcttgtatacgcttctaagaataagaacgcagtgcttggtgtcactttttctccatgcacaatacactttttctttatgagtagtctcaccttcgcagtggcatagaagcttagctttcagcctagatgtgggaacgttgggcagaactgatgctcttaaaaatgtgcacctctctataaggatcatttcacatgcacatagatgcacaataagcatcatggtaagaattcggggccaatgttttgggggagatgatagcctttttcaaataatataacaagtggagctctataaacaaatctaaatgaacaaatgataacaataattaattttatctcagatgaatttccttccccttcttgtgcttatataattaaaactgtatttcatgataattactgtgtcgatatcactcaggatgcttcagtttggaacttcactgttgacactgttagataaggggagaatgacgttttatctgctgtttatgttttggatattatttgaaaatggtttgggggaacatcttaaatatttaatatttaatgcttcttcttagcattacatgacgaacatttaaatagtatgttttttggactgttacaattcaacaatgcctcccaaatgtgtcagtttttatgataaaaggaatattttttaatgaggtgtgtctccatgcagaaaaagtaatgtcctttcctacattagcttcttcattgggaatcttatattaattattttttttcaactttttgttagatattttctttatttacatttcaaatgctatcccaaaagtcccctattaccccactaccaccctgctctcctacccacccactcccacttcttggccctggcattcccctattctggggcatataaagtttgtaagaccaaggggcctctcttcccaatgatggccgactaggccatcttcttatacatatgcagctagagacatgagctctgggggtactggttagttcaaattgttgttccacctaaatgcagacccctttagctccttgggtactttctctagctcctccattagggaccctgtgatccatccaatagatgactgtgagcatctacttctgtattttccaggcactggcatagcctcacatgagacagctatatcagggtcctttcagcaaaatcttgctggcatgtgcaatagtgtctgtgtttggagactgattatgggatggatccccaggtgggttagtctctggatggtccatcctttcgtcttagctccaaactttgtctctgtaactccttccatgggtattttgttccctattctaaggaggcatgaagtatccaggtacatttacacaatggagtactactcagctattaaaaataatgaatttatgaaattcttgggcaaatggatgtatctggaggatatcatccttagtgaggtaacccaatcacaaaagaagtcacttgatatgcactcactgataagtggatattagcccagaaacttagaatacccaagatacaatttgcaaaccacaagaaaatcaagaagaatgaagaccaacgtgagaatcttctattaattataatcctcaaaatgttacccatagtagatcaaagataaatatcctgggaagaggagttttaatgttgttgacttaagaatattagaaaacaaagcactgtttgccttgtttatgcatggaaaagccaaagaaaggcaaagatacaaacatttttatgtcttaaaattgaaagaaaaaaatgtttcattacagaaaataacttattaagttcctaaaatgaaaagctaaacctccttatttatttttggtatttataatacaaaggaggtatgaatataaacatacctaaaataagatgaaatgttcgtgcataggatattgaatttgtgagtgaacaaagaagttaataaatcaattgtaaaatgtgaagctatcctttatatactatatgctctagcaaattataagggaacctttgttttgcctcatgctttttctagggaatgccttagactataaaattaaccaatgtacatttctttatagtatttaaaacagtaattttctattagctgaccagatttaatgtaataatctataacataagattattcttttatttttaaagattcctttatgttaataagattattcttttattatttatttttatttatatgagtacactgaagctatcttcagacacacaccagaagagtgcactggatcctgctactgatagttgtgagccaccatgtgggttctgggaattgaactcaggacctctggaagagcagtcagtgctcttaaccattgagccatctcttcagccccatataagatcattctaggacatgtggttctgtttacagatggcagattaagacacctgatctggataatatccctccttggttttgttttttttgtttgtttgtttttttttgttttgttttgttttgttttgttagtttttgtggggtttttttttttttttttttggttttgtttggtttttggttttaagttgacatagtttaatctacctcaccgaagataacgctttaagtaagataatgttttgagtaggtagatggtaacatctcgttcttcttctttgtaggtctctttaaggaggtggcagggccaacagagatgtgtgaccagcggcagcttggcctgctacttcacgatgccatccagatccctaggcagctgggggaagtagcagcctttgggggcagtaacattgagcccagtgtccgcagctgcttccagcaggtaggcatgggcattatgggtatgtatggtgtgttgagaaagggacttaatgtttccaagaagggagtcagttgtgctagcatcaaacagtggaggtttcaggtatcagccctctaagctgatgatttctttcttaagttacatttgactcaaggcatagtaaaaccttggtagatatacatctttttcagggactatacattgaagtgcagtgttggaattgcaacatgctggctctgtactcatgtctgtgacctgtccccttgtgctcagcttctcgtaatactcacttcactccttgattcctgcttccatgccctcggacatgcactcttctgtttagaatgttcttcctttgtgtgcacacactctcttctcccactcgttctgttctgtctttatgtgctggcttagctcttgtgtctgctcaagccctatcaggtgaagatcctctgccctgtcatgctcactacagtgtgacatcatactgagatatgtaattaattggtttgtattgcttcttccttgtccacctaagcttcctggagacaaagctatgccttcacacgtctctccagtcttagtctgctcaagctgctatagcagaatctatgaactggtgggttatgaacaactgatgtttattccttagttggagaggctgagagcctgaagattaaggttccagcaggtttgacatgtgctgaagaaagctttctgacagcgttttcttggcctgcccaatgcacttcagaagaacaatctgatggttgctcatcccttcataatacgttgaacctcatattgactttgatacgttttcttattgaaggaataaaaatgctttagtgttctctgtggagaatatcctttaaaatatgaaagcattacaaaaacagccatcttttctcaaatgcacatacacacaaagtcatgtacaaatttttgcactgatctgagctgctaattttcacctgggcaaaagccacagtttcttttttaaatgcttacggtgcagaagaacatttataaatgctactgatgtcatccatatgcataaagttagaagcctacagatatttttccaaagcagagccaatgatttatcactgttgagcgaaagaaatgctcacacggtatctttgaggagaatcaatgtcacgggttattacattttataatggccctttttcttattttagaaataaaaaaatgctaaatgattttttttctaaatatgatttatagtcatatgtgtcagtgctcagaatgacctcaacccctgcgggaagaggcagttggcggaatttacctctgctctcacccacaatcattcagcattaggattcaaggaagacttgagttgcctcacaaagtctgtcttgatgagcttagagaacctatctggtggatccgggctggtctgcctccagtgtgatgctctgatagaacagaggcggggcgtagcaatgactccttttgggaaacatttgtaaagctcgtgtagagtcttccactttgtctggaaggtgaggagtcctcgtctcgtacgtttaccatcttagataaacttgtgctacagaattaaaggctgggttacctggaatcgtgtgggttttcattttgcttcctttttctttctttttgatttgagcacagagggactaggtagacggcccagttaaagggagtttccgtagaagcctgaggacttgggatttatctccatgacccgcttaagtcacgtgtagtagcgcatggcctgtccttgtaatcccagcatcaatgtagcagagacaggcagatccttgggctcaatcaatgaaaggctgtccacgggcctcctcatgtatgtgacctgcatgcaagtgtacctgcatagatgaacatttaaaaacccacaaataaaaaagaaaatctgagcactaaggaattgccccccccaaccatatggcaatggctgcttccctaccccttcctgcattcttctaattttagcttctagaattttcttaccttaaagaacctattgtcttggctggcctggagtcacttgacttttctctcgtgccaatttgcagcagcagcacttgctgcagcttcaatgaagagctgttcttcactttctgtctcttcccccagaataacaacaagccagaaatcagtgtgaaggagtttatagactggatgcatttggaaccccagtccatggtgtggttgccggttctgcatcgggtcgcagctgctgagactgcaaaacatcaggccaaatgcaacatctgcaaagaatgcccgattgttgggttcaggtgagaagcactaagagaaatcagaactcaatggtctctgctctcctcatatggccatcccttcccatttattcctgcttggtggtttgtctttggagtacatttatgctccacagcgtccttctttccaatgtaccattcctcctcatgatctatacacaaacttattttgattcttgtagttatttgtaatactttagtccagaatcagaaagttttataaatatcctttcactgaggccataggaatacctgcgcaggataattgcattgtagattaggtacatatagtcttgatcaaatttgttggctgttctaagttgtttgggatcaaagttagtaagacaaaagcaatatgtaaaatatgagcaagaagttatcagaaaactgtttcgtgtgctaagtttgttgtgatcaattctacatttcacctgctcattaattctgttgattgtctattctctctctctctccatctcctacctttttcttaatgagcatgtatgtatatactcctggatatgtgtacatgtgcatggagaccagagattgaggtcaagtatctttatctttctcaatgactctccagcttattcttcatccagagctctctctgaatcttgagtttgacgtcagctaggctgagtggcatgccctgggcatcgtcctgtctctgcttccccagtattcagatcatctcgggttgctggtgcatgccactagactcagcatctttatgccaactctgaagaatctgaactcagatcttcatagttggctaagccagtcctgccacactcagtccatctttttttctcatcgtgtcaaggacactgacttaaagccttagaggagactgtgtaggactcttaccttggtcttcacaggatggtgtgtttgttcacgttggttccttcattacctcttgaaaaagtatgccacattcttttcctggggtttatgatttctcagaaatagttattacatagctattagtatatgctttaaacattattgctgatcacattattagttatggtcagccaaaaatgataatacactgaccttatgagtaatattgaacttttctgtaaaagtggagacatgaggaatgtacgtgtgtaagatttatttttatttatgcgtctgtatgtgtatgcgcatgtatgtgcctgtgtgtgcacccatagaagagggtgttggttccctcggagctagagtttcagatggttgctagcctctgtatgggttctgggaatcaaatctgcatcacctggaagtacagtgaatgttcttaattgctgagccacctctccagtccttcaaattgagctttagtgaaatcttagatctctaaggtgtttaccgagctgagaattgtttcatttcaaattccacacagctggtcacagtagcatgaataacaggcaggcctcatctcctttcatgtgaacaaaatgctaagagatatgccaaggctggggctgcatgctcatcttgactctcggttttgcctgccttcataatctctgttatccccaacccatgacttgaattttcacgctgatctccactggcaaattggctcctctggatgtcatttctgccttttgaagagagggaaaagccatgcccttcttcccattcaattggtcccttaaaatcccaagggaaagccttgcccaagacttcaccctgtattgtcctgcttaccaccatcagcaagcaagactgagaaacagcagttttagcaaagcacatggctaaaacatagtgacagtgcaagagtttctccctggtgaagaaaagggaagggttgcactaaagaagatttcacaaaggacagacaatgccagccatatttgtcaacctatgagaaaaggttaaaagatataagtgatctatcaagccaggagcataacaaagctggtataaatagattgtcttcagataacttgcatttttgcatgtcattttaaaagtccttcatcacttgatagtgtatattaacctcacataacctttacagtgtctttctagtttgactttgctagtcttggcatttaaaatgtccctctacagatacagctgtaatgtatgtttctatctatacagctgtaatgtatgtttctatctatacagctgtaatgtatgtttctatctatacagctgtaatgtatgtttcttagttcccccagttgtcttaactgagtgggctatttggggagcattttcctttcagactccatagaagtttaagacttaagagtgttgtttctgcaaatagacatcagtgcacagggttactttctacgagaggcttaaaacattatttctttcaagactgtgtaatgatcaaggtttctctctctctcttcctaataacgattttaaacaaaacctaaaaatgctcaaggtagaaacgagtgttcttatgaaggaatcttatattcatttcttatgagtggtcttgttgatattttaaaataatgtgtgatgctcactgtcataacttttctctatcatttcctctccacactcagatctcatgcagactcttctgacattgattctagacttcacatcatgggtaaacatgtgcaagcatgttttcagactcttagatgcatttacacatgtttatcatctttcatggtatgcctgcatctaattctcagtaataaagaaaaaaattaattaaaaagtttacaaaacctaacttaggaacaaggcttctaccttccttcataatctgagatcctttttaacaaatacttaaattcctctccccttgttagagagataaacttcttttttttcccccctagagcaagaacaagcagaagtcttattaagacagacaagacacaaaatgtacataaatctaaaatctaatgtaatgtgactaaattataaacgcatataccttcctctaactccaactttatagaagcaaaagtcttacacttaataaaaatatacagaatgtataaaagcttactccagattggtttctttctgaatagggtcttttcatatggaaacctcacattatgtcatttatccttggtagtctacatgtgattacagccatcgcttttaaattgacactgagaaacatcatcttgcatttgtagcagatgcgctcttggtttcctaagtgcaaagcttgttgctaaggcacagggttgggttcagtggcaggagtgatgcctgttcttttctccaccacagatacaggagcctaaagcattttaattatgatgtctgccagagttgcttcttttctggaagaacagcaaagggccacaagttacattacccgatggtagaatactgcataccggtgagtatcttttgaatctactgagcagttatatcactggtttcttaatcttatttttatttccttatttgtttggctgattggttggctggttgtttgttttggattttttgagaagggtttctctgtgtattctttgctgtcccagaactctttttatagaccaggctggccatgaactcacagatctacctgcctctggctgccaagtgctgggattaaaggcatgtgccactacctcctggctagtaatgacacttttatctaatacatttttacttaactattttttaaaccttcaaaaatttatggttgtaaattttgttgttttctttccttttaaatataagtgtttcttatgttgaattaagaaaaattctacattataccaaatgtaatttgttaacttaccaaatatgtgttttcattttaaacttaacttttttggaagcatattaagaactcatactgatttagctatgatgaaaatgaaaccacttgctgaaaacaaccatgtttctcttaaatttttaaaggatgttttttgaaaaaaagagttataggtgatcaaaaatgaaaaatagagaaattaaaaattcatccatacatttagtttctgaacaaactaccttctaatatttaagcatgttctaattttataaaacatatgtatagttttacttgattttttttttaaagacattgtatgtcactcatgtagcatgggatggcctggtgctcactatgtgtattaggctggtcttggacttactgaggtccatctatgtctgctttctgagtgccaggattgaagacatgcactaccatgcttgctaataaaagaattttcttcaatctggagtttgtctgcccccccacccccacccccatttttccttagacaatagcttcctggaacaaagtattaagtgaatgaattgctatagctggcctaaccatcttttagatttaagtctttagtttcctataaacagcatttaagagcattactgagaaggtaacattttatatgtgttatataaattacatttcctttgggcaaatgaccagaagtaggtgagctaggtcaatgactatgagtagctctgtggccaaaatacttaatgtcaagttgttttccaaaagaggtccctgccaccatatcatacagtcacatttgctaatgtgttcattttgccatagccccctcacactggacacagttatggttcctttcatctaaagttgctttgtcctaagattatcctcattttctgtcaatagccattccttagttttgttccagattgtggcaaaatttatttatagagttgtatattttctttggtttagagaattaagtaactttttagcccataaatctatacaaaggcagcagtacttgtaaaatatgcacatataattctcctattcttgctgtcttattttaagtcaatagagattctttcatgtggagaggaaatttctagaaaatgttgctgaattataatggatgaaataatcttgatgcccaacattaactaggaaaatattgctcccaatgaagctggggaaatatctattacagttattaatttatttactaacccagttaatattgaattcttactgtatgtcttacatgattatcaaagctagctgctagttgaagtggtaggacagtttattcagtagaatccacatgtatgtgtgaggagtatgtctgtacacatagtggagtgctcagaagtatttgagcatgtgagaaggggatactggcttggcagtgagaaggacagggacagagctaagcagaagacaaaagaaaagtgacaaaagtgtgatgctggagaccagctgtgtctccagttagagaagttaggataaatctccataaaaactggaaggcattgccttcttacctaataatctcctttcagagaaatggctttcgaggtcctcaaggacaaggctcctgagttctaagcgatcatctgcccatttcaggaccacaccaaggtttccgactcctcattcctttttgataagtcctcttggagtggtcagggctcatttcagtgtgacattacacagacaggaaatgttttgagcagcatagtttctacaaggtatctacttgttctatgctgttatgtgcagctggaggtcataagaagtatgcagccttgagctatcagaaatcaaggtgatgcctgttcaagtcttttaaaagaggatgggatggggtggatggaacaataactgagaatgtgttatttttgtaggtcagaaattcgacagaatagaaggctatgaaccttagttagatccaagagagaatctgtctttagagtcaactctaatggtttgtcggttgtctaggaaagacaagattactgatgtccccactgctgtctatataggaagaggaaatatgtgatactgagcaaggcaacagagaaatgagatgactacgggtctagtggctgtatttgaaaagcaggatgaggagatgggagaaaccatcttagataagagcaatcaggtccagtttgagaagctaacatttggattgaatatgaaggtggagagattcagcaaccatgtacagaatggggtagagtaacaaggcattgagacggaagaagcagcagtctcagaaagaactctgatagcaggcaagaggctgacaagaagatatagaacagaagtggaacctgtccttcaaacaagacacagggcaggctgaagtgcctagagaaaaatgaaaaggtagggtcccctgttcaaaagatactatgaatttccaagtgacaataaaggatcattaaactgagctggggatgttctgagcatggtagctctgcgactagctaggccttctgtctaatgacaaagacagtgggagaacaaagggcctgatgaaatagtgtcaggttgtacaatgctcttcagatccttataatagatttggattgggaagcagtataatgttaatatttacatgataatagctagacatttagggagctgattataaagatctggtattaaatgggaaaatcaagataagtggataagggtagaggaatgacgtagaattactgtttttattctcactaaatacaataattttaaataaattcttaacatttctaagcaagttgaaagcaaggcatgtttaatgatcattgatcaacggaagcctgtttgcaaccagtaacacatgtatgaagtttcctttcctactactaatgttgaatttaaaaagaaaacaaagctccaagtcagcagttttcaacctgtagatcacgacccctcaggtcgaatgatcctttaataggaatgccaagaccatcagaaaacacagatatttgtattaccattaatagctaacaaaattatagttatgaagtagcaatgaaaataatgttaaccacaacaagagaaaccttattaaagggttgtaccattagaaaggttgagaaccaccgctttaagccttcccaaaatctttcttctgtgtggttatttccaagtggctttcatttctgaggttccatcttgctttttaatttcctggatggtatcatcctttcggtgcgggaggggatcatttcacctttcctgatcttatgtggcaatcctatctgggttagtttctacatttaacctacaacttctagtccatttttatctgatttgtgttgggaatcagccccagacgtacatgcatgctaggcaaacaactcaccacagagcatgctagacaatcaatctactacagagcttaacttataacctttcctaacttctggagatatgtctgtaaactgagtcttagaggcatagtcttgctttaaatggtatgatgtgacttaattacgttccagtgtttttcacctaaatcctttagaccttttccattctactctcttcgttataaacaagctgtatgtatggcccattcatctttaccttgacatctaccttaaaaaatgggcttaaacagtgctcaggtttgtttttctttttttcagtgaagtgatatttgtgcattaaatggttgtggcctttccataagcaccatgttatttgcagttctcccaacctgtcttcatttcaggttaagaaaatggcccattcatatcactggcttctctctttctcctccaaggtcacatcttacccttctttcaatgtgtttattgttaaaaagtatactttgtcagccttataatgaggctccagactccccaaatattccaccaacctatcagcttattgcctatgactgtgtttgtgtttagatgtagggaaactaatgaggtctaaattagctctcatgattcatgaaggtattttattatactactaataaaatattcacatgaggaaatggagtggaatttttgtttttacgaaactgcctttaactcttactacccattactattctataatccaaatgtgtacctttataattccttcagttcaacaaaagtttatgttcaagtgatagcgtgacttggattctagttagtgtgtgtcccctttctctctctattcatttgcatcttacctttcccccaaaataactcgactgattcttgtagaggaatctttagaggttcctctaggctttagacctctagtaaggacagtgcatcattatagaagcatgcagtaaacaaactacttacatcattagccagagagcagagaagagaagcagagacagtatcccacaatccccttaaagatcaccataccagtgacttgaccatccaataggcttcaccttccaaaagcttctgccaagttccataaggacacactggagattgcctttgatatatggaccttcaaggaacgctcagtatccaaagttagccctataagctgctgtaataatacagataggtgatgtgtaatgaacagactcttacttggctgtttctaaaagtgaggaagtctaagttggaagggacctcatggggccagaaatctcttgcatcattacatggtagaaaatagaagggcaagacagctcctgtgtgaaagagaggggaaggatctgaacacattctctatcgggaatcttcactgctaaaaagtagctcttgtgatcaaatccatccttaatggtatctatgatgtaattcactcttaaggattctacttttaaacactgttgccttcagataaaattcccagcacatctaaaaaataaaatcatttgtctctgtaatgaaaattcagtctcctttaaataattgctgctgtaaataaccaaaatttaatttgaattagaaaaatcattcatgtaattagagaatttgaaagttctttttttaaaaaaagttattttactatttcatccatacaacatttttgttagactgggttttgattttggtattggcattactggggaccaatctcacggtctcacacgtgctaggaaaccacttttcttctgagctccatcccagatcttttaaaaggcatttttattttgagatagggtttcaaaattgcatagcttgaccttgaacttgctgtctgccaacctcagccttctgagaatctagaactacagggctgccctaccagacccaacatacactcttaactatagctacagtgctatctatggagactcaggaactcactcttgttacaactgacagtttggatggctttctatttttgaacctctctccagatttgagaatcaccattctaccctctccactctcagcttaactcctcacttatttacattctttgtataaatgagaccatgcaatatttttctttgtatatctgaatcatttcactcaggtccatctgtgttgtcaaaaatgggaagaattccttcttttataaggctgaatataaattataagcccttccccatgttctctctctctctctctctctctctctctctctctctctctctctctctgtgtgtgtgtgtgtgtgtgtgtgtgtgtgtgtgtgtgttgattttcctaatccatgtattgtggaatatttaactagtacctctttgagaccatgttgtcattgtccttgggtgtgtgtctagaagtagaatttctagatcaccttgtattgatcctttaacttctttaaaggacttcagaccattttccatggtggctgaatcagtaatagtatatctttagatttcaggctggtggtatacacatagtttataagagtgtgtgcaatttctaactatgagcgagcgctaaatagggttacagtctaaggagagtgggaaaggcttataatctctgctagggtcaggctgaatcaccaagagaaaagtcaggtgctatcttgacacaagcgcacagctgaggcaatcaccaaagagttgttagctctggctctccagcgcttaggagctgtagacttagacaatgataattttagttaaaggccaaagcagtaagaaatccccaagtagttatggtattgtgattgtcatgggctttcctcgtgctgaagaaaccctattgcagatgaaagggctagagatgaaagtactggggtgacaaagacttgtatccaccacccccaaggcctcccccaaaaggagagggagacttcaaagagtccagttaacagttttttccctagttattttttatagactgaaaaatgttttgagttttagcaaggcttaaggtgtagttacatcccaacatttaactaaaattgaatgtagagggtttcagaagtaagaggacatttaagaaaatgacaagttatagctgtgtgatattgtatctttagaaaggcttcaatagtacattggctacagatggtgaggctgaggggaataatgtaagggaaggaaaagaaatatctcttcttcctatttttaagatcagagctgaagagagattatcaaatgcacacaagttcatttagtgccaagtttccctgacctctgaggcttccatgaggaaatgcagacccaggaaaatgggaagcctatttagttcagtgctaaggatttcataaagaatagacagagaattctaagtgaacaaagatgttcttatatagggtatagcttatgatcctagagaaataaaaagcctgcatgtgaagactctgctccatgtcctgtatcttcaaaacccatcaagacatttgctgctgccataacagaacacttgaaaacgagatgtttacaaactacagctggttcgttgtcacatagttttggagtctgagaaatctaagattaaattctgcctctggtcataacaattgtgttaggttattgcatgctgaaggacactcaagataacacaaaagagatggaggggaaaagagaaagagctacacacatccttttcatcaggcactcttctgccatatccttaatccactgatgatatcagaacccatattacccaatcatgtcataacatcctatccacaatttgtgggacactttcaacactcagcaacaagatggtgattcctacctctccaagagaggcctcatgagtttctttggtggagaagatcagagagtgaccatcctggttctgctggttttttttttcaaatgccttgtttgaggcaacatgtactgagctccatggaatagaaaccccattttctgttgtcatcagcactgggattcatttatggaaaaagatatgaacatgttataggggaatctttggaagcaagtagagggtacaacagtgaagcaggaaaagtagacagaggctgtgtgcatgtgctgagagacagtggcccccgctaagttaggggaaaggaaaaacccagaggctgtggtattgctacatacagagttcagaatatgaagggttggctagggtgtttgagagatgtgttttctagagatgagatttacaaaaacttgttacctagaagggcagaagtattggctatgtccagattctcactgttggtcttgagtcacagtaaatcttgatcagttgagggtcattggacagagctagattgtactggtggttactctgggatccactaagaagaactgggatggggctggggagtgagtacctctgtgaagacactaaattactgtcacttaaaacagattggtagtgtaatttttaagcaagtacatggctgtatcttcattacttagaaaatactttgtttaatcaaaactgtgtagctaaaaaccgtatgtatttaatacaatgtgttacttctcacaaacagaaacaacaacaaacactcatacctagctgtgaagtgctgtgtggtataaacccaacacaggaaactgagacaaatctttttacagaagtgacagcacggctaaggtttcccgatacctacagtttgtttatgtgaaaagtccaatagtagcagtgtatttcagaatcccatcaatagcttcatcaggttctgcagtcaacttagcaaaagtatggagacttccagggtactatagttaaaaaaaaaaaagttatttttagaacagctcttagcatatttgttatgcaaaatatagtgtggaagacaagaggtatgggcaggtaaaaaggatttactgagaacagaagcagagacgatgtactgatatattgtgcaggggctgcagataagttcttgcagagtgtagaacagctggggacagcacatatttgatcttatctcctgggctagtttacagcatacgttgtcttccttggggctgggcttttgggtagaggacgtggtgatctcttaagattgggctccaaatatttacctcgttgaaatcacattccaagtcatcatagcccagttgttaaagtataggaaatatcctattgctcttggcctttggctatataatattcttaatgctctgaatttgtaggtggataattatctgtggttttaggatccaatagaatcaaaatattatattaaaaaacattttttaattaagttaaatgtgcctttttgaattgtattggcaaaaagtgagaaaaaaatcaaataaaagagaaaaaagggaccaactggcaccagtggctttgtctcctcccttttgccagcatccttgtgttctgaaggctgtgagtatcaactggaagaaagtgctgactctgtcctggtgccgtcggcacggtttgtgttggcaggcctgcttcttcagatgtgcattgggatattggccaatatgctaaaactgcagcctcgttgccatttctctgacttcagcatcccgaagtggtgattttcggctcttatctccctgatgttggttccccagcaagtctggtacatttagatgagccattagctcttaagaggaggctgcaacaagctctgctttacatcggtggcttattaccatccttgttcacggtgattctgtcaatgttacttaatttttagctttctgggccctccctcattaagattcagaaggctttgagtttctcttactgattccaccaagctgtagaatccagacatgtcttaattttactttgttgaaatcagtgaaaacccagggttagttttgccattaaaaaagaaaaaaatcctggagtgtcttcaagtcttaggataatgaaatgcacatttagaagtgtgcatgtgtccctcagctctgtcctcagtaaacctgctagtgagtgtgcttccttcgatttaataattgcagcgtttgtgcgtggttcacatggcagcattttcttattcaccccatgtatcacatgactacgcatctttatattaccttgatttacatcatcacacttctgtatctccctatgtacaacttattaatatttgaatttaatagttgaaaatctaatgctggacatgtttgttatggacatcgatgttactgtcacttgagttatgactgagaaaattactgggaggtagaaaaaaaaacaaacatggttgtagttttgcttattttcagttctttttgttattcagcttaaattaatctggaattagcagttgggttttgtccttggacttttttggcatcattgtgagcagactctttctccatggtgccttgtggctctctggcattaggagctgttggttcttcagctgaagtagaggagtaatttattcaacaagtcaattgccaataaattacatggaggtccgtatttctgaatcctagactcttctgcgccttggccttgcattttcatttgtcacattaaatgagaaggaagtaactgtcagtcatccatcaatgcatttcaagtgtaagattgtgcagggagtcaacagttaagctaaggatgtgcagtttaaaacatggaccaggaacatggggattcatggacatgcattaatatagagatattcaattgaagccaaagataatctcaaagtctacatcacctgaagtagactatttttactctcaattaaggagtaattagagaggactttaaaatattcttgataggggctagagtgaagatttagtggttaagagcactggctggttttatagaggacttaagtttgattctcagctccaaagtggcttttaactgtaacttcaattctaggggatatcataccctcttctgccctatacaagtagtttatatgtatggcacacagacatacatgcaagcaaaacatactatcaaatatatataaagattatatatattttttatttttattttaatacgcgcacacacacacacactgcaggcttttattattgttattgtcattggtaaaatagggcctggaaatgcagttacttggtttcaataccttaggagttttgtagaggcttacatgattaggttggatctgtggtagcctttataattgggtaatgcctttcaatattgtattcattcattcgtgatgatggaaagccagtggagaactagctgttctcattacctaaataagctttgatcctgtcgttgctgcttcacttcaggggaatggggtgtttcttgaggatccccacacccagtattttcacagtgccgcactatcactagctttgaaagaaaaagagaaggaaaggagggcagctctctgttgtgagttcttacaggctgtgagctatcagtctagagggactttgagggagatggtggctctgtggtttcaagctatctcattctctttgtgtttgctgtttcctcttctttgttagctacctaaaaagtaacagagcagttagttagcaaaatctagaaatccacagagccaatatctgcaataaaatccaggtccaagaaagtctccaaacaaaactgatgacaggccaccatcagccacaggacctactggattatcaccatgtcagggaaagagaaggaagcaaaagtgcttgggaactgtagatcctctagagacatcacatggtttgtagaaaacaggactgctgcttttgagcagaagtctaccattgaggtgcttctcctgtccaacttccatgtgatagttttgtttcatctttccatattttattttgttatattttaatattatcttttagaagtctcttctttcctagtaagagacaaaaggggagtgaatctggataggaggggtggagggaagggacttggaaaagtagagggaggggaaactgtattcaggatatagtatgagagaaaagaatctattttcaataaagtgagaaaaaaaccgtacctaatgttccaagaaatgcatctggcatttaacaggttgactcattgtgcagtaatttccagtaagttcctttccattccatgcttcccgccgtaacagcaacagctgtctgcttttaaacaacaaaacactacacctaatgtgcagcgggagttgagtttgatggcaatgatggcttccattatcctaggtggtgggtttctctttgccaaggcattgcattagcactataaaatagagaggtgctagcaaatgccgttaggtggctaattagacgaagtctacaacaatgttttaccatttcagtgcaaaatattaagcttaaatcatttccttggctctattccaactgcagaattacattctcttataccaaaggtcatctcccatggctatgagaagagtcacttttcatatcttctttggtgttgcgataaagtttatagagccagtgaaatagcagccttagattacaactttggatggcaaacagttatattccctgaacacaaaaattactgaagaaattaaaacatgctgtttctatgtggctgtctcctttataatacacatgcactgttagaagcaatctaactccactgtatgccttaactctgggggaaatgatcaggggtctgttgggtttttggtgatgggggaagaatagagaaatagtgcttctttattgcttgattagattggccctggttttctaggtcctggatatagttgaagaagagtgtgtaatgtgcgattggacatttgagtggtacctttgagtggtttctctctttttattcaaatatgattctacataggtacccagaatagataagccagaacagcatagaaaccacagaagacatactatatgaagatctgtctatgaaacacccagaataagcaatctcatagagacagaagctatattaatacctggcagggcctgggcatgggtagtagtcatagagtatctttgaagagtgatagagtcattgtatatgtaagtagacagggttgtggttgtttaagtagaagtggactcataaccagtgagttgtatactgtacactactggggagttggcagcgaagcttggaacctggtcatgtggctttctttcattcatctcagggctacaaattcaagtcctctggactcagcgatgaatgcctaaccatagccaaacttagttacaggccgagttgaagctagagcacattcttcatttggtatttctttgtatgttaactgcctatgctaagagcaggcacaggagcagtggaatcacaaatccctatccagaaataaacagtttcagtttgtaaacaagtctctatgatgctgggtcacttgccattaaataaaaggcagaaagtgggaccagttggcacagtgcattcacatacgcatcattccgtttgtgttatatagataacttctctgtctccttataaagagggcaatgaatccactctgcgctaagtgtggaagcaaactacctgagtagtagttcagcattctgctaataatctgaatatgtaactggatcgccaggactagagtttctgtctgtgttgaatatgaacactagaattgttgatagtataaaattaggcttagaaaacagttgatggaatcagataagagagttggctttgaggattctaagcatatctcacatgtaaatggttatagatttatcatcttgccaggtatggtgacacatgaccttagtcccagcactcaagaagcagaggccagccttgtctacagagcatgctgtagcactttcagggctatgtaaagacaccctggctcaacgaagcagagaaacaaacaacaaactaaaacaccaatcattttgaaatccttaaggaaattgcaacatcatacatcatattacattttaatctgggtataacaatagtttttctgcttggttgataaagacttgagaaacttagactgttttcctaacagaatcctgaggtggccctttgcttcctctcctctcccctcccctcccctcccctcccctcccctcccctcccctcccctcccctcccctcccctcccctcccctcccctcccctcccctcccccctcttgtgcttttttttttccttcttcagaaagtgtctcatgtagctcaggctagcctggtatgcctattcctcttgcttgtatctcccaagtcctggggtttatgggcctgcacaccatgcctggttagaagggtttgttcatttgactgctttgttttcttcctcagctcttttgagatttacttagggcctcaccaagtagccgaggctggccttgagctacatataaatcctttgtctctttcttgtatgtgctgagattatgggcatgcaccttccatgtccccttccactgccctttctttattattgattaaaatttctcccaactagaatgcgtggtagcttgtgggcagcataggctaagcactgacctcagtttttaaacccaattcaaagtatgtcctctggaatgtcatcactactcttgtagatggaaatcagtttactcacaggaatcttccagtaagctttccaaaactgtaattttgggatcaagttttaaaatatagaataaagaagctatttagtggtttacttttaacacgttttattaaattatggcataactgaatgtgtctttcatagagtctcaattaccctttattttcctgatactgggcttttcaaaggtatataaaggtatttttggcatttaatgaccgtcaccttacttctgctcagcttttgttgtagatattgttgtagcctttttaaccagaactgtgaatttttcaacctatagacaacatctggggaagatgtgagagatttcactaaggtgctgaagaacaagttcaggtccaagaaatattttgccaaacatcctcggcttggctacctgcctgtccagaccgtgctggaaggggacaacttagaaacgtgagttctgttctagcattcagtttgtgcgtgcttgcacctcattgtctttaatactagtgctaacaacatgaaacaaattgcatcttttcaaagagatttgtgtcctgatgaaatattttattttgaaacaagttgctcttcaacagttaatttgtattatctggggatttttgtttgttgtttccgaatgtgtattattatttcttcctcctcctcttctttctcctcttcctcctcctccttctcctcctcttcctcctcctccttctcctcctcttcctcctcctccttctccttcttcttttcttctctctctctctctctctctctctctctctctgtatttagaaatatttgcccaatcaatgtggtattatttgctccttcattttttcatttatttcccttcctttcttccctttcataggtttcaatctttttgttataatacctttcattattttgtttcgtgttgtggtactggtctgaaccctgagccttatacttactagagaaggactctacttttgagttatatcctcagctccacattatatctttttaaattaaattatcaaaaatatttcatcttacacttcaaatgcaactcttctctgaaccctcgttttatgtttcattgtcatctccttaaagataaagttggcaaaaatgaagtatctttatgcatctatgaagcagacaaaattgcttacaagtctgcaatttgagttaacaagcatcttctaagaaattaggagggagaaaaaaaattacaatgggatcataaagctaagaaagaaaacaaaagactctagagcttgaaatgagatgaagaaagatgttaaaatgagccagaagacatacatacatggacattttaaatcaccaggcagtcttctattgagatcaaagtagatgtgattttaactcatcgaatccctttttaaagcatgtacttcagcgtttcaactgcaatgctttttgtatgctggagtgtgtaagcaaagcacccatgtgactatatgaggggtgattgattaaggaagacacccagcattcacctctggcctccatgtgtaggtatatacatgcatacacacacccaaaaaagtatgtacactacccacaacaatacattttttttctcattgcttccataccacataagacaaatttaacatttgttttattttaaacaaagctatttaaatacatttagaaaatgcatgtcttttgtgaatatgcttttgtctttaaagagtgtatattaattattcttgttgttgtatccgatacaagtttgacttcctgaagacctgataaagtctttcttctgctctgatcacatcgacttaacctttgacatagctcattgtggcatatagtgttgtaggttgactatcacatcgtgctgggatctaagagggaagagagtagacttgtattgagcaatgttgccttgcactattttcataaatcatcgccatttttcatcccaaatatctccacccttcacatgagccatagatagatggatatttcctgctcctttcttttaaattttaatgttttgcctttacatgtcaaaatgatcatgacatttgatttgtgggcacacacttgagttcatctgtgtatgtggagcctagagattgacatcagttgtcatcttcaattgctgacaacttattgattgagacagggtcactcactgagtctggagcttgctttctgagcaaggctggctagccagcaagtccccagcatcctccagtttctgcctctgtactgggatcctaggtgaccagattccatgtgggtcagggggttgaattcatgtgttttgtgcttgcagtgaacacattttactgactgagccatcttcaggatccacttagagacttttttttccaagtaaaaatgaacagaaaaccatgcaaaataattacattctctgcttttgatatactacgctgaaaatgcctcaccctgattaacataaatttcccaccattttccaagagagatacaagaaggagaaaggaaggggcatctgattaaattggatgccaccaaatcccttttgaacaagatttatgagctactagatagtgtgggtgggtgttcttcaaatcctatgcagagctctgtggatttgctgtagttcatttttctgctgaaccctcttctgctccaaggtcacttaatcattccagtggaacaatttatgtgagtgggtagggttttgtttttttgtttttttttaaagaaaaaaatgtttgatttcatttattctcctacttgtgggaggagagaacattggagaaaaaccattgaagtggtgaaagtgttgaagttatttatggagctgggtaaagcttcctttgacttctttcatctttgccaatgtggtactttaatttctgaccagtgattagccatgcaggcatgcatgcagggactctatgaggagaaatgcttattactaaatgggggtaaacatgtccatgctaaggcttattcagttaatttaataggtctctatgcaagaattttcaaaatgagaaaaatttattcataatgaagttgaaaaaaagagctaaaataaaatggtggcaggaataatttgagagttctgagagattattagtgactttagaattagtttagtttccctagagattaagaaacaacaagaaacaccgacttctggtattgggtaatatatccatagtgaatataatatataatatatagtgactgagtcactctttgaagaatccctacagagcaggcgcagttgtggagagggatgttcaaggctggaagggacggataacgatgctgagacctgcctgaatcatctgctgaggactcaggatggccagaggtgaaggaaaagactcactggccaaatgaatcattttcaaaagcctggattaaagttctaacacgaaactaatatcaaaaacaaatgagagaggcagagccagatgataaaggaccttgttatctatgctcacatctccagggtttaacttgagaatagtgagagagttcacaggtaacaattacgagaaaagagtggtggatggttcaggaaagatgttgatatgaaattacccttcagaaaatgaactttagtaggagcaagggggcttcactaacacaggaaccatggtcatggcagagcattttgagcaacaatatatcatatcagaggtatcttgatgggcctgaaaggtaggagagaattatagaagcattgcgaaagtttgcctggggctagggagattccctagtagttaccagcctgatctgctcttccagagtttaattcccagtgactatgttgggtagctacaaccacttgtaactctagctcctggacatccagtggcctctcctggtttccgaaggcacccaccccacatttggcatgttcagacatagggtagatacagtggcatatacacagacaaatacaaatataagtcttgaaaagaaagttactttaagttgaatgtgtagaagaggtagtgttagccattgtagacagtgttataggtagtgttagctatagacagtgttataggtagtgttagctatagacagtgttataggtagtgttagctatagacagtgttgtaggtagtgtaagctatagacagtgttgtaggtagtgttagctatagacagtgttgtaggtagtgtaagctatagacagtgttgtaggtagtgttagctatagactgttgtaggtagtgttagctatagacaatgttgtaggtagtgtaagctataaacagtgttgtaggtaatgttagctatagacagtgttataggtagtgttagttatagacaacatggtaaaggtggaaagtacacaatctagagagacagagaagttggggagcttggctataacaccacatgacgcagataggaaagtatatttgtttacattttcacattatattttatggcatgcgaaccagccagaattacagggtcttgttaatttgctgtcctcagtggacagactgactatagggagtggagagggagggggtaagactagtctggttttcaagcaccaggctatgatctaacaggtagaaacagttaacagctttggagcaaatgggttaaagaatcaaaaacacggaaatatgaggagactgctggcaatttgcgtcattagatgtctatgttggaattcatagacttacatttatattagagtctgattcttctcatagcatatgaaattagtcaaaccccccgctgagctgctacactgaaaacaggaagcagctccattttgaagtcagtggtagctcacagattgatgctgcctttattttattatttacttctctgcatttgggtgctggcagtagcagtcagagactcatctatgccaaacaagcagcctggcaagtgagctcaacccttcttactgtaggtcccagggatgaagcgcggcgctgctgttctttcttcctactgagtgtgagcttgtatcacaacttctccctgtgagccaaagtcctctgaaggcaaagaaacctaaagtttgattttgtatctgtttcctttatttgatattgtccgtgaaaaatgttcttctttcagtccagctttctgcctgttccattcttagttcacaaatttttgtgccaacaattaacttcctaagaatcgctaaagccaatccacaaagctttgccagggtttcttaagataagtgcatatatatatatatatatatatatatacactcacaattttttttctgttgaaagcttatattgaatgttgtcctaggcttgaattttagagataatttcttaagcagttgctgttttaggaagagtgacacagggtgcagagctgtctgtctcttgccatttgcaaggtttcagggataatgagaagtagtgatatactaaagacgaggaatgatactgtgtctccactgtcccggcttctcctttacatggacacagttaactctatttacagaatacatattttggcagacatagaggatgaatgcccacttttgaaagcagatctaaagaactttagctttctacccaataagatgacctccatctctttaatgtctgtagtgcacatatcatcttgtgcttcacacagcaggagataataagatcatagttatgtctccagtccacatatgtaatagaaaaggaaatctgaaaggattttgcttgatcagcaatagctttttcaagagactttacataattagagtactaattttccttgtgcttttaaaattctacattcatcaggtaattcgtcaccaccttctctcaaaagttaagagtttgaactactgtttaattgggatgagttgtttcaatggcatttcatggagatttgaggctctcaggggatctgaaaatctagggcggcccctgcactgcctcagacccaagcccctgattcaagcagagctggttggcccatgttgtttcctagagcgaacttctagttaatagcatcatagtggatggaagtctgtcctgtcctggcgaggtcaccctcagtgtgctgatgctctgactctgaggagggcataggtaggaaggaaaacttttcttttccatgtgtttctgaaattgagaaatgtggtgtacacataatttaaacttttatatttctgaatgaagagccataaacccctcttacttcaattctgatgtcaatagtctagtaattaggtaataaattcacctttctaattcaatgtcttttccaaggaaaaaaaaaaaaaagaactgtgtctcccttagaatattctggaacatcatcttccaacagcctataatgtgggacgatcttagcacatttggctgatcttttcactctcactgttctaaaacatgatgcccatcttgacacatggatgctgcaggtgtgggaaagttgctttcagtttccctggcggtgaggtgatgatcaaggaagccaaatgagagtggaagacgaatctgcctccgtctgcttttgtctgaaatcgctctaaatgtttgttctgtgacttttgtctccctgtcccctctctgcagtcctatcacgctcatcagtatgtggccagagcactatgagtgagtattcacagccccctgtgcacaggcggggagttctaatcaggaatattagcatgggtctaaactactacttttacatcctgggtgacagtgctggtggtttgtttgcatggcagattcgttacttaactaaccttctaactggtaacatctgtcaatattgagaataaatcctttgcctttttatttcccccttttcagcccctcccagtcccctcagctgtttcatgatgacacccactcaagaatagagcaatacgctacacggtaagagactgataaccatcccccactctgcttttgtagtagttcagtgctgctgacaaaccttgtggtaggagtgtatttgcagaagtcatggttctattccatgtggatcctggccttttatctattcatgatgtaatttgtactttaccaaacacctgctatatattctgtgaagagtagattacaatagactgccattacagagctgctgagactccaaacatcaagcagtcaggataaagagaatataacctaattccaatgaataaaggtagcatttggaactgcccttgggagactgcgcacatatgaattgcaatatgtaattaaacttatgctaatatttgattattagggtttgtttttaagtccctaagcagagcaaactatagatctgcatgcagtgtgcaaaactttcaggaaagtgtgtaaaatcaaccattggtcatactagaaggcagctgtctccaaagtccttagtttaaaagctatttttaaaaaatagtcggccaggcggtggtggcgcacgcctttattcccagcactttggaggcagaggcaggtggatttctaagttcgaggccaggtctacagagtgagttccaggacagccagggctacacagagaaaccctgtctcgaaaaaaacaaattaaaaaaaaatggtcacatttgtgctgaattaagactaagtcagattttttggagctgttggataacatgctacagaagaatgtagcttctttattgaactacagaagggagaggagtggagagtctgtggggttaacaaagaccatagtctgataacacagagcccggttgatcaggagttggttcacattctaggtcaagagaagtcatggtgaatcttcagacctgagaggaacaaaattaggtttgtgtgaaaggttgctctgtttcagtggagaccagctagagggcctgagggctcaatgagaagacctcacactgtggtataccgcctacaggcccaaagtgaatggcaatcaaatttcagctcaccagtacagatggttttaattccaccactgagtgagatctggactattttctgttaggtcataatatagatttaaaagccagcaagggtgcttctggaggactgttccagttgcagccgtgtaatgtcatcttctcgtttttgtgtttccagactggcccagatggaaaggacaaacgggtccttcctaactgatagcagctctacaacaggaagcgtgtaagtgcatcgtgcattgagtctgcccaagaggccaactgaaatagttggggttgtgaaagagtatctcagagattggggccaaggaaggccacagacaccacaccatgcaacagacctcatagaaaagatttactggggaagtgaggagatgtagaaggctgcctccgaggagggatggaacaacagagagatgggccaggtcatgatggtgggctttagaggggatatggagcacatacactgggagggtatgtgatggtggaaacgtgtcctattggtgatgactgggccatggaaggcaggaaggaacctggttctggaatgtgggaggttcttggctgactaaccttgcctccttgtattatggtctcaggattaatcttcatagatcatggcatctgagttgttatcccaatccaaactgatgtgtgtttcatattagtctatgcacattttaacttttaaagccatgttagtgtaaatgaagcatgtttatttacttaggaatcaacttatctgctttagaataatcagattgctgcataattatataatattgatatgtatttttgtggatatttatatgttttatgtttgtatttatgtgggtatgtacacatatatacgtaggttcatatggttgcacatgtatgtggaggacagggataaatattagatatctttatcaattttctcctatttatttatttgagacaaagtttctcaatgaaaatggatctcatttatttggccaccctataagctctgtctctctccaccccccacccccacccctatccaattccctcaactagagatgtgtgctaccacaccccacttgtacatcagagctgggatctggactcaggtcctcattggctccctggctagtgttttaccaacctagccgtctctcgcacccatagtattgatagttttacaaatttattgatagttttacaaatgcacatccaggatcaacacacttttgtaacttcctctctcctgtgcgttctaacattttcttcatagtctctgctgttaacagtgccctccacacatgcttggacagactcattctgccattcactgaaaaataactcccttacaaatattttattttatcaggaagtggggaaagcttcattgacttataatatcttttagaaatagcttcggagctagatattttatatctcatttccttatttgtacatcttaagcttggctgtggaatgctcttggcaaacgcttcctctctgatgttaatgttgtaatagatcttttctctttgggacttgttttgaccttgtttttttatgagatgatgtgtaaaaaggcttgtatagtttcaagttgatgtgacttgtaggctcactatggttttgaccagtcagggagcccaggagaacctgagaagctctagaatatagtgtgcacatgttctcactcacaaagacggaagaaagccaagtagaataatacctcaagccagtggttctcacctttcctaatgctgtgatcctttagacacttcctcgtgttgtggtgaagtagcattcattgctacttcataaatgtaattttgctactgattggatcatagtgcaaatatttgctatgtgacccttgtgaaagagtcactggactcccaaaggggttgtgaccctcaggttgataatcattgctaagaacactgataaagaatgactcccttaagtctgtttcatatttcatttatcattaagcttataagtagaagctcttgggaacttttttctattttaaatatcaaaagtttggcatcttaggcatcataagtcatggctgaggcattattattcaggtgttatgaaccagaaaccacttcagctcaagataataaaatatttgccctgctctttcatatataacctaacagtaagtgtttcatataaagtaattaagttgcttaaatatctcttaaatcaggctagtcctcacctcaccagtgttaaaagcagcagggaatttaatgaactgaaaaataatagttatgataaaaatctaacttcttcagaacatttgtgttcctttctatgtgggcagaacataggaaatacaatgtgcactgtcctttagttttctcgcgaatgtgtcagaacggagaagttatccagatgattagcagctcaacagatttaacacagagacctttggtgtggtgattcattcaacagatattcattttattcctagacggtagtgaagtgatggagccacttgtgagaggcagctgttacactcaggacgtatgtggcctgtttggcagagccctattccagtctgtgtattctctcatgtatgtgcattgataagtaaattaagtttagttttaggagagagtgctcagaacccaccagccctgtttttgttcttattgtgttttgttgctgttattttattgtttgtttgtttttattttcctccctcttttatagacagggttttactatgtgccacatgctggcctcagatttccaatcttccgtctcaccctgtaaagtgttctggtgacaagcatgtgcttccagctccttttacctcattgtactctcgctgcccctgggtgatgtttagtcggggggtgggggggtatgcagctgtgtatcttccgcatcttctgcacacactattgaagggtgagcttgctcaccatgggagacctccaaccacagagctagcaaagatcattcaccaatatttggttttgggttgttttttgtttatttgggttttgtgccttcagctatagccaacatacctgtagttggaggtggctttcatccttcaagtaggatcatggaaacaattccctgtcccctctccaagtactcccctccatgaaccttcactgtgtattgagcattcatgtatcatatataccagtttcccaaaattgacccctacataatccagtcccaagtactcccctatttctctgaaagccagactccagatgatctgttggggcattagttttaaggcttctcagtatcttcgtaggaagttattcaaatacatcttcaggaggggcaagactcagagagacccttagacagcagtccctgaggccgttaaccagcttctcactccatccactttctgcctttgggtgatgctgttttatgtggactgaagttggggcttggtcatggtctacctcaacattaccatttgtaaatctgaaagctggaatagagcattggttttaaagttcatcaagggaatcacagctctttcatcatgtgacaggtactaattttgtaatgtagatagtatttactatatgtatcacatacagtataattatattgcatctaatgatacctcttgatacaggctacatttaaaaaaactttctatttcagcatgatgcacactattgatgtttaatagccctaatctggtgcatgatgtatcatctgcataatgagggtgctcttggtttttattatacacaattaaacactagaacagatctatttttgtatttaacctttaaggctaataatctatgaaaatatttaaggccaagattttatgctacatgtaaattattctatttttcattttacagaaatgaccttaattctcttccagacaccataacaaacaatgtagttagtggccatgataattattacaacgccctgtacatcaagttcacaaaggaggcgaatttacattaatactgacaacaaaatgcttcccaaatagagaagttcaagtggtttcccagtgcccagattaaaaaaaaaaaatttctcagttgtgtgtgcatatgcatacttgcatgtgtacagagaccagaagacaacttacaggaggctaatcttttcttccaccgtgtagcttgcagatgttggaacctaggacatgagcaagtactcttaccacttgggccatcttgccagcccaacatttgaaaccaaaagtgtggtttatgttattacgaagcacctagtccccaggcccaagtgtctacacaaatgttcttagggaataaatgatctctgctatctcccaatcgcaggggctctagtccaaatctgtggccagtcctagccataagataattcaggctattttgggggtacatgatttttattcagaagattcttatgatttatcctttttaaggtattgactttgagttttttagggatagtatccacaggcattatataactaatttgacttgccttttatttatttcaataactaaatctgcgtcaatctgatgcgaatgactgaggtaggattccacacatcacccccttgtcattgaatcttaggtatctgggacaggaggggcccaagcttttctttcctttgtaaatgactgctcattttgctttgatttttagtggattactcatggtgttttatccttaaaacatagaacatttactgacataacacattttccgctttcttggatatcccattgtttagttgcttgcttaggtgtgtttcagcctgaaagggaatatttgcagtatgttctgctgtgctctcattttgcagttgctttagtgtgtgtgccctccatccttacaccttgcccatctgttctgtcctcgatgcatcttggactcacatcttttcctactgccttattttccacttgatctcagagtggaaccaccacccatgatacacagtctctaactcgtgtctcaggctatggatttattcatcacagggcgtcagggcttcatctctgcttctgcctcttcaagtacttatgtctaggctactgatcatgaacttgtgtgtgtgtgtgtgtgtgtgtgtgtgtgtgtgtgcatgtgagtttcatacacatgaaggtcagagggcaacttatggaagttagttctctccttccaccttgtggctccgggagagcaaactccagtgatctggcttggggcaaccactttcacttgtagagtcattttccttgccagagctctgtttcattcttctgtgtgggtagctgtcttagggtttcgtcactgtgacgagacaccatgcccatggcaacttttatacaggaacacatttaattggggctgccttacaggttcagaggttcagttcattatcatcatagcaggaagcatggcaacatccaggcagacaggattataaagaagatgttgagaattctgtatcttgatccaaaggctaccaggagagaactctctcctatactgggcagagcttgagtgctaggagcccttaaagtccccacacacagtggcatcagcactcctaatagtgtgcttcccatgagccaaacatatccaagccactagagtagcctagaagttttagctgctgtgcaggggtcgtatatcaactttcctgctcttctcatcctttgaaccctcaggacatcatgcgacttcttttgttccctctagagatcttgcatttactatgaaaggtgagatgacgtcatggccaattctatcttttgtgtcatctacctgctgtatttttattttccaccatcattgtaaacaaccttcaaaagaccctctttaaaaaggccacatttgtcaggagggagggaagttaagttaggctttaagcttagccaaagtacatgagttttatttttgatatacagtcacactctctcatatgtgtgtgtgtctgtgtgtgtgtgtctgtgtctgtgtgtttgtgtgtgtctgtgaaggaaggaaagtgagagtgctcaatgcaggaaggaggcccattaagtcaccaagaatttctccctctccctctccctctccctctccctctccctctccctctccctctccctctccctctccctctccctctccctctccctctccctctccctctccctctccctctccctctccctctccctctctctctgatctctttgcctgaaacacatttttttctaagaacacactaaatcatagatgcaatttcagacccctgactatcagaacaaaagtgtgatatgccaaggatggattttctatcacacataagaatcagagtgcttgcccagtatccagtactgcacaagagcaaaggggttttaaggtccaggtggaacaataaagttcccagactgccaggctctccttggctgttttagcacagagtctgatccagggctacagcgaaagatgctgagagaaccgtacagctgcacagcttatactgaaggctcagccataggacagctccattttcaactctggtgaacacatcagttatgtcttattttcctgatgccttatcctttatttcccctcttgacaaaaactatcaaaccaggccatgtccagtatgctagagggctctgaaatctcctgagccaggagatggatgtgacagtcataccttcctgaggacatccaactagatctgcctcacaaaggaagaacagagattccagcccagctggaaagctttttcattaccacagacatatttggccttgtctcccttcactcttctgctgctgacagtcatgcatcaacactactgtcgatgtgtctagttcagtaacagatcattggatgaagaacttcaatgaattaaatgtaattaatgatttaatgcaggatattgatcctaaaaattagttatgatgacaccaagtaaaatagctactgctattttataaatatgtacaattgtgtttatgctgttatttaaatagaaatacgttgtaaatcctttgggttatcaaacataggaaaactggttatagccaaatcaaaagatcagtcattcttggtgctgtgatcttttagtccactgttttggtagtcagtgggcaatatgcttgcctatatcatctttaacttttatgttaactgcttctaggtatgtccaacccattgatatttgtaacatgttcttatctaaaaatgtggtggactacatttcaagctctcctgagctgcatgcggcttatggtcataggttgggtgcaccccattaagcctgatttatagcaacttattactcttatttataggcatggatgtgcctttttttttttttttctgttgagtggaatggctctctggggattgtgagaataacaaattgtggcatgagagttttgatatgttgagctcatcctacacaagcactgtagcatgaactccagcatccagctcgagtttcaaaggatggccatggagacacagagttccgaagcagcctggtccagccaccggtccaggcgtcacaggttttatttcttgtgtgctctgagatctcagcacccagatgtgagctgatgggcatcttccttgtctctagggaggatgagcatgccctcatccagcagtactgccagaccctgggcggggagtcacctgtgagtcagccgcagagtccagctcagatcctgaagtccgtggagagggaagagcgtggggaactggagcggatcattgctgacttggaggaagagcaaaggtgagctagacccgggagaagaaaatacactactcgctccccttcccttccttctgtcttttcagagatgttatctaagacatcacaatgaggtccaagtttgagaggacattagcaggctgggatgtgggtagggcctcgtgcatctgtgatttaatgatggatcctggaaaaactcttgcttgaagcccattttctccctcctagctcttcgtgctaataaatgtttttctatgagatgaagagtatcaaactaaatttggagttcccaggcagtttgggggagataattatctgataataattctggttaattttatatttttccctttccatattagaaatctgcaggtggagtatgagcagctgaaggagcagcacctaagaaggggtctccctgtgggctcccctccagactccatcgtatctcctcaccacacatctgaggactcagaacttatagcagaagctaaactcctgcggcagcacaaagggcggctggaggcgaggatgcaaattttggaagatcacaataaacagctggagtctcagctgcaccgcctcagacagctcctggagcaggtaggggtgtggattcctgtgcagcacctccacaggacccacccacccacccacccacctcactgaagcctggacccgtcaattcatgagcaacacagttaattctgtgtatgagtggaatctccactgatacaaaattgtctgttttcctatctgactcatagaaattctttcttcttttgtactaaaatatcaccttagaacagtttgactttaaaaaaaaaccagaatcctgtggtagccacgagcctgactttcatcaggaaagattccacagagaatagggacagcaggtgacctacaatcttcaatctaacactttcttccagagaactaggactaagaaggtacctcagaaatcactgtctgtaaaacaacgacgacaacagcaaaaggaagcagaggaacaggtggctgctagtttgccactgtcatttcttacacgggggatgctctgctatagcagtgacttggaaactttcttgacaacaagcagtacaattttcattttgaggaaaacgtatgtttctgatgagtatgaaatgatgcacacctttaacagagatggatgcacacctttaacagagatggcgtctcttaccctcctccccttccccggccccttcctccctccctccctccctccctccctctctccctccttgttttctcttgctttcctttttataatattgggaccgtttttaatactggcacctttcttttatgattaaatactggctaataactgacagttttgagaaactaccatcctttggtttgtggcttctgcctttctgcttctgcccctctgtgagggggaagaaacaacgtggcaaggagccacaggcagagagttaatagtttgactaacttaactagaagagggcagtcagctcgcagagctaacagggagaacacctttgctgcagacagatataatgttgatttccccacataatatttcctgactggcaccagcagtcctagcacggttgcctttttctccagcctgtgtggggtggcgtcctgtgacatcctaacagagatgccctttcccacatgtgctgtactgcattaaagaaaaccatttctccggggatttgcttacgtttacgaaagctgtcttggcttagttgccaccagggtctttttatcttgtcaggaatcttgaaagcattataatttttgcattaccaacatagtggacagttgatccctttccctcctttggccacttgcttttctctctctctctctctgtcatcatagagtttctttgatataactgtgtgaatcatttacttaaaagactgaaaattctccatctttggaaaataatggcttgctaagtgagtcaaaacttggctttctgttaagacctcagactgtttgcttgatcctatcctcagtgtcacatatattggcaggggcgggtgttgcttgtagagtgaatttgaagttcccacgtagtaccttagtacagcataagtttccttgtgtgatctcttagagcggcagttctgagcctgtgggtcacaacctctttggaggcattggatggctcttctgcaggggttgtatgtaagatatcctgcatatcagatactcgcactatgagtgataatggtagcaaaatcgcagttatgaagtagcaacggagatagttttaaggttgaggttaccatgacacgaggaactgtagtaaatggtcacagcactaggaaggttgcgaatcatcaactgttgatgtccacagtttagcgtccacttggaaccatcacacaagctctgctcgaagcccttgcgtgctgtatacctttttgatgctcttgggaggaaagaaaaggttcctggactcattcttccaacctcccccctgccatcccattagaccaaggacctagtggctcataggccttcacaattacacagtaatgtttttggaactagctgatgtctaagtggctcagaatatccaaggctgtggagctcttatctcttcataacgatttagtgtgcgtgccagaagtagatggaaattttaactcaatataaacagggaaaactaccagacatcaactaatagggatttaatggaaaatctacatcaaagaggaatttctacattctcatattatagatcctgctttctattttgaccacgtacttatcagcatgcccttcggtagcacaaagatatgcacgggagttatcatggagggttcgccctgtgtcggactgggcaaatggctttggaaagactcatttatcactttcctggcaaaattctatgccgcggctatggcccataaagctttatttagcatctcttcctccgggttcttcatccacactaaggtgttaatgctaaaacagtttgtacacagcatctaacacaaaagtttctgtagtttgcctagaattgtactgattcttagtgctccaagttggactttgaattcaagctgctgaatccaaaatccagggggataaaagcactctctctctatatcgcctctgaggggagctattgaaagttagtacatttgccattttcaaagtacaatggcactttctgaaagatgaacccaaattacttctaagtttactacattggtgtaaaaataatgtaaaatttgggagatgaaaatggcagacataaagaaattctgtggtgtaagaagaagttcttcaaagcacaaacatggagcaagcatttgggtctcaggagaagtgttcgggccataacctaggctgaaattgcccaaggaccatggcaggggctggaggtgggggaggaatactgtcctttctaggttgcaggcatctttcttactctaacatcccatgtgattgcagcctgactctgactcccgcatcaatggtgtctccccctgggcttccccacagcattctgcattgagctactcacttgacactgacccaggcccacagttccaccaggcaggtaagtgtcactgaagcacagttgaatttggactaggctggagtttttatggttttggtgtttggttgctagcattcttacgtctgtgtgctctggagcatagaacattattctctttagtctgaaatgaatgtagatccattttaataataaaaaaacactttagtcataatgtgcttgtttataaaatgtgtaggagtggattcaattttggtgaaagatgaaaaatttctcctttcatttgaaataagcaagacttttattttgctttgagaatatttgtgtgtgtgctcatgtgtacatgtatgtgtgtacacttgtgtgtgtgtgtgtgtgtgcacacatgtgcatgtagtgtatgttcatgtatgtgtgaagatgctccaagagccagaggaggacatccggtgcccggctctcatcctccacgtgattgctttgagataagttccctcactgacctgggataggatgggcaggaagcctcagcagtccttctgtctcagctccctcccccctcgttactaagggttacgggcacacatcatcacagccagctttttagttggactctggaatccaggctcggtctcatacccaacgcaggaggctctcttacctactgagccgtctcttcagccccaagactggtcgtttgcatatatgtttctctacaacttttacattcatgtacatgcagaacctaatgctgaagagtagcctgcaacgtggtcttctctaccttatccatcctagtctctgtggacattgctccacctatgctctacagcagaagtgccaccaacaccatcagtgacagtgtcacctcactgttatgctgttaaaaacactattgtagtttcaatcatagaataaaatacatatcgagataatataaagcaagacaaaatagactgtgataaaagctccaaaatggaaaagaaagaaattgctagaatattttatgtgcaaaataatggatttttcagctagcacactagcgtcaaattcactgctacttatttttcactttcatattttctcttagtatataaatttatccacataaacatatgatacatttttaactatataaaagtctactgctggagctaaggatgttgctcagtggtagaatgttccccctatgtttttataaagatctatgtatcgttcctgtatgctttgtgtgtgtgtgtgtgtgtgtgtgtgtgtgtatgtgtgtgtgtgtgtgtgtgcgcgcactgtatcgttcctgtatgctttgtgtgtgtgtgtgtgtgtgcacatgcttgcatgtatgacatgtcaaatgaatacagatgcttctgttcccccagaagttgttcttttcaatgacagttcatatcctgttcctattttggggctggttacggtattttttgcctgcaagcggttctttggtagaaggatggacattgattctaagctccctccttcctccgtgttttgtctcagcatctgaggacctgctggccccacctcacgacactagcacggacctcacggacgtgatggagcagatcaacagcacgtttccctcttgcagctgtgagtagtaacacctttatgcccccgtggtgtgcctgtcctgtccttcctccttccccacttgcaactctcttgtcttctttcggacgacagcaaagccaatgttagagacaagattgcaggctgttttgaaataacacagacatatgtgttgacagagaaagtgaagccccattcagatggcagagagattctgaggtccactgatggtatgatcccggccttggagattttcccacaggcctcaaaagcgactaaatagagtccattagcacaatgtctgcttttagaatataacttgggttaagtgcaggctataagaaacttgtgttacttcaaagaagagccttgaacggcatgccaatctaggatgaacacagcttttctaaggtaactttctacgttccttgagatatatctccacatgtcttcgtagtcaggcacagaaagcaattatttctggcctcccctctcctttaaaagaattcttttttttttcccttcagggaataaaataatcattgtgtgaaaaccagatgattcacagggtcacaaattatgagtctgaagtctccatatgaacagccaggagccaaaaaaaatcgcccaatgagagcagtccaaatcccaggggaaattacataatgattttaatcgattgaattttttaagtggtttctctcctggcatcttgccacccttgagattctgctgcactctcacctcagagacctctgtggtctctctactcaggagctgtccacagagtccatagacacagactcaccactggattgtgacagtttcaaatacttttaaggagcatgaaagggtcacttatcatttgggggtggggcctctcaaatggatgttaaaaccagtcaatcagtaaactacagttttgtggaagtctctgttttttggtttactgttttctgtcagctccctagacaaatctaagtcaggagaaagagattcatcaattgttggtgtaattgataaacatgttaaatctgttacagtaattgaagttaaaggttgaatttcatctcagaagtttttgttctggcttatgtagtacccaatggctagaaaaactatcatgttttatgaattagagtttcagaattaaagtttctaaacactaatactttttagctgaactgccacctaaatgtattcatcactaaagagcaaattctgtaagtggaattctgtttagaagtttttatttaaatttaatgttggaccttttcaatttaaaactctgttggcagtgaaatcagagtgtgagatatgcttaaatctacgctttgtaataaatataaaaatataaaatgcatagtttctataatggaaatgtgcttcaagttcaggatttttcttttacgagtctttttttctaaagcacttctaaatctttcctaaggcatattctgatatgtatatttgatttttaaaatgttcatctatgccttgcttaaaatagaatataatggaaaaactataactgtataacacctaatcttcaaaggtaactgttgctacctcatgccctgacccctgatacaaggataaaattcccattgagttgaaccactcacggtgattggttcctgagaagaggcttagtctctatggagaccacactgcagtggctaaacccttcccttgcattgagacctctttacctgtgacatcatccttggcgctcactgggttatttaaagaggcttgcagttccttaagaggaaaactgttggcattctctggcagtgtgtatatctaccagtgtttataatgttgagattttctatacatgagcactcctagtcatttgttataatgaagaatccaggcacctcttaaataagaaatggtacatagtacattttagagtcctgtgggatccacagactatgtgttcttacttctgaaaatggcattgtttgttccttttcattatttatattcatatgtttctctggcaaatataaaaatcttcaaggtaaaaaaaatgctttccaatctagaaaaaaaaaaaaagaactccattgtcttgtttacaaaattaatgcatacctcagaattttacctaggattactaaatcatttcaaattgtacagaatcaattagtgcatggtacagacctggtacctaacacagacttccagattgatgttgtcagtggtttacagggacagtcatgtttctagctagagaaatataatggttgaaaatttcccagctagcacttagaaaggttttgcaggattcattagctttaatgttccatttaaattgctcagttagcaaatattttatcgagagtctgcaactcccaagcttcctgatcacctttggaagtttatctaactaaataggattggcatgctctcattgcctaaacaatctcttgagtttctatagagaaggagaatgttcaaattgcttgtagccagtgtgtgatggatgggctgagctgcatgttaatcttgacttttgatcctttgtggattaaacaaattgcatggctacaaatgaatttcactcatggcaattttggaattaaaatgagtgtctgtattcataaatcctaatagcatgaatagctctgttagcttattttttatattgtgtcttatatgctgttgtgtgtaaagacttttaaaacccttgcattttgaatcaatattgcagttagcaatggtagcatctttgaattatgacctcttaaaatgacattgaatctcaaagcagagacacaggcatcgccatcttaccctaacaattaaagaattgaatttaatttgtgttgacagttatccagtcatgtagtagaaaattctaatgactataactgtttctttgttggcataatatagtctgcttatagtttgttcaaatatgtggaatattaatagtaaattgagctttctttctttctttctttctttctttctttctttctttctttctttctttctttttctgctagaagtaatgcttttagacttattgttaacttaccttgtgtttctgctgtgatcagcctgcatttgtcaggcttgaatggcatccatcaaaaactcaagacttaacaaaagcacaatgattacctaattttcttttaaaatacacagcttgttccaggaaccgcctataatgttttatttgattaaaagagataggaaggcaaaatggctttgacttctgtctagggtttgactattacatatccattatttaagagagaagcctaactgtctttcttttcagatggggtgtatatttacaacatgtctttactaataattcacctcagctacctccggggtatagctcacatgaggacaggggttcactcttttctctgatgggaaacaccttgtaggactaggcttatgtttccctggttcttctcccaaataccggggctcacattctcccctgctatcacagggaggaaatcaatctcaatcaatcaatctctctctctctctctctctttttctctctctctcctcacaaatgagccacagatgtcctttttcccccttatcacagaaaaatgaaggattggaagcatgtaacatgctacttgattagagacactcccctttggccaaggatagatattgtcatcattaccctttctttccctatgttgaatatgaatctgcagcgaaagtgtcaaatattggcaggcttagaggacatagccagccaatggcctgtaaagcaaaatggtgaagcagttagacttcaattactgttcacaacaacagcaacaatgggtcctgaaatgtgtctctagtattagaaggaggtagacatcctgcctggaagactataggaatcctaaactttctaggcgttgaggacaaaggcttaccccttctccctcctatgggagatagttacttgcacagcccagatttcctcaggaaagttcagagatagttttaaaagaattatttactcttattttatgttatgttcatgcaagttttgcttgcttgcttgcatgtctgtgtaacatgtgcatgtagtgccaatggaggcaagaagaaggagaagtggggaggaggaagaggaggagaagaagaagaggaggagaagaagaagaggaggagaaagaggaggaggaggaggaggaggaggagaggaggaggaggaggaggaggaggaggaggagaagaagaagaagaagaagaagaagaagaagaagaagaagaagaagaagaagaagaagaagaagaagaagaagaaaaagaagaagaagaagaagaagaagaagaagaagaagaagaagaagaagaagaagaagaagaagaagaagaagaagaagaagaagaagaagatgatcttaactgctgagatgagcatctcttcagcccttggattttttattttttctttcatagaaagcaacaattttcaacctgtgcacctctatactcttgagagtcaaatgacactttcacagggttcacatatcagatatcctgtgtgtcagatatttatattgtaattcataacagaagcaaaattacagttattaagtagcaatgagaataattttacagctggggtcaccacagcatgtggaagggtcacggcatttggaaggttgagaaccactgatagcccgcctataatgtctgtgtgaacagtggtctcttggaccattgctgctcttcagaggggctctaccctgctctgccatcagctttgtcttctagactatactcattttaatctctgaattgtttttagtgaagatcacaagaacaaggggtcatgaacatgatctcagtgaaaaatggacctgacaaagcagagatctagaaaagtcttggtagtgccagttctccgtaagcccacgacatcagcttctttgtcatgggctccgatgcaaggataatgttgaagggttattagcaccctaggctaacttctgtgctctttactgaacccatgtaaggcatcactgttgatccccgttctgaagactgctgatgaatgactagccttttcactgatgcaaatgtaccttcttcctacagctttcagcaagggtgtgccaaggtgtgcagaaaatactaattccctctaaggacccttttggtcagaatcaaactgtatattcaacacaacatataggctctcctctgtacttattatacaaaagtcaaaaaatacatggcatagttataaaatgaagttttcagattttttttctcatttataaaactaagaccttcctgaatgttttattttttttttccattttttattaggtatttagctcatttacatttccaatgctataccaaaagtcccccttacccacccacccccactcccctacccacccactccccccctttggccctggcgttcccctgtaccgggtcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttggatactttctctagctcctccattgggagccctgtgatccatccattagctgactgtgagcatccacttctgtgtttgctaggccccggcatagtctcacaagagacagctacatctgggtcctttcgataaaatcttgctagtatatgcaatggtgtcagcgtttggatgctgattatggggtggatccctggatatggcagtctctacatggtccatcctttcatctcagctccaaactttgtttctgtaactccttccatgggtgttttgttcccacttctaaggaggggcatagtgtccacacttcagtcttcatttttcttgagtttcatgtgtttaggaaattgtatcttatattgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttatagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcgaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttccttcgttagagtcacgccgagatattttatattatttgtggctattgagaagggtgttgtttccctaatttctttctcagcctgtttattctttgtgtagagaaaggccattgacttgtttgagttaattttatatccagctatttcaccgaagctgtttatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaaggatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttctttttttttttttttttttttttttttttattaggtatttagctcatttacatttccaatgctataccaaaagtcccccttacccacccacccccactcccctacccacccactccccccctttggccctggcgttcccctgtaccggggcacacgaagtctgcgtgtccaatgggcctctctttccagtgatggccgactaggccatcttttgatacatatgcagctagagtcaaaagctcaggggtactggttagttcataatgttgttccacctatagggttgaagatccctttagctccttgggtactttctctagctcctccattgggagccctgcgatccatccattagctgactgtgagcatccacttctgtgtttgctaggccccggcatagtctcacaagagacagctacatctgggtcctttcagtaaaatcttgctagtgtatgcaatggtgtcagcatttggaagctgattatggggtggatccctggatatggcagtctctacatggtccattctttcatctcagctccatactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttgcctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatcctcgccagcatctgctgtcgcctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttgagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcgaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctattctcggttttttgttattccagatgaatttgcaaattgctccttctaattccttgaagaattgagttggaattttaatggggattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttccttcgttagagtcacgccgagatattttatattatttgtggctattgagaagggtgttgtttccctaatttctttctcagcctgtttattctttgtgtagagaaaggccattgacttgtttgagttaattttatatccagctacttcaccgaagctgtttatcaggtttaggagttctctgttggaatttttagggtcacttatatatactatcatatcatctgtaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaagaatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccattttttcttgaaggcactcatagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacatgggacaatttcaatatttttgaatctgttgaggcctgatttgtgacctattatgtggtcaattttggagaaggtaccatgaggtgctgagaagaaggtatatccttttgttttagggtaaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggcgcaatgtgtgctttgagctttactaaagtttctttagtgaatgtggctgctcttgtatttggagcatagatattcagaattgagagttcctcttggaggattttacctttgatgagaatgaagtgtccctccttgtcttttttgatgactttgggttggaagtcaatcttatcagatattaggatggctactcctgcttgtttcttcataccatttgcttggaaaattgttttccagcctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaaggtggcattctgttcttgtggctgtcttcttttaggtttgttgagggattaccttcttgttttttctagggcgttgttcccgttcttgtattggtttttttctgttattatcctttgaagggctggattcgtggagagataatgggtgaatttagttttgtcgtggaatactttggtttctccatctatggtaattgagagtttggctgggtattgtagcctgggctggaatttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatatgcatctcattctttagatttgggaagttttcttcaataattttgttgaagatgtttgctggacctttgagttgaaaatcttcattctcatccactcctattatccgtacgtttggtcttcttattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttttttcctagggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggtcttggttcctgttagtaagattcctccgtttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgcgcagatatcttgtatttggacctcctcctggccgaagaagaaggcccaaaacaggacctttctcagacactgtgttgctttggcagttcccaggtggtacagactctaacctaagcagactaaattcctaagttccttggagtcccgggacgaagatggtgaccgctgctgctgtggcttaggccgcctcccctgccgggtgggcacctgtcctccggtccggaaggtggccggctgtccccggcccacacagggtgctgcctcagcgcctctgtgcttctgcctgttccagaagctgtcaggttctctggcgcaccctctcacctgttcagactaatttcctaagttcggcgggtcccggaccaagatggcgaccgctgctgctgtggcttaggccgcctccccagccgggtgggcacctgtcctctggtccggaaggtggccggctgtccccggcccacacagggtgctgcctcagcgcctctgtgcttctgcctgttccagaagctgtcaggttctctggcgcaccctctcacctgttcagactaattccctaagttcggcgggtcccggaccaagatggcgaccgctgctgctgtggcttaggtcgcctccccagccgggcgggcacctgtcctctggtccggaaggtggccggctgtccccggcccacacagggtgctgcctcagcccctctgtgcttctgcctgttccagaggctgtcaggttctctggcgcaccctctcacccgttcagactaatttcctaagttcagcgggtcccggaccaagatggcgaccgctgctgctgtggcccaggccgcctccccagccgggcgggcacctgtcctccggtccagacggtggctggctgtccccggcccacaaagggtgctgcctcagtgcctctgtgcctctgcctgttccagaggctgtcaggttctctggcgcaccctctcacctgttcagactaatttcctaagttcggcgggtcccggaccaagatccttcctgaatgttttaaaagagctagtatatgttttgtgtggggttttggttttttctttttcttctctctctctctctctctctctctctctctctctctctctctctctctctctctagaatgtttgcatttcaaatcacatagaatatgagacatttacttggaaaactagccttgcttagagggtcagggtggctggcctctgcttcctgctagcatccttggaagggcagagctattctcttcctctgaaaagcattctatacatttgcatgcatgagaagggaaggcacaaagcaatagtaaagccctcaattgatttcttctattttctttttcagcaaatgtccccagcaggccacaggtaagagttaatggttcaattgacttcgctttcttgatcccatctgggcgtaagcacattagctgctattgatttagtttagtcttacttcattctccatataaatgagtaaagccacgtgatgtttaagtgttacttggttctgtacaacagattgttgctttgaagatgttgggtgggaccatttggttccccaaaccaaactctatgaggcacccaaagtacccatgctggatttcagttctcattccatgctctctactatacaagtttctgtgtaaatctgactgacctcaaatctcacatttgtcacagaacagtgactttgaaatgtccctggtactacagggcaatactgagatcattactccaatgaagacagagttgcctttttcatttaagaaaatacgttgagctcttctggcatctttagcccagtagctttcagttttgtttggttccttatgaggagccattaattaaaatataccacggagccaaagcagatctttataaaacattttcttgagtgaatttattagtcctttcaaaacagtcaacattgtttcatcttattagcaagtggaactggggtcttggctagaagacaggtgtctgtaaagcagtctgtgacacagtaggtagggttagcatcttccggtgatgcccattgtcctggtccattggaagcaaggattttaaagggaagtgagatgacagaagaaccctcagaggtataagaagagatgggaagatgtgctcatgtgcagggaagcagacacatcccaaaacaatccatttgttaaaagtactcaagttagacatgttttttcaaaaatctacttcaaaattgtgtagcccgtatttagacccattggcattttccacatagcagacaccactagacatctgtctcctcctctctaggacatgaaggaatggggtactcttttggtagcctaacacatatatcatcgctacctttcccaagaagcaaagacctctcaatttgacctgggtttctagcctgtttaaaaaaaaaaaaaaaaaaaaaaaaaaagacgtcttgtcacccctggcctctgcttttatgttggtgttgactactgtaataaacagctggcatgtgacttcagggtgaaggaaatgtcctcatcccacatgagcagttgggggagggtcccctttgaacacagccatataaagttttagttagttctgaaagatgcccttattttcccatgaagaactgacaagtcttcattacctgaatgtccttatgcagatgctgttctgaccttggtgttttcccttgccacaggcaatgtgagcatctatccagccagccaacatttcccgaccttcagtattgccctcttctgcaaatgccaatcccaagacccattcaaccccaaagctccgtggctccacgacacaagctgttgagtgcttactgggtgttctactgagggaaccaaacactgactatccaaagagaaaaggatattttggttttctaataacgtatattattgttttcttctcccctttctatgcaactgtaaattaatgaacagagaagtatttggaggtggtaaagcatttgtcactgatttgtataatatatacagccatgggaaagtgggtgggggctttctaatatgaaactgtctttttaataaccaagagaaaaaattgcataagaattagaccactttacattattacattccttctgctgttcacattaaccttgtacaataacttcacttattatttgactgttttaccattatgttttggttatttataaatttatcagccatacaaacaaatagattctatgtatttgtttctataatctggccaaattcctaagttcatatatttgaatcaaatattttacatatgtggagtaggcaggcattctgaagatactatttaactttagttgacgtcacacacaccatcctttagtaaccactggatgactacactaaaaatcctgtggactttaacggcaagctgctggggtatttttcctcctgtttttattccttttttgtaagtagatcttgacgtctttatttatttcatcttgcaatctctataataaagaagactgtattgtaatagtctcaaaaaattattttaccaagggttaccatttaagcatattttcattttgattcagaaaccaaagttggtacaacctctcctagtacttgcaaccttggttttcatgagaaaacacacggcaggctttgcccattgtgaggagagcacacatcatgctcttcagtttcctttgaatagacttttattgttgtttttgtatttttcgagtcctgtgtaagttttgaaagctctggttgtttcctttgtgaaagcaggcagatacttattggctgtctcatttgaagctttggagcagatagtcagatgtctcatgacccctcacttggccagcagcacatccgagaaggatgtcactcacaagcctacaccacggcttctctagaatgaaatcagtgctcggatgattgtatccctgcctctacttctgagtgtgttcaactaggtattggcttctttttctttttcttttcttttttttttaatttaacacttaattgccgattttagagaaaccaaaaataaaggtgaaggtaatatgttttgattcaaacatatatgcttttaaaacatcaggacatgctaactttgggttctctttcactgggatctggccagaaggaggctgaaagttagaaattgctattcttttaggatcggttgggtgggttggggggcaagggtgtctatttgcagcatagatattttgagacgaagaaaattgttttatataaggggagagccatgatcacctttctacctcagaaccaccttcctccattgtgttggacatagctttatatgccgcagtgtgcaaaacctagggctgtagtcaggcctttccatacccaggaagcacctgtgtaaagaagatcaacagaaactcccggaactcagaaccccaagttgtagatttggtgtcgtccttgttcttgctttgaggagtcatgtattcttttatttcctgcctgtatttgtatgcaaaatgatctctatctgctattacagaaaaagctacacaaaacactacattgtaaccttctgagtaataaataagaggaaatatattacagtaaccatgatgagaaataagtgtattgttcttttgaaatatgtggttaatcgcagactgtcatctaatctgttacataccgtatttttcatcctgaataaaagtaattttaacacaaaatgactttgatgtttggctgtgttcactgatgaaatcagatctctgaatgtatgtgatgaaagctaactataagatgatctatattctgataaatctaaatattttctgaaactctctcttatacattaatctagtctccattcactcattatctctctctcctttcttgcatataaatatgattatatatttttcaatttcctgtacaaatcagagtcttattactagggaaaatggatgttataagtacattcctaaagcccattgggccttcatttttataacttggagctactgagatttatcaggttactctctcaaatccactttcatcactagactcatagttttctatgtatctatattattataactaaataaaaatatacatgaacatatatgtgtgtatgtatatatagttatatttatttatatttattttagatatatatagttagttttctgtgcagtgttgctgtaaagcagcaccataactgatctaacttataaaacaaagcatttcattcagagactgatggttctagaggagtagagcccatgtccatccggattcagcccatgcctgcagctggcagacaggcaaggcgctagcgaagtagctaagagcttataaggggtgggcaaatctaaagcagagggagacagagacagactgagagagctgaaatgacatagtcatttgatatctcaaagcccacccccagtgacactaatcctaatctgtcccaaacagttgtaccaactgagaaccaggcatgcaaacatacggcctcataggggtccttcttattcaaaccagtacagactctacattacctgttcattggtgctgttgattttattgtgtgttttatatatagtacacatatataaaatatacaggacaatatatagtaaatatatgtttatatacagtctggtatcagatttatcttgcttctgaagctcataagggcaaaatggtgtcaaaaattacaattaagtacaattaagtcagcaaccctccaagaattagaaaattccgccaaaatatattattttaaaagagaacagaaacaattagaccaatattttaaacgtctcatctaccatgaagtatcacattaataattcctaaggaaaccattagtttccagtgactttactgagtcgtcactgaaaggcctccggagtgacaaccagaacagctttgtttctgtgacattgatattctcattgtattttaaatgacatagttgcctctgatgactctttgctacttgagcagactggctcttcaaatcccttccccgtgtcaaagaaccatcaaaataccatcaccaccactgaaacccatgtgctgaatgtaaaacccaattaacttgttaactgaatggtctttctcagatgcatgtgcgcgcgtgcacgcacacacacacacacacacacacacacacacacacagtgttcaatgcctgtgatagccattattccatgatgatggtagacagcagttcagctcatgagacgtgtaggttaagctcacctgggagggacttttgtaacctcagtgagaatcttacacgtacctctgatctccagaggcttgtgttgatggtggctggtttcctctcaggtctaggctaggctgcatgttgatggatagatcatagatagtctagcatggttatagacacttggctgcattcttggcaagccaacctggtttcatgcaaaggcagctgtgtgaagggtttaggcaaagaaaatctcaaggctagggaagagtagataacatctcatggagagaagctgcaaagagctgcagtttcatggcacacaatgaatagggactttttttttttttttttttttttttttttgtcatgcaagctctggaagcagagaacttagggccagagtaccagactatctgctgccacaggcatcttctcagttcagtagaatggaagagaaaagaagtgtctccttgccaccttttcctgatttatttctataccgctctttttaagtcatgcttatggatttaaaaatcagtccttgcagtttggattattacagggcttgttttcacgtgataccttgctgaaatacagattgctggcctgtctgtctgtctgtcctttctttcttgtttgttgaaagattttcttttttatttagtgtattgtctagaaggatctggggaaagcaaaagaatatgatcaaaaggtattgttctgtatgattaaaattaaagataataataaaattagtgtgtattaagtccctccaactcaagatgtaacctcagagacagagaaacttggcacatatgtggcaaaaaaaaaaaaaaaaaacaaaaaaaacaaaaacaaaaacaaacttaagagaaatggaaggtaacaataaaattaggaacaaaaacaaaaaaatcagagattttagacttaaaaatagagtaaatgagaagtcagagtgaattacatattttagtagaagaatattgcatgggggcctccttgctttgccaggtgggcaagatgcaagtggtgagtttgtcccccagcaagccatgcatgtcatcagaggcatgaaatttgcataagcttccaaactggcactaactctcacctcagaatccttggcactgtgactgggtggtggtggcacactcctttaaccccagcactcacaaggcagaaccaggcagatctcttgagttcaaggccaaggccagcctggtctatacaacaagttccaagacagccagggctatacagaaacctatcttgaaaaaaaccaaaccaaaccacaaagcactatttgcacttgattccaggttatcttttgcaggcagcttatttcctggtccctttttgaactttgtagataggaaaatttggaaaaattatctgacagcctgccctgtaccgacctctgttccagaagtcccagaagtcacaaatttcttatttcttattctgtttgtcaatgttcttcaagaaacatattccaagtatggaaagagagagagacagatgtagaaaaacactttgaaagatgacttcatgcaccaggcgtggtggcacacgcctttaatcccagaaattgggaggcagaggcaggcgaatttctgagttcaaggccagcctgaactacaaagtgagttccaggacagccagggctatacagagaaaccctgtcttgaaaaaccaaaaaaaaaaaaaaaaaaaaaaaaaaaaaaaaaaatgcatacagatgtcttggtaggggttgtttcagtccagccccaggagccagggagacagaaagtgtatgtctcatttggagtcacgggactagagaagcagaagctccaataacctaaaacagcagagggtggacctcccaggtcaagcagaaagactcgatttatccttctataggtctcaatggatgggcctggccctccccacaccagaagtctttcacatctagcatttcaaatgctaattttcccagaaatgtctccagtgacttgaaaatatttaaacagatatgtgcccattcctcagcctagttacaatgatacatggaactgtttcatcacagtaaaggagacaagttcccagctaactctggtttataatcacagtaggacccaatattgctctcttatgatcgatcattttccccaaatgttaagatcctggtttttaaatgtttagtgtaagatcattatattttaaaaatctcttctgctttaatttagttgaaataaaaatgtcagtacttagactgctggggaggctgaaatcatcctattgtaagtctggctcaagttgagctgatcaaactccagcacggtgtcatttattatcctctgaactgcctgagctgtgttcgccccgtgaacagctatagtcggtcacacatgatgaacctgtgcccatacctgtggcacacaagtctcatatgctctgttctcctcgtcccagctcctccatctcaagttggtttatacgacaataattttagaagcagtctgtcacaaaacaagaatgtttgctgggtacaatgtccacacaaattcagtaataataaaaaatgtgagtcaaacaactttatgattaaatgaaggatgctaaccatgcatcaaaatggcatttttggcttaaaatttggtcatatattttagactattacttaaaaataaaatcaccatccaaattgctaaaaacaacgggagcctctgcctcaaggtgttcctaatctagcagataaacacagtgccaagcaaactgttgcaatagcagttttgggaagtggagggggccgagtctgttcctatacagatgtggctgcaccccatgcttccactatatgtttctacatacagggatactgctcgcaaaaagcatgtatagaacttgttaccacctgtggagccacattgtgacaaatgatgtcataatggtgacacacttgcaagtgaaacccagcatttccctaagaaaaatatctcttggctaactgatttcgcgatgctctgttgcaccagcgccctttggagattcacagcacacatcagcctgttaaaagctatgagaaatctgaagaaagataatgtgccttaatgcagcagttttaatctgtggttcacgacctcctgtggatcaaataacccttccacaggggtcacatattagatatcctatgtatcacatgctataattcattaactagcaaaattacagttatgaactagcaacaaaaataattgtatgtttgggggtcaccacaacatgaggaactgtattaaagggttgcagcattaggaaaattaagacccattgccttaaaataaatctctctggatctctatagcatttaattcttgtattttctcaacatgctttgtgatgtacacttggatagcaatcctatgtttcaattttttgccagtatacatttgaggcagcaacacacgaagactataaaaatgactcaaaactagttttctcttaaattatcaataaaattttaggattttaaacatgaaaggagccttgtgggcaactaaagagtgccttatcaaaaggcatgctttatcaagaatgaggaacaaggaaaacaaataaagaatgctactttaattcataaagaatgatctgtatttctagaaaccgcatctctaagatggctaagccagacatgaatgtgaagcacaacaataggtgggaccagcagagccatttacaagcgatttcccgatatcacactgtttactatgtcttagttttcttaagagcagggtgccaggcagagagtgtgatcccagcgctgagcaggtgggtgtgtgcaagaaggggaggagggtcatcccggattagatagctagactgaagatactctgggcctgtctcaaagcaaaaaataaacaaaataaaaggaagaagagagcgaggaaggaaacaggactgtctagattttcctaaatctgatccagacattttccaaccggagcgtgactggcgtacaatacctggaaatactccatttattttcatctccgtattttgtttgaggatctggttgtttcccacacaggtaaacatttctggcaggaggactgttttttggagtcacagctggcttgagattcttttgaagcctcccttagtgtgctgggcaaatatgaagtggagcatcctcaatggaaagaagaaccctagcgatctgccattcggatgcaggcagaacttcctgacagctgctaccaagctctgtgctcaccaggttcatcccatgcagatctgctgctcagttaagagaagctcatgagcaccagggtttgccgtgaatgtttgccttgcctcaaagatgaattatttagtgaactgatttcatcttaaccagtctaggagttagagcactaagttatgatcctcatatctttttcctcaatatctcttgaagcttaattgggctcttgggggacccacagagtgagtatctacaggccacgcttgagagtctaccctataatcctgctggtcctcccaagtaccattaaaataaatgataagatggagcagaatttatcttttaaaacagcaaacagggaaaccatttggctgaataatttatgttgtcttaaaggggaaaggctccagctaggactacaaaacacagtgggtgtaagccttgacctccgggtacagcaaaaggaacctgttgggacggaggattttataatcaggggaacatggttttgtgttgtgtgttgaatgattaggttttgatgcgaaataaatagaattttcaggaactttcggtaataaagatttttctttttttggtttggttttgagacaattttttgagtagcccagccatcctcaaaaattagtatgtagctaatgtgatcttgaactacctctttaaaagttatcatgtataagtatatgtgcatgtatgtgcaggtatgtgtgtatataaagatgtgtgagtgcagaaatgtgtatatgtgcagatgtgtatgtttgtatgaagatttctccctcccactgtgtgtgtgtgtgtgtgtgtgtgtgtgtgtgtgtgtgtgtgtgtgcagggactgtcatggcaccagtatagatgtcagaggaaagctttcagaagtcaattctctcctcgatttcttggttcctgggggcaagcttgggggactaagtgcctctactcactaagccatcctgtaggctctaatcttgactttcttaattcccctgcctctaccaccagaatactggcatcataggcaacctttctatactcattgctgatgattaaacacagttcttcttgcatgttgggcaagcactctcatcaactgagctatatccctagtcctgaaataaagttttaataaaatcatgactgttatgaaatataagggggcggcagtagcaagactaagggtcgtcgccctgagaaatcacaccatgcgacagacttgatataagggaagtttactgtgggggtaaaaggggtagcagaagaggaggggacagagaagggcagaaagagggaaagaaaggcttgccaggaacatgtgggaacagagagagaaaaagagagtgagtgagaagggagagagaaagcaatgaaaagctgggctggggtagtgagcagtccttttatatgctgccaggccacccacaacttacagagtgggaggcaggtgctgatatgctgttgctaggtcactgttgggaggaacctagagggattgtctgtaataaatgataacaacaggagtagtactgatattctggtaaagataatagcctttgaagtcattgcactgtgtgtagctgtggatgatgtggattttcaagctttctgcagcttctcccacccccaaaagacacatcacgatcaagctacatcatcatcatagattttggtgtcatggtttggggtggaaggagtcattgaagtggtccaatgtgtcagcttctcccattccttgtgctagaaggtcatttgatgggtcatgtgttgagtggagagcctgtaaaacccaaggctctcagatgcaatttatacaaacattaaaataaaactaaaggatgagtttagagtgtgaagcctacttctcatgcagggactacccaaatgaaccaaggggaatggctgtggggttaaaaggaccagtgtgactgtaaagcaaagtctcttggggaatgttttgtgcactgtgtattcgaatgttgattctgcaccaggagtccaggcctggcttggtcattattagaaagtatttcctgactcagtattttgtaaaactttggtctccatcaacttctgattggtcaataatgagctggtcagcctctggctgggcaggagaggatagggcagatgtctgtaccctgagagagaaacagagggtctcaggggacaaggagagaaatcaccatggtgacatgagtgaagaaggaagtcctagagtgaaaccaagatggctgggaaccaggccagaccaggccagcagagttgggttagaataaatcagtatctacccagctatagtgcctagaagctacatacgcatgactgaatgtcttcagaggtacaccaaacaatgttcttgggacacagcgctcattcttactttctctgaaatgaccatctcttaaaaaaaaaaaaaaaaaggaagcagctctgttctgaaacacagtttcatttaatttcctgagtccaaagagacagaccaaggtttctatagtgatagtgacattattaagcatgcttgccagcattttgcagtatataatgtataatgtgtatggttcctccagctactcgggtttcttttaaagtgtgaaataaaggatattaaagacaggagaaactgattaagaatgcccccttgatagtatagttcccagatctagcataatatcatgatatttttgtacagaaaagaaagttgttgctgaaaatctatcttgggtgatgtcagaaagtttacagaaagtaggaataagtttaccaagtttctgtccaggtaggaagactagtgagtgattttgggggttgggggaggaaaaaaaaaccctattacatattgttgagcttctgtgaacatttttttcatcaagaatataacaataatggagccggacagacacactccaaatatagaccctttgttcctaagttctatttctatgtaagttcaggcattaaacctggctcctgtgaaaggttactgaatgtcatctctgtggcagcaggaaccaacttttcaagatatggtgtgataatggctttggatttctaatggcctgtcctgctgtgggcaaccataattattcgtcttgcttgtctttcagttaccgatctggggaaatctggaaaggccaactttgttaagaaaaatacccacatgtgtgtttgtgtgtgggggggggagagagagggggggggtccatcacctccaataattccaaattaggaatcaaatcaatgtagtaatctcttgaagaactgtgaacctttataactcgatcaccttcaaatgattgcattcttataaaaggattggtggtcaacccatcaacacctgagccttctaggtagacactttacttccaaatgatagcaggctggccttcaaaagcaacttatatcactagaataattgtccacataagtctcttgttgaaatctgctgtggttggctcagttgagatacacagacattgctaagctcaagtctgaactagctgtaccatctttaagaatagggaggctgtagacaccatcgcatacaccagcaaggttttgctaaaaaggaccctgatatagctgtctcttgtgaggctatgccagtacctggcaaacacagaagtggatgctcacagtcagatattggatggaacactgggcccccaatggaggagctagagaaagtacccaaggagctaaaggggtctgcaaccctataggaggaacaacaatatgaactaaccagtaccccccagagctcatgtctctagctgcatatgtagcagaagatggcctagtcggccatctttgggaagagaggccccttgatattgcaaactttatatgctccagtacagaagaatgccagggccaagaagtgggagttggtgggtaagggagtggggcgggggagggtatgggggacttttgggatagcattggaaatgtaaatgaagaaaatacctaatttaaaaaaaaaagaattgggaggctgtgagattttgagaaaggcactgtaaagagactgtttcctctggcacatcagtgtgcagagtaaatagcaccctatatggttagctggtgtgtctgtgttcacaagaagaaaacaagcccaccactgaagattcaacagtggtttgatatggacgaggtcatgagaatgtctaaaggtcactacctacagctactgctggaatggtggttcactcccaaagcattagaacagaggcaggggttggggctgatggtatagcacctatgttaatgtttttctaaacatgtgtggtttccacttactattcttatgaagttaggagtaaaaagagaaaatgagtgcttggtttctatttacaggaatctcgtggatcttccactccattttcccacacggatttttgattaacacaagaaagttcttttcccaatgcccttttacttatgggaagtaattatccaagtctcaattaaagaccctcctctcctatatactatgacccatttaaaaaaaaaaccctatatggttctgtttttgttattgttgttattttaaattatataaaattataagcacatcattagtctttttctttcttttcttctcttttgctgttattctttgtttttgttattgttgtttttaccgtatcttcagctggtggtggaggtgtttttgaaaaggactatttccaatcttaattttgctttcctatcagattctgtgttttagctaagctgtaaagtgaggagccgaggaacaaaacagacaacctccccttctccacttctcagttctcagatctgacctcagttacaaaagacagattaacaaagcaaattgcactgaaaaaaatttaccatatgtatctacatttttaaaaaatggtgtgtatgtgcatgtatgcgtgtgtatgggtatgcatatgtgtgcatgcatgcgcatgtatgtgtgctagaacatgtgtttgtgtggatgcattacacacatgtgtgtgagtgtgtcatcagggagaaatccaggaagagcaagcaaatatgagctgtgcttagagaccatgttcacctgaaggaaagagtgaattggggtagggaggggcagaagggaggtaatttgcaaaggcaaccataaaattacagtagatggaagagaggcttgttgcttggatatacatccatatcgtctgactataatcagtaagtttattaccacttagcaatattgctttgtgtctgaagcagatggtcagagccccgtctactttatgggattcttgggagagtgccaagaagagagttttcagcatctccaacttatccatggtcctctggattcttagtggttactcttgacatgtttccatctctcccttttggagacagacatttgctctgtatttctgctagccttgaactcactgtgtggtccaagccagtccccgatttgaaacaatcttcccacctcaagtctgcagagtgctgggatacaggtgccaccaccacacctgcctttttctctatcttttgcatggaattttgtgtgactgaattcttaaaattgattcttttctttttggcgtgtgtgtgtgtgtgtgtgtgtgtgtgtgtgtgtgtgtgtgtgtgtgtgttgtacacatgtgtatagtacatgggtctcagtagccaggagaggatattgtatgtcctactgcatcactctccatattattccttttgggacaaggtattttactgaaactggagtcaggctggtggtaagcaagccctagggatctttctgtctccatccctattatgctggacttacgagcatgcatacagccaggccagcctttttacatggggtaggtcttgaactcaggtcctcatgattacacagcacacacccttattcacgaacatccagtagtgtagccccttaagtgggtttcttattccaaagagttgcacttgttatataagaaactcagttcagcttccctatgcaggtgattgatttctgtgcacatgtaggaagtttcccaatgtcatgcagcttccaaatacccacattgcaagacaagtgccttcagtcactgcacccgtcttggagggggctctaagactgtcaagtatcaaacaaaatggtcaagtaaccattggatcaaacaaggatggcaggagagtgagttctgcttgataactagcaagcataggacacgcgacaagcaatgcatgagagttttagctaaggtgatttctca

(The sequence listing continues in the following parts.)

What is claimed is:

1. A single stranded oligonucleotide produced by a process comprising:
    synthesizing a single stranded oligonucleotide that:
        (a) has a sequence 5'-X-Y-Z, wherein X is any nucleotide, Y is a nucleotide sequence of 6 nucleotides in length that is not a seed sequence of a human microRNA, and Z is a nucleotide sequence of 5 to 8 nucleotides in length,
        (b) is complementary with at least 8 consecutive nucleotides of a PRC2-associated region of a UTRN gene, wherein the PRC2-associated region is a region of the UTRN gene that has a sequence that occurs at a higher frequency in a sequencing reaction of products of an RNA-immunoprecipitation assay that employs an antibody that targets Ezh2 to immunoprecipitate RNA-associated PRC2 complexes from cells comprising the UTRN gene compared to a control sequencing reaction of products of a control RNA-immunoprecipitation assay that employs a control antibody; and
        (c) is 12 to 15 nucleotides in length, wherein, during the synthesis,
    at least one nucleotide incorporated into the oligonucleotide is a nucleotide analogue and/or a modified internucleotide linkage is incorporated between at least two nucleotides.

2. The single stranded oligonucleotide of claim 1, wherein the oligonucleotide does not comprise three or more consecutive guanosine nucleotides.

3. The single stranded oligonucleotide of claim 1, wherein the oligonucleotide does not comprise four or more consecutive guanosine nucleotides.

4. The single stranded oligonucleotide of claim 1, wherein at least one nucleotide of the oligonucleotide is a nucleotide analogue.

5. The single stranded oligonucleotide of claim 4, wherein the at least one nucleotide analogue results in an increase in Tm of the oligonucleotide in a range of 1 to 5° C. compared with an oligonucleotide that does not have the at least one nucleotide analogue.

6. The single stranded oligonucleotide of claim 1, wherein at least one nucleotide of the oligonucleotide comprises a 2' O-methyl.

7. The single stranded oligonucleotide of claim 1, wherein each nucleotide of the oligonucleotide comprises a 2' O-methyl.

8. The single stranded oligonucleotide of claim 1, wherein the oligonucleotide comprises at least one ribonucleotide, at least one deoxyribonucleotide, or at least one bridged nucleotide.

9. The single strand oligonucleotide of claim 8, wherein the bridged nucleotide is a LNA nucleotide, a cEt nucleotide or a ENA modified nucleotide.

10. The single stranded oligonucleotide of claim 1, wherein each nucleotide of the oligonucleotide is a LNA nucleotide.

11. The single stranded oligonucleotide of claim 1, wherein the nucleotides of the oligonucleotide comprise alternating deoxyribonucleotides and 2'-fluoro-deoxyribonucleotides.

12. The single stranded oligonucleotide of claim 1, wherein the nucleotides of the oligonucleotide comprise alternating deoxyribonucleotides and 2'-O-methyl nucleotides.

13. The single stranded oligonucleotide of claim 1, wherein the nucleotides of the oligonucleotide comprise alternating deoxyribonucleotides and ENA nucleotide analogues.

14. The single stranded oligonucleotide of claim 1, wherein the nucleotides of the oligonucleotide comprise alternating deoxyribonucleotides and LNA nucleotides.

15. The single stranded oligonucleotide of claim 11, wherein the 5' nucleotide of the oligonucleotide is a deoxyribonucleotide.

16. The single stranded oligonucleotide of claim 1, wherein the nucleotides of the oligonucleotide comprise alternating LNA nucleotides and 2'-O-methyl nucleotides.

17. The single stranded oligonucleotide of claim 16, wherein the 5' nucleotide of the oligonucleotide is a LNA nucleotide.

18. The single stranded oligonucleotide of claim 1, wherein the nucleotides of the oligonucleotide comprise deoxyribonucleotides flanked by at least one LNA nucleotide on each of the 5' and 3' ends of the deoxyribonucleotides.

19. The single stranded oligonucleotide of claim 1, further comprising phosphorothioate internucleotide linkages between at least two nucleotides.

20. The single stranded oligonucleotide of claim 19, further comprising phosphorothioate internucleotide linkages between all nucleotides.

21. The single stranded oligonucleotide of claim 1, wherein the nucleotide at the 3' position of the oligonucleotide has a 3' hydroxyl group.

22. The single stranded oligonucleotide of claim 1, wherein the nucleotide at the 3' position of the oligonucleotide has a 3' thiophosphate.

23. The single stranded oligonucleotide of claim 1, further comprising a biotin moiety conjugated to the 5' nucleotide.

24. A single stranded oligonucleotide produced by a process comprising:
   synthesizing a single stranded oligonucleotide that:
   (a) comprises a region of complementarity that is complementary with at least 8 consecutive nucleotides of a PRC2-associated region of a UTRN gene, wherein the PRC2 associated-region of a UTRN gene, wherein the PRC2-associated region is a region of the UTRN gene that has a sequence that occurs at a higher frequency in a sequencing reaction of products of an RNA-immunoprecipitation assay that employs an antibody that targets Ezh2 to immunoprecipitate RNA-associated PRC2 complexes from cells comprising the UTRN gene compared to a control sequencing reaction of products of a control RNA-immunoprecipitation assay that employs a control antibody;
   (b) is between 12 and 15 nucleotides in length and has at least one of:
      i) a sequence that is 5'X-Y-Z, wherein X is any nucleotide and wherein X is anchored at the 5' end of the oligonucleotide, Y is a nucleotide sequence of 6 nucleotides in length that is not a human seed sequence of a microRNA, and Z is a nucleotide sequence of 5 to 8 nucleotides in length;
      ii) a sequence that does not comprise three or more consecutive guanosine nucleotides;
      iii) a sequence that is complementary to a PRC2-associated region that encodes an RNA that forms a secondary structure comprising at least two single stranded loops; and/or
      iv) a sequence that has greater than 60% G-C content,
   wherein, during the synthesis, at least one nucleotide incorporated into the oligonucleotide is a nucleotide analogue and/or a modified internucleotide linkage is incorporated between at least two nucleotides.

25. The single stranded oligonucleotide of claim 24, wherein the oligonucleotide has the sequence 5'X-Y-Z.

26. A composition comprising a single stranded oligonucleotide of claim 1 and a carrier.

27. A composition comprising a single stranded oligonucleotide of claim 1 in a buffered solution.

28. A composition of claim 26, wherein the oligonucleotide is conjugated to the carrier.

29. The composition of claim 28, wherein the carrier is a peptide.

30. The composition of claim 28, wherein the carrier is a steroid.

31. A pharmaceutical composition comprising a composition of claim 26 and a pharmaceutically acceptable carrier.

32. A kit comprising a container housing the composition of claim 26.

* * * * *

UNITED STATES PATENT AND TRADEMARK OFFICE
CERTIFICATE OF CORRECTION

PATENT NO. : 10,058,623 B2
APPLICATION NO. : 14/401196
DATED : August 28, 2018
INVENTOR(S) : Arthur M. Krieg et al.

Page 1 of 1

It is certified that error appears in the above-identified patent and that said Letters Patent is hereby corrected as shown below:

In the Specification

At Column 1, Line 15, before the paragraph titled FIELD OF THE INVENTION, please insert the following paragraph:
--GOVERNMENT SUPPORT
This invention was made with Government support under Grant No. R01-GM-090278 awarded by the National Institutes of Health. The Government has certain rights in the invention.--

Signed and Sealed this
Eleventh Day of December, 2018

Andrei Iancu
*Director of the United States Patent and Trademark Office*